United States Patent 11,001,841 (CCCTC-BINDING FACTOR (CTCF) RNA INTERACTOME) - sequence listing, part 35

SEQ ID NO: 84326 - DNA, 1726 bp, Homo sapiens
ggctggagtgcagtggtgcaatctcagctcactgcaacctccacgttctgggttcaagcaattctcctgcctcagcctcccgagtagctgggactgcaggcacgcaccaccacgcccagctaattttttgtatttttagtagagacggggttttaccatgtttgccaggctggtcttgaactcctggcctcaggtgatccacccacgtcggcctcccaaagtgctgggattacagatgtgagccactgcgtctagccatgaattttaatctagtttgtttagcaaggtgttagccagtaaaatgttttaaggccaagaagatgactacattgtttttcaatgtttaaatccaaaggattctctcagttgttggaacggtatttattagcagatacattgatattttagtttacatatccagagacgcaggctagaaaacaaacagggacggctctcaggttgtcggtgttcttgacgttcacaggggcactgcatttaaaaatcagcttgcttgaaaggagcaaggcccaagctatatgaatcagtaaaagcagcactggctatgccatagctggaacactatcaatattcagtttcttcaacaaactccagaaaaaacactaaatgttttactgccttactaataaataacaaaacaaaaactcataaatattagtaagacaattttatttattgctttactaattaataacaaaataaaaactttgttctaactccacgcattccaaaatagtatagtttgacctatcagagaccacagccatggcccctccactaacttttcatactttacttggaagcaagttactattacagaacattaggctgcaaaaaagaaacaacaaaaaatttaaacaagtcatactctttttaacatcagtgaaatagtccaatgtatctgaaaatgaaaataaattgttttgaaattatctccacggtgactttgttattttcaaaagtacatatattatattacctctgcatataacctctttttgggggccgggttggggagacctaaaagagcgagccgatgaccatggcaggtgtaaataagaccttgctccaaacgtggcgtcttcttactgcttctgcttgcagcgtttgactctctgctttctggtgatccgccgcttttccatgtcctgggtgaaatatttgcttttatgattacatctcaaccgtgttgctgcttaggactgaatgtgaaactgatccctctcctactttatcttctttttcctgtgctgtaacgagaaatttaatgacttcagaaaatgtagagcccatgctgcaatgaaaatgtggcagaagtcaatgcatctgaattatgacaaaaggatattcaaccatgaagactgccctcaataactttttccttggtagatgaaactagtctctaaaaaccaacaagcaaacaacaacaacaacaacaaaaaaaaacaacaaaaataaaaaacttttttctttttaaaacgtgagcccaccgaaattaagattttaattttgggaagtcaaccaaactttggcaaattatgctttaggaattatttactctatattgtcttatttcagctcatggaaataattttggttttgttatattttagagttaatactattaatgaattgcaagctggtatcaatttttctgcaccttttttggtaacgtgatatatatatatgtatatacatgttggccagg

SEQ ID NO: 84327 - DNA, 1007 bp, Homo sapiens
ttattttcatttgttatatacaagtattttaattcttaaggctaaaatttaaagttctatgaacaaataatgtatggtttttgtaaagaatacaagattgaggcgctcagaaatttattttacgttttggatgaatttgactttttaaaaagttaatgtggaatataaggttgtcttttggttgcaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcac

SEQ ID NO: 84328 - DNA, 1077 bp, Homo sapiens
agctgggattacaggcatgagccaccgcacccagccatttatttttattcttgacatggagtcttgctctgtcgccaaggctggagtatacaggtgcaatctcaactcactgcaacctctgcctcccagatttaagtgattctcctgcctcagcctcctgagtagctgggattgcaagtgcctgccaccacacccagctaatttttgtatttttattagagactgggtttcaccatgtcaaccaggctggtctcgaacttctgacctcatgtgataacacccactttgggcctttcaaagtgctgggattacaggcgtgaactaccacacctgactgagagtagtttttacatgtttaaaggattttaaggaaaactcaagaatgtagcccctccagtataaaatatatactaaatcttcattataggggattcagtgtttggcttattctgtttactggagggtttagttataacttcttagagatttttggttttgtcttgttttatttaggaagcgttgggagatgttgtttattgtagtctccctgaagttgggacaaaattgaacaaacaaggtgagtgttcttaggatcttagaatgatccatgccatgaattttgtttacattgaatagtaatttgtttgtaccctggattaattagagtgcttttttttttttggagacagtcttgctttgtcacccaggctggagtgcagtggcaccatctcggcccactgtaacctctgcctcctgggttaaagcgattcttgtgtctcaggcacgtgccaccacgcccagctaatttttgtattgtagagacagagtttccccatgttggcaaggctggtctcgaactcctgacctcgagtgatccgcccgccttggcctcccaaaatgctgagattacaagtgtgagccaccgtgcccagccaattagagtgcttttgacccaagtattaggttggtgtaaaagtaattgctactcagaggctgagacaggagaattgctggaacttgggaggcggaggttgcagtgagccgagatcccatcactgtactccagcctgggcaaca

SEQ ID NO: 84329 - DNA, 1050 bp, Homo sapiens
tctcttaggtcaactctgcctaaagaggcacctgattattactgttatttttttttttaggttaaatcatttcttatatgagccatctttatgctgcctccctaaacctcatcaccccaaatttgtcttcagaggcacagatttttttttctgcaagacagaccagtaatagttaagtatacatttgaaatatgctccaaaattttcttttgtgatttaggctaagtaatgttaaagcagataatccaatctccaaaagatgcacaaggtgttcagatgaagccatctttgcttaaatggtactgctgtttaaatgcgtcatctctatacatgatcttcattctttcctgagccatgcactatttaaaggtagtgtcaacaggtcaaacagaaattctgggaaagtcttttgaaagcaatggtaatgaaaagtgcttcttaagaagtaatgctactgcttttctgaaatgttggtcttctgttttagtgcgtaaattcacagagaaacacgaatgggtaacaacagaaaatggcattggaacagtgggaatcagcaattttgcacaggtattggattatattgaaatatttgtcccagtgtgctcttgcatgatttgctttatctctacctttttaaaagtgtttaggctgcgtgaggtggctcatgcctgtaatcccaacactttgggaggctgaggcaggaggattgcttgaggccaggagttcaagaccagcctggtcaacaaagtgagaccccgtctctaccaaaagttaaaaaaaaaaattagcctggcatggttgctcatgcctgtggtcccagctactcaggaggctaaggcaggagggtcgctggagcccaggaggttgaggctgcagtgaaccatgatcatgtcactgcaaaatacaaaaattagctggtcttggtggtgcacacctgtaatcccagctcgtcaggaggctgagacagaagaatcacttgaacctgggaggcagaagttgcagtaagccgagattgcaccactacactctagcctgggtgacagagtgaga

SEQ ID NO: 84330 - DNA, 1010 bp, Homo sapiens
ctcaaacggacttgaaataactgggaaacctgcccatgaatgtttcggccatttgtgctacttcagcacaattattgcaggggaaaaacaattttctttttttttttttttctttttattgagacggagcctcgctctgtcgcccaggctggagtgcagcggcgtgatctcggctcactgcaagcgccacctcccagattcaagcgattctcttgcctcagcctcccgagtagctgggttcactggcgcccgtcaccacctccagctgagttttgtatttttagtagagacagggtttcgccacgttaggctggtctcaaactcctgacctcaagtgatccacccgcctcagcctcccaaagtgctgagattacagtcgtgcgtcaccgcgccaggccaacaattttctttacgcccaaatgtttgatacactgactgctcctctgcttcgattgcgtagatcagtgatggctcttgtctcattagctcattgttttagaaacctgtttggagctggaatggttgataaatttattccaaaatttgtagcataaagatttacttatgctgtcttgctaatagtctgtccgctctgtttctgatagggatccctacatcactaatttgaatacaaaggtaaagcatttctcagataagaatttagtttcaagtctgtggttttcgttccttttttttttcttcttttttgagatggagtctcgctctgtcgcccaggctggcatccagtggcaggatcttggctcactgcaaccttcgcttcccgggttcaaacacttctcctgcctcagcctgtggagtagctggacgacaagagcacacctccatctcaaaaaaaaaagagaagaaaaattgactaatactaatataaaatattttatctgactagtgacattgaaaaaggaaaatgcaaaattttcataaattgctcacaactcctaattttccgaggccaaaaaccacctttttcaaggcccagttagaaagtaatt

SEQ ID NO: 84331 - DNA, 1023 bp, Homo sapiens
tgttctgtcacccaggctgaagtgctgtggcatgatctcagctcactgcaacatccgcctcccaggttcaagcgattcttctgcctcagcctcctgagtagctgggattacaggcatgcgccacaatgcccggctcatttttgtatttttagtagaaacagggtttcaccatgttggccaggctggtcttgaactcctggcgtcaagtgatccaaagtgctgggattacaggcataagccaccactcccggccagtactttctaatattaactgatcccctcatcacagaattgttattcccatttcatagatggggagagtgaggcatggaaggatagactcacttgtgaagggcgcctggatgagatgtcgcagagctgggatttggacccaggcaggagatcccatggtctgtgactttactcctctccgctgcctctataaagattggttccattgtcaccacagtggcgaggggctggtctaggaggcctttccatttcctgacttggactgggtgggagtcgtggatcctgcctgagcagggactgtgcctccctccccagcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggtaagtcctgaagccctggggctgtgtcagcctccttgtgccttctggctaggaacagacgtggggcactgtcagcatcagcctcataagaaaaccaggccaagtgtggtggcttacacctgtaatcctagtactttgggaggctgaggcgggaggattgcttgaggccaggaattcgagaccagcctggcaacatggcaagaccctgcctctttgaaaaatacaaaaattagctggatgtgatgcctcatgcctatagtccctgcaact

SEQ ID NO: 84332 - DNA, 1003 bp, Homo sapiens
gtattttattcttacactgttttctctcttgacggagaattgactcaaattctttccttcacttttaataaaagcatcaggcaaatagatacacctagacaacagccagtggcaatgaagtaccttttgagtaaaaccattagttcactggaaactgtacgggcaggaatagtagacaggaaatacagggaggaaagaaagttgtctaaataccctctgtatactgtcatacacattatatatttgatgttaaagatgtacaagggccttctactgtcaccagaatggactggcttccttctgctggtacatagctgtcattccaggatcattcttcaccattattgtgcatccctttcacttccttcctgtttggattgcatcttgttagtatccagaatcttccactttcttgatatattcctttgtttttttggggcacattttctaacaccatcccgagaaaggttgcatgggaagtaaattgttttgtgacttcatatagctgaaaatgtctttgttcccccctgccacttgattgatagtttggctggttataaaaatctaggtctgaaataattttctttcagaattttaaagtaatttcttctttattatttaactttcatttacaagtatgaagccattctgattcttgatcctttccatatagcctatttttctttctgaaagcttgtaagacttttttctttatttctcgtatcctgaattattatgatgatgtgctctggagtgggtctattttcatccgttactgagagtacttccttaatagtcttatcttttttggttggggggacattactttttttcaggtgttgaaccttctggactgatcttccagttttcttaacttatctctcattttcttttttaaaaaattatttaataaattttaaaaaaaatagaggtggggtgtcgctgtgttgcccagtctggtcttgaacacctgggctcaagcagtccttccaaagtgctgggg

SEQ ID NO: 84333 - DNA, 1057 bp, Homo sapiens
ggccctcactccttctggcctccatgagtttctgaaatcttccaggaatgccctcaccccagccttcacatttatcctgccctgtgcagatgccagcgtggcctgccccctcctcgcagcaccttctcagcgggcctccctcctgcctcttagctttcctgtccccgtcttcgtacgacgtctcaccatctcacggaccaggcatttaaagtttttcacataagctctttgatggcagagaattacatgtgttctggtcagtatttcattttcagcactagaatcgtgcttggcacgtagggtttactacataaatattcattgacaaacggacatgaaacacctagggcttctatgatcccaaatagccttggcctgaccctgtcctccacagccctttctgccatagtttatactagcctttcccacgtcaacttgaaaacactgccctttgttatgcaaaaataattgtattgaaccagaggtaacagttcattttcttgttgtgagctattatgggttaaaaagtgaggattttctgatgaactcaccatgtatttcttaagtttgttttgagaagtggctttggcctctctggctgttgtgctggaagagtgggctgttagggaagccagaaatctttaagaagcattaccggagaaatggttttgaacgtggtacttccatgctggaacactgggaaaaaagatttctctaatttttaaaaatagtttcaacttttattttagactcggggatacatgtgcaggtttgttatgtgtgtatattgcataatgctgaggtttgcagtaagattaatccagtctcccaggtaccaagcgtcgtacccaatagttagtgtttcagcccttgctcctctccctgtctccttgctctaggagtccccattgtctatttttgccatctttatgtttctctaatttttattaagtgtatgaatatcagctttcaatatgatcattggccttgtgtgttcagggatcgctaatgtaatttcaggcaagacataacttcggaattgtggagatagatggga

SEQ ID NO: 84334 - DNA, 1051 bp, Homo sapiens
acatgctgtttatgactcaatacatgtttcattctagcacagacaaaactcctatctgtagcgactggcagcatgtcggtggttacctggcagtggaacgtggggtcgagattggcacagtgcctgatactgctgatgactcaccaagcttgctgtgtcagtcttcctagatgttgttgtcatccttttgatttccttaattttgtgcatgggctttgttttcaggtggatctatcttaacgaccagaatttatgcatccccgccagttcctcttttgtttatggagctgtacctataggagccagtatttatgttattggagatcttgatacaggtaagagtgttacagtgattttcttggaactgtttcctggtgattctgggtacattttctcacccttgcttatttctgtggcttaggtaccaattacgactacgtgcgtgagtttaaaagaagcacaggaacctggcaccacactaaaccactccttccatccgaccttcgccgtacaggatgtgcagccttacgcattgcgaattgcaagcttttccgcctgcagcttcagcaaggcttattccgtattcgtgttcattccccttgaggaggaagcagagcagagtgcgagatcctgacccaagagcaccataacatagctccgaaagggagagcagagatggcagctgaaactcactctgtgctgggctttggtatggtaactctttggtggttttatgatgcttacaaacttgagctttagctcttgtttgggagaacacgtaactgttgaaaaactacctgggaggagtgagttcctccagttaaatgtggctgtagatgttggaggctagggaggctagtaaatatcaaaaggaaaagggagtgggaattgctatcatgtaaaatatcaaagttaaaatactaaggtgcattttccctgaagggaactcatgtctgactgctgtattcaaatacgtagctttggtaacaaacaaaatccgtatatgcaaatcaacatatccaaacatgccaagactgcttttccactgcac

SEQ ID NO: 84335 - DNA, 1046 bp, Homo sapiens
gataaaattgctcttttgtaactttatcttagtaatgtaaagattcagtaaattgatgagtcaggttgcagccctcatgtgaactgaaagaagttgctcgcttctgtgttgacttagatcaagacacgtcacgcatcctttctggggtagtacctgtggagccgggaagggtctcctgcagtgccattctgccttctcaatgagcaaaaccattttctaagtatgaggatattagtgagtaggagattttataaaagaaagacctgagtcagacaaataataaaggtctgctgtggctaaaaaagcaaaaacaaaaaagctatccagacaaaatacatagggatcagaaactttttcatataacctgtctgaaagcacacaaagtcttgtttactactgtttagggtttgaaaacttgtcttagaatgcgaatctgtgttaagaatctagtctttgtaatagaagtttcccagtggcattcactagtgagagttttagacaaattatgttacgagtaaagtttggctggtagaataaactacctcaacttaatttcattctgttcatagtagagcaaattaatcttttcctccttccctcctttcctatctctcattctcacctcaacccactttaccccacttctcattgggggaaaaatgtctttcgttcgtggaacgtatcttgtaagatattttgttttccacttgaattacaccaccctagtgtgaaatcggggacttcaaagtgcttgattccttcctaaattgaattttatgcaatgtcaaatttctaatcaatttaatatacagtacttcatttttaattgttttctaaaaaaaaggttttttttttccttttggaatatggctgtaagaagcagcattttgtcttattaacacatgtataaaggtatcctttggttttaagtcgagaacaggaatttcttctagaaacttcctgtatggaacgtttatatgcaattaacatgcatatgaaaaacatcacttacgttctcccacccatagacataaaaaagggtgacc

SEQ ID NO: 84336 - DNA, 1075 bp, Homo sapiens
tgtttggttcctcggtcttgtaccccttcagttcgccggcgacgtaatggtgataccctttgttttttgtatcataccttttgtgaattgtgacaaccatcccgtaatcattgtggcctcagcagaagttttgaacaatctttgcagccactgttggggtgtgtaccagcagcctggaagtgaccagcagagctgacaaaagcaccccctgctctgcccacctccgcagagtcctgtcctcatcagaaacggtatcgcggatgctcctcaggtaggcgtaggcagacttcattgtgtgttagcagtgacagtgatgtctgtacctatctgtgagtgagacccattcatgacacactagaaatgtgtacattcttttgttttccatcacgggtataggtcttctgccatgaaagagaactatcaaggaaattcctgaaaacaagatttgtaaattcgatttgaccctcccaaattcagggctgctctttgcagtggtccctggcccagcaggtggccggcgtggctcctgttggctcatgccagtgttgtgctggaccctcgagtatgtgactgtcacccttgtccaagactggtttttaacagtcttgatttgtcattttgatgctttgaatactataaggaaaatgccacgaataccatataaataccacaccaatctgttgaacatatctgtgttttctgacatgggacctgcagaatagtatttcttttaaatcctgcaactttattatctagtagaattccaagtaggtctgcttagacacatattcagtgaagattgtattgtgtgtgatattatcctatctttaataaagtcctactactgaaaaacagggatttgcaatgaaaatcatagctaaataggcaggtttagaaagttcaaaatattggaagtgctagaaggctgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataa

SEQ ID NO: 84337 - DNA, 4033 bp, Homo sapiens
tggtgaccgcggtgccccctgcctggattctggagaccccagatctggcttcagaattttcacctggctcagggggactttattgggctttttttttttttttcctcttacactccacaaaatgaagggttgttggtggtggggtaggaaaatggttagaaggaacagtgacctgccatgggaaggccaggaggagccccttctccctctgggagaagccaggagtgagtgtcccgctgctaccgtcctgtttccggaaagccagctctcgaggctaatgcctccccacttacctccgattgctcaggaggtatatctgagagaaagagggaaggaagaaagacctgaatagccagaggcccctcgctcaccttggccagcccaggtaggtggcaccatcggtagtgtgggcctttccggaaagcacctgtctagtactggggactgaggcttatccatggagcaagattctcttggcagagccatgctctggtgttaggaaatgtggcaagaggaactataaggaagtgtttgatggactggcataatcccctttccgctgcctttcgtcaccaagcactacaggcagggggtgtccttaagtcttacccttgccctctggtgggctccagggggccttgcctcagggcctgtgagcctggaggtggggctgtgagggctggcctggctggagcgctggcctcccgggtagaggtgaggttgggactgccaccagggctctcgtcccatcatgagacacctggttggtgtccaggctctcggggaagcagcggagcccctgtggggtttccctgaggcctggacattatgtaatctgtctgcgttttatagtgcggcccaagcactctattgagaaatatgagcccaaataaaacaaaggtgaatttgagtgcagttccctagaacaaaaaccctttgcagtcctgtggcttcgcagcagccgctggcccagccctgagctcccgatattccaagtatgtttcctatagagtcatatccttacttgaaatatcagtcatccatattttaagccatctacacagcccaactcagaatcatctggtaattatctggttaattgtatgggcttcaggaacaagacccagagtgattgatagggattcaaaccaataaacaagccaaatactcttttttgcccaaaccttttgcagtctgtttccattgatccaattaaccgaatctgagagatttaagaccgtgcttccaggagcacatctgcatcaggctgggatgcaggcagactcgggctcccagtcccacctgctgggtgacaccggctaggtacaccttttagtctggggtccaagggacctgatagccctccaggctgtcttaccggtggagccagcagcctcacccgcctggcctgcctgtaaactttgcctcctgtgggatcaggtcgcagcttgccctgccctggtctcctgggccagttactgattaaatccttgcagagccaacagcgtgcctaatgtggcttgtgacggccgccaggtctgatgcaccctgtgcttggagactttggatccgaaatgctcgtaaacaaaggaggaagcagataggcgacagctgacttgggaggggagatagggaggccagggccccctcccttggggacccaggactgcacctttgtggggaagggcctgtctgcccaggctgtggcctgaatgtggtgccccattccctctttgtacccaaacttcccagttcctgggcctcactggctcttcatggctggtgatggtcgtgttggttgtaaatgacagccagggcagccaggggttctgcataagcggccgggttcggcaggaccagaatccattttgctgctctcgtctgtgggttgaatttgatcacctgctaggcatgtttgtccgtgggcagagggctttgtctgtaggctttgtttcttctgcaccacagaagtacaaataagctgcctaccttttatttcatcttacttttaagagaatgtggcacacggtatttcagaatggtggatccactcagaaagtcctttattcaggggtcggggcacaggtgacagtagtgttctttattctcaagccataattcatcagtggcttgtttttaaattttcaccactctgctgtttgattgcaatgtttctgggcatcttgatatggatgggaaaggagaagccaccttcattctcattggtttctttagtctggtgttttctgaacttggactttgtttagcacaggcttactgcatgcctactgtgtgtcacttgctgagctaagagttacacatccacatggcttggtttctacctaagaattaaaatctatgtcctccagggtagtcacagatcccacgagaactcatctgtgcccacatgcacgcatgttaattgctttttcacttttgttacataccccccttccccccatgtgcctagcctgcctttaatttatttgatgtttttttgtggcagtaaacacacagatttccccccccccctttccatgccatttgtcataggaggattttggagtgtatcaaaattgtttcctagacaacttgtctgattggaggtggtggaggggaggggctgagacagagaggagaaaaagtcaaaattctctgtaaattgcaaacgtggtctgcctttcccaggctgtaataagtaagtgcattttaaggaaggagtaagttttgatgctcgcatttgcctggtgcaatctgagatgcctgttccggccacggcaacatcatgccagtccaggtggaaggaatttcactgcatgtggctgagctttcctgcaagtgggtgacagaggtggcagttgctgctggcttgggctgcttggcccacagattgactgatgtggcggccctgcctgctccttagtgtctcatcgggcagtgagagggcatttctggggcactgtcctgggcagggctcagggggacctggtagaaggcaaagctgtcccagggtacctcaactgctgccagccaggactgactcgtcttgaaggtacccaattggtgttttgttggcatggacattgcagggggtcagcttacacctttgattaaaggaatacatgagattaggtgaggcagcctgatatggggcatctcctctgtgggggagaacagatttgggttttgcgttctcatggcgctggatctggatttgaagggtgcagtttcctggctgtgtgacttttggtgctttgctttcccttgctgggccttgtttttcctccatccttagggagagcacctcatgtctagggttgctgtaaggattggagaggatagataagcacctactagtatagtcagcatacagtgaccaggattccaattcctgttttgctaattgccctgaaagagcttcatgactttctgcacaaatggaagggattattgttacctaaaaatgggtggcctccagagagttccctgagatgaatagtgcattggggaaagctaggggtgtttagcaggtctcataggtaggaaggcaatgaaattcttgccagcagtttaagaaaaattccttgcggggcgtagtctagtttcttaaaataaattacaaaaattgaaatactcatgtatgcatcaggtagatttgattagtataacaaggtgtttaatgaaaaatgaagcttcccttactcgacgtccacacagcccctagtggccctccttggaggcaagcactgctgctcatttcttgtgtatctggacatgcatgcacacagctgtctaccgtggttcttcactggacagtatattttggagaccctccatgcgtgtgcagctgccttgttctttttcattgctgcatagtgttctgttgtagaagtgtatcacagtaatgtaggtagaccctcccctgttgatgggcattgaggttagtcccagcctctttgatatggtttggatgtgttcccacttaaatctcatcttgagttgtagctcccataattcccttgtgttgtgggag

SEQ ID NO: 84338 - DNA, 2537 bp, Homo sapiens
ggactaatacactcttgttccttgaaagaaaacattttctatttttactgaatggagttgtctctattttgatgttcttttgcttaattctttgggatgggggagctgagcctccttttgaagagggaagggcagtgtttcctggggttattgctacctggagtcatgctttgttctggctgaaaggtcaccaaccagggatccccctcagagggtctggccacttggtcttccctgcagctgaaggaacataggtgaccagggggctctgacaaggatgcgctgacttccacccacagaacaagggtctgtgcagctccacctgagggcattgctttttgttccctgacttcctgctttccccaggatggaagccaggccacccagccccatggtggaggaagagaggaagtgagagtttctcttccttgctcctggctctggtgatgaaccacccagtgtattcaacaggcaccgagggagactgtgcgcattttgaaaggaagcttcgcttacatcagcagagccctaaccgaagggtgatgagacgtgcgtgtgggggaggtgtttgctgtgtgtattgaggcaaaggagatggcagagaaaatatttctggtgctgaaattggttcctgacttcagtagccatttcgttacccctcccatgtgcacagcgctcgtcctggcatttggggtgtgcagtgaggccacaggaagagaacacggcagacccagtggagtaggggagtgaggacctggactttgaaatcagacaggggagcttgaatcctgcctctgcagtgtcccaggtggtgaccttgggcaggtcccctagcctgtgtccttatctgtaaagcgaggatcagagaaacttcctcttagcattgatgtcagggtaaatgaggtgaggcctggcggtgctttcatgcctccattcagcagttaagtgtcaccgttctaggcactcggaagaaaacaggagcctgccctcgtggagcctgtgttggtgggagtggacaaacaactaagttaagagcaagtaattataaaatccgatgacagggatcgtggagaaaagcaagcagggtggggcgagtggtgggctgctttgtacatagtggtcagggaagcgggtgataggacttccagggggaagagcgttccaggtagagggaacagcaattgcaaaggccctgagggaggagatcatctgtggaaatcacccagtaaagtggcttgcacctggtacatgttctatgattgtcagtttccttcctcctgctctgtggagctgttattatctgtttaaaaaattaatgagtatgtagaatgtgcgaggtgatggacacacaggcagctccttgccccgtaaagcttccattcttttgcttctgttgtgtgttttttcttttgttttttttttgttttgtttttttttttttttttttgcaaacctggctgcctcccaataaatagtgaagaatagccctggtagcagtgccttaagagattcttaaatgacaaagcccagcagaactttgaaaacgcaactccctttgtccataactacactctaaggatcctaggatctagaacacactagtgctctgattcacctctggttttgccagcgaggaaggggtgaggggaagtgtgtcggcaaagacccttgcagctggctcagcagcccacctgggattcaaacccagactcctgccttcccatggcatcctttgttcgtggctctactgctttcaagctactgtcagaaatggtagggtggacggagcgactaaactgattgtgctgggcgaactctttttggagggaagcacgtggtctggatcgtctggtccctggtggatataggatttgagtgtatggaatcaaacagccatctgggtgcttcccttgggctgggctggctgcatccagctcaggtggggtcatatggagaaggaagatcacaccgggactgctgctagcttctctgggtgtcctgggccagtgccagtttccttagaggtccaggatatctgaaaattggagcacacagtctgagcagacccaggcctggctctcctccctcgcatgttggctccctgtgtggactaggtgaccctgtttaccaacacacacaccggtgcgaggctctgcagggaaggagagccacgggtatggaaggggctgtgtgttccccaggcaggctagctgccgtaacacgcagccctggcatctgggtggcttcatgcagcccagttcttgcagtcctgcaggggtctcccgagggttctgccccctctttttcttgtgaaatgggtctgccctcccctaggtccttcattgtcagggggatggggaaagagtgagcaccacagccaagccgtttgtagatctggccgcttggttggctagaactcagacacacggccacacggagtgcaggggaagacttgggaacatggtttacatgtgcgtctgggaggaagaggagagcatggaagcgatgactactcccaccccagcatccttgggatg

SEQ ID NO: 84339 - DNA, 1264 bp, Homo sapiens
ttaggtagaaataagtgagcttttcagtttagtgtttgccaaggttggcggacattcctttgtgattttgtcaaaaaagttaagggaaccgatgtgggaaattgaatgccagctattcgtaaagggtaagcattaggtgtataacttgaacaccatatattatttgtgcaaattgagtgttctggggcactgttcttgcatagtgagtgctctcaggcatggcacttggaaagtcagacatactcttccctcccaagggactcatagttaaatgggggtattacaattatgatacaccattgaacaaagcacattgcttagagaggtttatgtcttgtcctgtgtttggacggaggaagagacgccatcatgggggtggggagtttcaggaaggacttctttgtaggagacaggcatctggatggagaggtaggatggagactgatggagatgagggtggcaggtcggaggtgggaatgagcagagggaacagtgagcaaagggacaggccagagcggctgggcacattccgggagtctgtgcagtttttatggggtggacaccgtaagacggcataggaattaaagatagaggtgggtttgcctcctagagcagagtctaccagtgtggggtgattaatgctgggtaaacccatgcaccctggggcgggtggtgctttacgatgcagagagactaaggactggccggccagccgggagcccgggatgtcacagattggaaggcttaggagtgcagggatctccgagtcgccaggaccaggcagttagtcacagtagtgaccgtgcagcggccactcgtgtgattagtgtgtttcctcttgccaggggctatgctatgcaggttttatcagtgatccgtacaacccagttagatactgttactctctccattttaccgatggggacactgaggcactgcccctcaacagacatagtttggatgaatgaacagcttgcctagttgggaggtccgtcctgttggaaggggagagggacccacggagagggaggcgcaagcccagatctctacccctccacttccttgtaaccccacgggcctctggccctctgcgtaagtgcgagttctaccactcccctgctgcagggctctgtccgtactgaaagcaggggattgcgtacatggtgtctccaacacatggcccagctgtggtgcacacagcctttctcggtgtgcacacaggccctaggattccgagcccacccctgtggcctgtgaagagtgg

SEQ ID NO: 84340 - DNA, 1024 bp, Homo sapiens
ggagtggcactctgcctcttgtctgcagtgggggaagtgcagtggggtctcagctggcaggttacaggggcaggtctgcccattggaaaggggaatgatgacttgttgacatctgtttgtcgccctggttggttcatgtttcacgaccctgtgactgaggcttgcttcagggtaggaaaatggaagagctcgaactgtcccagcaggctggtggcaactgagctcggggagtcccagcagggccagacagagcccagagccagatgatagtcatgtccaaggtgagtggaggggaccgcggggtaatcatgaccatttcctccagtcattctcagacctttaggcgtgtgcgcatttcgtcctctcatcagccccgtgaggcgttagcaggggaaatggagacctcaagagttcaaggttacacagctggaacccaggcagcctaactccagagccagtggcctccagatgtcacgacgagtccctggtggggtgtgagcacaggaaccctggcagcaagggccgaatcaccagcaaggcaacagtaaggatagtgagcacttacccagaacctgttttatgccagacactactagagccctttgtgcagatgtacattcatctaatcctcacgatgcccctgcgaggtggtgctgtcattgtcccccttatacagatgagcaaactgaggcccggagaggagaggtccctacttacccagcttgtaattgtggagcgaggatttgaccccaggctgtctggctccagagtatcactgcctgtggctggtaagcagagttttggggctgcaaagcagaatgtcagaaaggcccacagtggccaggctggctgtgagctgagaggagggccttgtggaagggagagcgtgtggacagagcagaagggtctaccctgactgcactggggccccttccgggagcttcctgggccagcttcctgcagacccatctccggaggagccgtggcagaggatcgcttctcacctgccctcgttgaacctggg

SEQ ID NO: 84341 - DNA, 2290 bp, Homo sapiens
ctgcaggactgtgagcttgaaggcagggtttgggtccgtttttccaggaatacccgatgtcaataaaggcctttgtctgttgcatggtgggggaccttggcatccaggctgtgaagggacaggaaagtctcacagttttcttggaaaccttctggtgaccttggagtcaagggaagctcttcttgggtgtgcccgtggccctgtgctgtgaccctgcgctgtgaccccgtgccgtgaccctgctccgtgacctcgctccgtgacctcaggcaccattatttggaatgggctctcagcccctgtcctaaccccagccaccaagctcccaacccaagcaagatggaaacccgccgttgggaggattaagatattattggtggttttcacctcagctttcagcagcagtgcttgggaaataagattttgatctcggaaaatatgatttaaaaacagaattgaaagtcgcttttattttctaaacgatattgcccctgacgcatgcactgcctctgactggtggcctccggtctgagcacacccgtggggtaaactgcgtagcaattccaggggtgtgctctctggattttatagacttccaccccaagcaggccctgcctttgatcccccactcgggtctgcagtgacagagcacctgctttagaccaagcccaggaggctgctgcttctttggggaattgtcttagcctttcccactcttaggaggtggccttgtcagatgccagctgaaggggtcttcttcctccgagccctgctgggctcacctttgaatgccacaaaccaaacccatggaccaaggggactttggccacatcccagtgtcccctccagtggggaagggaagttcctttccttcctgttgtgtgagggctaggggcactgagtccccacaaggcctcaccatggaggctctgagaggtgaggtttggctcccctggccaccccagagtcaacacagggcctgtgtgtttttctttgcctctgggcccatgttctattctttccagcctttgccttggaaaccccaccctccattcttttctgctcccctgccttctgggtgggtctggccagtggagagcctgggggagatggaggatgggaggagggtgagtgggctatttattccctcctcccttttccttcgggttgccagcggttgccatgggtgggtggcgtccctcagccactcctgcagtcatgtcactccctctacccaggtttttctgtaactgctccttcccctgcagtgtcaggcccagggatagaaatacatgggggagaaatgaagtgactgctgtcctggtttgcccaggactgtcccaggtttttgcagtgaaagtcctgtggcccaggaagcccctcagtcctgggcacacttggacggctggtcaccctaggtagaaaaaccatcttttgtgcttcccctgtacgctgcccatgccttaatatattgtccttttgtgaaaatttcctctgccatctgtttcctcccaggaccctggctgatgcaccaggagcttgaggagatggagtggtgttcagagcctcttccctttagagttcagagcaaccaaatgggcatcatgctgaacgtgggagaaacaaaagaatctcttgcacttggactcttttctgaaaatttgccccctgcaaagcaaaatggtggtggtgatgatgacggtgatgatggtagtggccatttctttgcctacccactgtggccttgttgtgaagaactttgatgccctgttgtatgtgatcgttatgacaatcctgtgaagtttttcaatgatgaaggaaactgaggcttagagagttggagtaatctgtgaaggctcaggatgggcaagaggtcccgcccaggtttgagcccagatgcgaggttaccacgcttcctggtgaggtgttttacaactaaggccaagccaggcaaaacccattgttctgcagcttctggcttggattgggtgtcttgttgagtatgtgggcagtggatctgatgttttccacttcctcccatgtggcagggctgtgtgcatggagcatgaggggctggctgggcagacagccttgatttgactgaattcagccatggcccatgttggaaaatgttagcctatttttccttctccatttgccccttccccctttttttgtttttataattagaatcagagccagccatagttggaagagaacttgaagttcatctagttctgggatggcaaataagtgacacatgtgctgccactcctcattgccttgaccg

SEQ ID NO: 84342 - DNA, 1364 bp, Homo sapiens
gggtgagaacgaagtgagaagtgagcagatatgccccaggcctctcgcaggggcctgcgcgtgccgtgccctctgtgctttcagagtgttctctcattcagcagttaggcatcgtgcctgaagcatgcccttatggggcacctcctgggtaccaggcattgtgctaagggttgggagtgtggagacaacagcatgggagaagagagttatggacaatcggttccagtgcccgcaaacgagggtgactcagggtgggcactcgtgggaagcagcagggtccctggagagaaggctgctgatccaagaatgggtccgctcaggccaggaggagaaagcagggaggagctttctgggcagaacacagcattgggaaagtccgaggggcctggtgaggcctggcacacgctccataggcctcaggtgtattgagtgggctgggggctggtggaattgtggagggcggacgcagtgagctgcctgcatgctggccttgggactttggacttcaacatggaagccgaattacaggaaggccccatgaacgtcttgttctttcctactccgctttgagaggacctaattctttgccccgatttggatcaaccttaggcccaagaacctggcaatggctgagctgatcaggagtgtggggcccagttcgttgccaacagggaaatgtcctctgtccctcaacctttgacgttggtggggaaacccaaaggggctggcagcccttggggtcattctggactagaagcatctagacccaagataatgcaaagaattgtcacgtataggaaaactgggatcagcccaggccagtaatcaaaacagcatgttggaagttctaccttgggctctgccacttgcctgctgtgtgaccttggtcaagtaacttcacctctctgagcttttgtttttcatcagtacaatggggcagatagcggtaccaactccatgggcttctgtgaaggattcagtgagataatgcacatctggtgttagccttgtgtctgacacagagaaagtatacaggaaaaacagagggctcttattactgccgttaccactgtcattgctactgttaccaagattacagaggaggggacctgactacacccaaggtctgaggggccagagagggcttcccagggcaggtgacgtcaggctttggagtcagaccttcttaagttcaggctttgcctgaactgtggattcacagttcttcagagaactcactatgtgtgacattgggcaagttagttattgaaattaagttgagcatgttatttacattctgattacgttagttaaactctacctggaaaatgggataataacacccgacagccaggctgccgtgg

SEQ ID NO: 84343 - DNA, 1125 bp, Homo sapiens
ggtgcttttcatgtcctgggagtagtggcgtttgcacagaggccgggtcacagagacagatgtttcagaagtttgacctcaaaacagctttcttttcccttgggttgtctggagaaagtgctaaaaataaggctggatctgagcaggcgctgctgacaggccacctggaggttcgagtccaccacgaaggtggagtcttggggttatactggctggagccataggaaattgagatttaaaaaagctattaaaaagattataaatgagatcttgctgtgtttcccaggctggtcttgagctcttgagctcaagggatcctcccaccttggtctcccatactgctgggattacgagcatgagccactgtgcccagccaaaattgggattttgtaagtagaaaatgattaaatattggttccatatagtttgtaagtaaacacaattcttgacttcctcatgtgatctcttcgctgtagccctgaaactcctgagatcagtacaaaaagaaatcctttcttgggaaagaaaagggagtgttatgattggtgtacatacacataggcacacacatatgcatacacacatgcacacaggcacaaacgtgcatacacacatgcacacaggcacacatgtgcgcacaaacatgtgcatacacacatgcacacaggcacaatgcgtgcatacaaatatacccacatgcacacacacgtacacataaatgcatgtagacatacttgtgcatatacacatatacatgcatacatatgtacatatacacgtatacacataggcacaatacatgcatataaatatactcacatgcgcacacacatacatgtacacatacatgcacacatagaaatacatatacacataccatatatacttgcttgtacacacaggcacaatatatgcatataaatgtacccacacgcacacatatgcacacataaatatgtataggtgcacacatatgtatacatgtatgtgtatacatgtgcatatgcatatacacgtacaaatgcatacacacatacatgtacatgcacatacatttgtacatgcatatgtacacatacacatgtatgcagacatgcacacagatacataggcatacatatacac

SEQ ID NO: 84344 - DNA, 2009 bp, Homo sapiens
tgctgcactggtggccaccgcctgcaagtgcttatgtcggcctctgtctctgcaggacgacgtgaacaggctgcggctgtcactgacgtgtcttccttcgtgtttgccgtggggggcatataattgcattcctcatgagggaatgacacagaaagggcagggggtgtcagcaggggccgctctgtaatttccatgtctgggacggatttcaggactgagctgttttcctctttgacccggcagaggctgttgcccaagtcaacagtggtgcgtttttgaatttgtctttgttggttttctttttccctttcttcttctttttaaaataggtctttttttttttttttccatcctatgaaataaaactggagacttggttgtagtgggtaagaattagcagttcctgtccttttggtgtgggagttgggcgggggttgacttaaatatttatttcccattaagggattcatgggcttggacgcttgtgttggaatggggtgatctcaaatctcactcatgattttcgacccctgtaggacttgggcctgcctttgggggacgcggggacgcagggacgcattgagcagaagctgcaagcggatgacccatgggccaagtcaagtctgctgacgtgttttacttggcccacacagtggttttttttttttttttttttcttaaagcttcagtaagttgtctgcctttaaagttgggagcattcccctaaaaagttccggatatccattttctaataataacaacagaagcaaacatttctatgtgacttaccacaggcctggctcagctctagacgactcccatccctttgctcctgggatccccagacagttccgaggtggtgcttcctgtgatcatccccattctacagctaaagaagcagaggcaggcctttaaccgggcactcctggctgtgcccatgttcctgtgtggccaccccttcaggctgggcacggcctctccactcccccagcctcctagcccactgtactcaggttcccccctgctcagagcttgtgggcgtggactttgtaccccccgggcttggagagggcaaggtgactgtgggagtccagctgctgctccttaagttgagttgtctgtcactgacttaccctccctccctctctccctactgtctccattcttctctttcccccttctttctcctgcaccctctttttccattcctcccttcccccttcctttctccgctctctctttccttcactcccttcctcccattcatctggtgcttaccgggggccaccaggtaggcacgtcgcacactacttctgcttcatgtgaggggttcatggtggcttctccctaccttcagaccacacctctggtgggaggtgctgcgtgaggatcccaggggtgaactgagtcaggtcagaggagcagggagccccagcccctggtgtcttcttactgtgtggtctcttccgtgtcaccgcacttctgtggaaggggaatgatgggggaagtggaggaaccactgtccgcctgcggaggggcctcagtgttggccgtgctcatggcgccctcctcctggggctccctctcctctggtcctgcctctcctgcacgcccttcctgcctccttggtgccaggggagccagcccaggacagtctctgtgcctaggccctgccagcctggctgccctgcctccagccatggggggcgggcggggagggagtcgaccagtgcttgtctttgcagaactgctggtggactgaatgtggttctgggggtggccaggcctgagggtaactcattttggaaggtttgggatgtcacttcacttaaggagccttcagcaacatggagtttaagtggccctcttcaccgtggccttgtggcttcatgaatggagctgctgtggtcagcatggctggccctctggagaggagggtgggccatgaggagaagatgctgtgtctggaggccttaaccctttcctcccttctctccctccctccctcc

SEQ ID NO: 84345 - DNA, 1146 bp, Homo sapiens
acgggaagccaaaaccgcctgtgaaggaggcctggtgcagctcagaaagccctggctctggccgaggtttgggatgtgtggctgccatggcaacccgtctccccgacgaagggtagacgggttgggcgccgaacgcagggtgttgcaggttgggctccattttgactctggtggagaacgatcacctggctgcaaaaccaacctccccgcccagtacaagcatctcctcttcccccttgggccacgagggtgggggacttgaggcaggagtgggtttttgtagtggggtcattgggtaatcatctccggctctctgctgcagttggtgcgcacagacccggctagtttaaggccattgatgggactcctgtagacgctaagcgatggaaacattgtgcgcatccagtactcggcgtgctctggatggggctggaagatgccaggtgggcttctgaaacgagtgtggggttcactctacctttgatctttgcctgcccgggtgtcctcattcatttaactcttggcttccttattcctctgtccttatccccttcctaggagtggggtctgctcagatataccctcttccctgcctctttccctccctcccctcctgccttcctcctcctacccctgaaaacctctttttttttctgtccaaggctttcttgggcgagtttagagcagcagtttccaacttgagctgcgcattggaattacttgaggagcttaaaaaatgtcctgatgcctgactccacccccagaggttgagattcatttgctgtgtatggggctcagacgtcttattttttattccgacatcatttgcttgaatagctgtggagtattctattgcgtatgtataccagaatgtattaagctactttcctgttgatggacatttaagttgttcctaaattttcctagtataatatgttctccatccatctccttgtgagctcatatctgtcaagaaatactgcgaacgactttgaaatgggtggagaaagattcctgggtgtgttgtctagctcactcatccgagctatttctaccttttgttttctttgagctattttacaactctaattgtggaaagctgataatactgcaagtggttctggttcatgaaaatgcaaaccagct

SEQ ID NO: 84346 - DNA, 1025 bp, Homo sapiens
gtgcctggtggccggcactgttgcagatgtcctggccaaagccagcttggtttggaagcccggccccaacagccgccaagtctggaaatgaagtaaatgagtgagttgttcttggccattttcccctcatctcaacccagctcaaatcaaactggagctctgacctcaggcatcgcacattccatactccccggcctcctggggttcaaaggcgcacggcaggcgataaccgcactgggcgttgagcgccgtgagggaagcttctggagggagcgtgggactggggtgggggcagctggcgcagcttcgtttctctggacaccaggcctcggagaaacagaaggggacgcctgctgggctgtgcttggcctctggtcatggggggccctgagaaccagaacaggccctgcaggggtgaggcttctagtgaaccggggggggtgtgggggctactttggggtgccccctccccaccctcccttgcctcctgagcctcactgctctacctgggagccccagcgtgacttcttgagaaatggtggcctctgctaagcaaggctgtcccgggcggtcacggcgagctggcacctggattcctgaggtcctgaggaacccgcttcaaacctgggtggtcagggccgagtggggctctgactgctccactcccgaggccccagaccaaaccacacagcccttgagggtgaatcactttgaagtgaggggttctgagcctgtggcctgccaagcgggccggcttggcgggaatgggcaggctgggcagcatggcccgcgtggcttccaggcagcaactcctctcccaaggcgaaggaagccagagccagagcgcaaggctctgggctttgtggtcagagagcggctgagttcagatatcatttcctagctctgtgacactgggcaagtcacttaaccactctgagcctcagcttgctttatgtgcaaactgtggcttccttgcaccactctcacagggtctgtgtgaggattaaaggaaaaaacccatgcaa

SEQ ID NO: 84347 - DNA, 1050 bp, Homo sapiens
tagtcaacagctggctttgagacacatgcctgagtgccttcagctcctggctgagtcctctgtccctctgtccgtggccactcagccatgagcacttctgttagcgatgaagatgaaaaagtgtcccttctgcccaggctctcccttcctcctctggctgcagagcagggaggggtttcagtggcatcgcggtggccgggagcgagtgtgctggccggctgggccttgctagcagggccgggccttgctggccaggccaggctatgcaggccctcgagagggcctggggacaaaggcgccttgggaggaggaggcaaaacaggggagggaagggagggccctggagaaaaaggggggaagagaaacaaagacaaaggctggcaaaaatagaccacggaaacggcaggcagccgggataaggaggacaagaggcaggatgtggaagaggaggggaggcggaagttgtcgtggggggtcggggagaaatggggagtaaagggagagtgggttacggggagctgtgtggggtgggggtacgtgggagagagagacccagaaagacagacacacagagagaagggagcggccgaagaggagggcccgtgagcgagaagatgcagatgcccctttagtaggagggcattgctccctgcgcccctggaagggactctgggctggaaaggaccagaatgcagggaggagccgctggcgggggtcactggaagcttgattcgggggaagctgtaggttggagctgggagacccgagttcctgcccctccagggtcttgtacgtcctcacagaggacctagggccttgatcctggtcccggcacacagacacttcaggggtgatggagccaccacaccgaattctcctctagggccctcccccagcatcagagtgcagtctgagggcagcagtgggagctggactggggccatctgtgcaaggggttattgtgcccaggtgcacaggccggagctctggggtcactcaccctccgcgttacctgtcgttacctgtcgttacctgtcgttacctgttgtc

SEQ ID NO: 84348 - DNA, 4008 bp, Homo sapiens
gtcaggccaactgcaaagcctgtgctctttcgactcctggatggacactgcccaggtgcccctgggtaactgatacccttgtccccaaacaactctgaatctcttttcatcatgaatattattaataacaataaatactaataactgccatttatcaagagcccctacttgccaggtgctttctcattcagcctgccaaggaagcccgtgagttgggcaccagtatcgcactttacagatgaagtcattgaggtacagagcagctatgtaactagccatggatcatagagctagtgtcggagatggcacccacacacaattctgatgacaaaaccttacacttggggactgtaaggctttgggcacattaggtgacctctctgagcttcagttttgtcttctgtaaaatggacctcatatgctgtccgtggcataggtttgcatatgtgaattaatgactgtggagtacctggcactcagtgttagctctcaccatcatcatcatcattactgtagcatagggtttctcagtgaaacagacactgatggtcagagtggacctctcagcctgggggaagcagaggatgaaccctctggggcggggccctgggcaggctggttcagtgataagcaggagccaggcgacccacaggcttcttggatgggctgggcgtgcatggcataaccgtttgagaacaacaaaccaagccggccgggctgccgctctgtttcctgcgaggagggaagttacagatctccgccctggcgtccggggaaggatgggacaggctgctgaggtacagtcccatgtggggaacgactctgtccagcttgatgtctgtgcctaaaacctcgcctgctgctgctggccacaggccagtgaaattcacagacccacttctcagagggtgggcaggtgtgtctgctaatctgagagaccccaggccccttctctttttatgtttgtgggaggaatggctgagaccccaaagctgtgggctgctgctctttggaggacttgagacattgtgagagctgtcacctcctcctggaagcccctgcctgctgtggtcagccatggccactcactctcctggggcatctgctggcctcccttagtgacttggctgttggctgtcattttctttccacctcattcccccaactagacaggaagctgtcagtcctcagcctccttatctgtaaaatgcagtttgcgagataatccccagctcccccagctcccccagctccgagacttgcaggagcagagaaagaggccatgaagctggcaggggcgcaaaggaagcagggcgttgttccagggaagggagagcaagtgagccagggaccgagggtggggctttgaagatgctgtgaatccagggtagcaagtgtagtggtgcctttgttttttcatctgtagaatggggataatgggactggtctccaagggtggatatgagtgctgggtgagttaacacacatcacatgtgtaaacagggcctggaccatagtaggtgctatggttactattaaaattgctacatttagttaattaaaataaatattaaatcaatatttgtcgtgcctgttgtgtgctcagaatacagcagtgaacaaaacagacccccttcatgggggcgatcctacttgggggcgatggatgggaaacaaggaagtaagtgaaacctatttagaatttgtacgatggaggggagttaattgcttctcaaccctgacaagtgaaaagaaaagtgagaaggactttgaaggacaaagaccaattaaaatttcagcctttcagcaaggatcaaatcagatttatggttgtttcatccagtgataaaaccctttgaatggatgacgatgtctcaaagtagcaaagtggggtgcgggagagctcagttttaaatttggtgagcttttgtgcacgtgcttccagggatttggtatcacagctgtctcctccaacagcaagaagagaaggttcataaaggcacaccatcccagtagaggcgggggtcagccccctgcggaccctggacccctgggaacacagtttgaaacctggtgctccatctcttgggcttcttcccaattaaaatgagcagagtcttacattctgtgaaactgaatgggagccaaggggtcaaaggacaagttcaagagggagaagccagtgccgcttggcgggcagtgcccgggacacccacccacagcctggcagctgggccatttgcttactgctggctggctggggggttcaacagttggaagaggccataaaagtggattgcacagatgccctgatgctgggcctcgtaaggggtgtccgggctgtggggatgtctaggcggagagggaggtgtagaccctgggcctcccaggcacagtgatggggcagctggagctggtggtgcccatgcaacagtccaccctcctccaacccctgcctgacagccttgcatagcccgggggactcagtagcttggggctcccctctgctcaggcagacctagggctctgatggctcccatttatgagaacagctgtcacttggaaggacctgctacctgtcctccgagatgtgtttttcataccttgtattggtcctctccaccaataacccctcatggatgagtgattgttactgtgtaggaagaacttggggctcagtgaggttgagccacttttccaagaggccacttagagctggagctcataataagtaggggtctctaggaactgtttctaaacaacccccgaacccagctggtggctcccagaagggtctctggaagcaaggcgactgtctcattgtttcattagtttgagccctacggggccttaggacacagccagcttggagaagtcactctaataacccatcttgccggtgatgcccaggcctcggcagactggctctccgagggtgtctgggcctgggcagccgaggtcttgttaaccccaaatcccacaggactcgcatagagtgcagaatcccggttttctgaattggtgctaaaggctcagtggcctggccctgctgtgaagccacagggcttgtgctctgggagccttggccgacacaggtgccccgccgcctcctctgctgctgcagcctcaagggctacaaagaaagctccttctgcccgtgcagcgtgggctcctgggtcccctgcaggccaccatggctgctgctccagctgtggtccccccagaggcttctccaggcagtgcctgccgactctccggtgcttcccttattttattcctcttccgggcactaagtttcggtttccttttcattgttctttgttggtctgttcattcattcatgcatgcatgtgttggttcattcattcattctcagagtaccatggtggctctgaggacagaggtcagacccagctgggttggaacctgctgctccctagcagtgggcctctgggcagatgttttaaccatagaactcggcttccttgtctgaaaacgtggctccttctaggacagtcaagaaggttcaatgaaatgatggatgtggagccccaggacgtgacctgaggatggtgcttgtcatgttggggtctgtgtccctcccttgggcacattctctccttccttcctttccagcttcctgaggacggtccagtgccgggggctgggcacaggcctgagtgagatgcggcccttgtcccccggcctttttggtctgggtcctcacctctgcaccgagtccccctggggctgctcggcagctctgagggggccactctgcctctgcccagtggtcctgctttctcacgggggttatcaggcctctgctcctcgcgcctcactctgagagggtccttccacctgactcatggctcccatccctccatgcccctgcccaggtgcccacacatgtgtgccccagaacatggctgcacacacttgcataccccacgagcacacacgtgtgtgcatgcatacaccccatggtccttgagcacacatgtcctg

SEQ ID NO: 84349 - DNA, 1008 bp, Homo sapiens
tttttacgagcaaatctggtggttatcctttggaaaataagcaaaggcaaaccacttcctgccacttccaggagctgctcaagtgccggagctttctaagacctactgagaatctgaaacttcaggccagcgtcctccgttttcctggagaacgcagtaatttgtgttggtgaaattccactgggcctgatggggttggagattgcatttcagtcttgtcttgctaaggaatttctgagatcgagtaatttggcaagaagagaaaaggagaacaactttgggttgtgacgcacgggcagcaaatgcccgtcctattttgggactggtgcctcctgctttgcgtgtgccacacagcctcaggggacctgaagcccctctttggccccagggggagctctggcagtgccctgtgccacgcattgtatcgggctccttgcactccttcttacttgacttataaggttacgctattaaatagcgtcatctgcagaacagccctaaattcttgaatggggagagaaaatgcggtagctgggggtggagtggggtcgggggcaggatctcaggatgggtgtggcatgggcattgatgcttaggtttgactctggttctttttttttttttttttttctgagacggtgtctcgctctgtcgcccaggctggagtgcagtgtcgtgatctcagctcactgcaacttctgcttcccaggttctcgcaattctcctgcctcagcctcccgagtagctggaattacaggtgcatgccaccatacccagctaatttttgtatttttagtagagtcgggatttcaccctgttggccaagctggtctcgaactcctgacctcaagtgatccgcccacctcggcctcccaaagtgctggggttacaggcgtgagccattctgctactaaccggcaagtgacttaagtccttgtgccttccttgcctgatttatgaaatggcaacaatcctggggatgatgggaggacttttttattcagtcaa

SEQ ID NO: 84350 - DNA, 1029 bp, Homo sapiens
ggagtgaacacagccctgggtcatcatctgtggctctgctgtgtgacagccgggtgcttgatggtgaagagtttccccctggtatgagcagtcagtgttatccctggtctcagtggatcactgggtcgcctgcctagtcccagatacctctgatccctttattttaatttttattttttgaggcagggtctctgtgcacccaggctggagtgcagtggcaacaattatggcttactgcagccttgaccccccaggctcaagccatcctcccacctcagcctcccgagtaggtgggaccatagatacatgccactgcacctggctaatttttaaatttttttgtacagacaggtctctctgtgttgctgaggttgttcttgaactcttgagctcaagcgatcctcctgccctggcctcccaaggtgctgggattataggcctgagccaccgcgcctggccttctgccccattgaggtgccagtctggtcaccttatctcactgtggatgtctagaagtgaattctgaatctcaacccactgccttgttctgaggttgcctgaaccccatggcacccctccagatccctgagcggatcaccaggcctgtcagtgacagacgtcatcacctgggaacagggcaggatgtggctgagtagctgacatgtaatgagggcgtgttcacacctggccctgtgctccatggactttatatttaaatcctcacatgccaactgtcattttataaatggagaggtgaggcttgggaaggttcagttatttcaccagtgttagaaaaaggtcagtggggttgggcgccgtggcttacacctgtaattccagcacttgggaaggccgagggaggcagatcacttggggtcagaagtttgagaccagcctggcccacatggtgaaaccccctctctactaaaaatacaaaaattagcctggcgtggtcgtgggcgccagtaatcccaagtacttgggaggctgaggcaggagaatcgcttgaacccgggaggcagaggttgc

SEQ ID NO: 84351 - DNA, 1461 bp, Homo sapiens
gtgctttcttagtttgggaactgaaagccttgtctgtttccccagactgtgaagaaagttatgagtagtgtcagggagctctgcacagaaactttggccaagatcatttccctcttgtaagctgggtctctctttgagtctctcctcagtgaaagagtggctggtttaaatcaggaacaggctgggcacggtggctcatgcctgtaatcccagcactttgggaggccaaggcaggtggatcacctgaggtcaggagtttgagaccagcctgaccaacatggcaaaaccctgtctctactaaatacaaaacaaaaaatcagccgggcgtggtggcacatgcctgtaatcccagctattcgggaggctgaggcaggagaatcacttgaacccgggaggtggaggttgcggtgagcctagattgtgccattgcactccagcctgggcgacaagagcaaaactccatctcaaaataaaataaaataaatcaggaacagtaagaactgccgttcattgagtgcttattacatgctgtcacattgctgagcagtttacacacgttgtctctattcatcctcctgcaaccctaacaggtgggacccctcttagcctcattttattgatgaggaaaccaaggctcggagaggttaaggaacttcctgcagctcacgtagttagaaactggcgaagctgattggatctaggcctgtgtgatcctgagcctacactcaggaccgttctgatcctgaccagtacttactgatttggggtctgagaagacagtaatgagcaagggcccccagagaagttttctgaccttcacaaagccctgctgagatcttgacctctgttcttaagaggtggatcttgcctcagttatgctcagccatttcattacacaggaagacctcattcttccttacattgcaatttattgttttttaaagaaactggccttgtattgtggaaataacattggaaaatggagattaaaatgggtaatggaaataacaatcagtaatggcttaagaacagaagcttgattggggaaaagtcttccgaatagaaagatgatcaagtgggaagaaaataaagtggaactttgagtttgaaatggctcactcatgcctgtaatcccagcactctgggaggccaaggcgggcggatcacgaggtcaggagttcgagaccagcctggccacactagtgaaaccccgtctctactaaaaattagctgtgtgtggtggtgtgcgcctatagccccagctatttgggaggctgaggcaggagaatcacttgaacccaggaggcggaggtggcagtgagctgagatcacgccactccactccagcctggatgacagagcgagactccgtctcaaaaaaaaaaaaaaaaagaaatggctcaaagccttgttcctgaatgtcctctaaagaaagatcatcggccgggcacagtggctcac

SEQ ID NO: 84352 - DNA, 1328 bp, Homo sapiens
agcctgggtgacagagctagactctgtcttaaaaaagaaaggaagatcatctgcccagccttggctttctgggggtcttgggtaccctccctctgcagctgctaaagataagcctaaaactacgtttctcaaactgggatatgtgcagcctgtgagggtgtcaggagtttgagaaaccataggctaaattgggtgtgtcctctatgtgtgtccacttgacttgtggattcagagggaaaagattaagtaatttaactaatatataatttagaacatggctcatcttcttggaatgagcattttccttgaggggtggaaaggttaagtcgtttaattggtgcgtaatgtaaaacatggctcccctttgtgggaacatccactttagacaatttggtgaagggagaaaaggtgaaaccatttaattcaggagtcattggagatattattttgctgttaaagtgtgcacagatgtggagtggaatgcaaattcacaaggctcattaagattaaccaggagacctgagtggaatctcctggttggggtggccgcagatcactttgcgtttgccctgctttatatttggggttcttgggggaacaagaggactgggttctggggaagggctgtgagggtagcactcagtagtactggggtgtgagtcccattgctgcctgggacactggcccagcctgctggagctggactgatccggtgatttttgcctttcttggtttatttcccatttggttttcccaggcttttagtagagcccacttgggcaatgccaacctatccacccatgcttaacggaggaatcagagatgattgaacagagaggaacaaagcaggagcattcctcccccaaccttgttctagagacaaagtgagtgctacatcctctactttatattattttgaaatattaaatgtgtgcatttatttttgaatagataggactttcatatgatgcacagctcaggaaatctataaggaaatgtggtgaaaagtccctcttgccctgtggcccggctggcttatctcctccccagaggccacagcatccctggtttctgatcatctcctttgtggacataattaggtacatagacgcaaatacgtacaaatttggtttgtttaaacgaatgatagaatcctgtgcacattttcctgtaatattttctcactaaacaatagtgaggaatggttgcatatcaggacagcttccctgttctctttttgtggttacagagcattctactccatagctctatttggtcattttcttactgatggctgtttttgcagccttttactctttcaagcaatg

SEQ ID NO: 84353 - DNA, 1060 bp, Homo sapiens
atgtctctgggaaaaattcctagaaatgaaatgtctgagtcaaaggttatgcacctctggaatattgataggtatttacagactgcattgggagtttcagcactctccatcagtctgagagggtgctccgtgagacagatctcaggacagctcctgcaggcctgggatggtgtgcagaatgatctgatcatgcctgagggacccacgtaggccccaggatggggatcctcatggtgtctcagggccccttctgatgtatgcttttgtcaactgtgcactggggttgggaagtacttaggagagcaagtgtcatgtctggagtggttctcccttggccttgcctgccattcctttgctcagcgtggagtctcccctactccaggaatgaactcttgaatacaattcaggttccctttcccttagccttaagagcagcagcttttatgatgggaagggaatcattcattttatttttttcaaataaagatctactcttcagagagaaaaagtgccagcaggtcctcatgaagaacagattcattcaggtgtctgcaggtgtcaccaacaccgtgtgctccccgtgtggcagacctcctgtgtcctcagctgtcattgccccacagggctctctttagctccatcctatagatgcgcaagcaggtgcagagagatgtggcatgggcaggaccacccagctggagagcccaccggaatgatgctgatgtgccctcagcctgcacagttccctgcctgtgtgtgtgtctgggggcttgcttcctgtcacctagctcggcataacacattggtgggagtttggctttggagataggcacttgggtttgacattggggctgcctccttcctgcgtgcactgcctctggcacctctctgagcttctggttttttagctctaaaaatgggaatgactttcatgttggtgcctgatgtgcaggtactcgggggtcatagtctggctgtctttcccttccgcccactctgtccgcctccctctggtcatcctgagcaggtcgagccagggcggccctaagcagagccctac

SEQ ID NO: 84354 - DNA, 1155 bp, Homo sapiens
ccagctgcacatccttggggctgggtcttaactgggacccagacccctcagcttgctgtcttcctgtctcccttaaccagggaggagagaacaggtgagtttcctggtgggcaggagcatggaagtgtgatggatctgatgcagtgattggctgggggcccctttgtcaggagctccggacatcctgccctcacggagaagtcctgccccaaaggaagtatgcctgaatcagacctggctggcaaattgaacctcattttctgatcaatttccatcaggattttagatgaggatgcttttcctgtatctttaatggggcgtttggcaaaagctctgctcactttggctgtgactttgtctcttgggcctctatcaaggtattgacgacagtgacgtcagcatcctgctgcggggctgccaccctctttgtgttatagttctcaaggtctgatcggggacgagggggtgctcgctcctcacagctgcccaggagctccacggagcaggtgtcagggcccttgtttccctgggtgtgagtcgcccaagtgggaccatgatggccgccctcatcacttcatcactgatgtttttgctaataataatgatgacaatgtcaataatggtagtgttattaccacctaacattattatgtgctctcagctaagcacttggtttggattagtttaatcctttgacagtcttctgaggaaacactattgttagtagccctgtttaggaggtgagtaaactgaggtttagcaagcaaagggacatgcacaaagtcacacaaccagccaggcacaaagccaggatttaagtcctggaggtgcgattccaggtcttttcaaaattacacttcactaccacctttctcagatactgtgatggaccagtccaagaccaatgtttttttttccttcattaaaacaaaaaaaatcacaaatcacaaacctttattttgttttgttttgtttttttggtgagatagagtcttgttctgtcgcccaggctggagtgcagtggtgagatctcagctcactgcaacctccacctcccaggttcaagcaattctcctgccttagcctcctgagtagctgggactacaggtgcatgccaccttgcccacctaacttttatatttttagtagagatgg

SEQ ID NO: 84355 - DNA, 1003 bp, Homo sapiens
gcttcctcatggtgtcatttaacacattcctctgttccctgtatttcctgtagatttcctgcataccttgtgaattcctagtttgtttttacacaaggtctcactctgttgctcaggctggagtacagttgcatgatcgtggctcactgcagcttcaacttcccaggctcagatgatcctcccacctcagccttcctggtagctgggactacaggtgtgcaccaccacgcctgcctaattttttgtatgttttgtagagatggcgtttcaccatgttgcccaggctggtctcgaactcctgggctcaagtgatctgcccacctctacctctcaaagtgctaggattacacgtgtgagccactgcacctggcctctagttagttttagacctgtgctgtccaataccacggccaccagccacacatggtcgctgagcacttgaaatgaggtcctcattgagatgtgctctaagtgtaaaacgcacactggattttgaagacttagtatgaaaaaaaatatacagtatctcactactcattttttgtattgattatatgttgaagtgataatatatttgatatattgggttaaaatatattattaacattgatttcacctgttttacttttttaaaatgtggctactagaatatttagttttaaacatgtggcttgcattgtatttctattggagagcactgatctagagatttggttgatttggattaaaattttcggcatgattcctctctaggtaggtgtttctgtgcacttccagttgcctcactccagggtccctcatgccttggtgggggtctttcttgctgtggttgatgggcaggttctggtgctggctgcctgatctatccatcaccacccccatcacctttcctgctcatgttccagtgggcaccagcaatcactgctcaggtgcattatttcattagagattgcaaagggcaggtgttttagctctacctttccttcctcatttgtcagatggg

SEQ ID NO: 84356 - DNA, 1073 bp, Homo sapiens
acctccagaggatcagggtgagggaagcttccagaagtggcatgaggagggaggaagaggcagcccagtttgaccttaggaacgaggctaacttggggtgcagtggtcaggagtgtgacgagaccatccaggttccaacccagctggctactcattagtccatgaccttagacaagtggtttgcgctcactgagcctccattcttcatctgcaaaatgggtgtactgtgagaattagatgggacagcctattaattaagactttagcgtggctctcagcaccgcatgggcacccctggtagatctagtgttgcggtcaatcgcggtggctctggagcctgagagcccaggagaaggtcatggcttcaccccttataacctgggtccccgtgggtttgtttccagacttctctgtgcctcagtctccttatctgtaaagtggaggaaacagtatttcctgcttcccagggtggttgtgaagattaagtgacttaatacacaatccttaggctgctgcctggcctgtgtgtgtgccgtgccagtgtgcgccatggtggctctagctgttgctcatactaacatctttcagaggagctaccacagaccaagtggggcgctggggtccagtaacagaaaatgcgatgaacactcccctgagcatcgttgttcgagggcctgctgtgtgccaggcccaacagccctggaggaaggtcatatccttcccattttccagagctggagactgaggccaggaggtgacccatggccacgtggcctgtcctggcaggagtgccctgtcccaaagctctcagccttttccctgtgccagaccgtcttctcccagttaaactagaagcatgactccagcagagagaaacctactgggggctgtgctttattctgggctctagggctgaaggattgaccgggcaggtgaggctgaaccctctcacctgtcagcgaggcctcaaaatgactcacagctgaaaggaacaccttggccttctgattctcatccttgaagcgttgtggtccctcacgcttctagatggaaaaacacaaggtctgtgttgg

SEQ ID NO: 84357 - DNA, 2060 bp, Homo sapiens
cagatggcctccaaggtcttcagtgaaaaaccagaaggcctccaaggtcatcagtgaaacccagacggcctccaaggtcatcagtgaaaaatcaggcaggtttcaaggtcatcactgaaaagccagacagccttcaaggtcatcagtggaaaaccagacggcctccaaggtcttcagcgaaaaaccagacggcctccaaggtcatcggtgaaacccagacggcctccaaggtcatcagtgaaaaatcagacagctttcaaggtcatcagtgaaaagccagacagcctccaaggtcgtcagtgaaaaaccagacggcctccaaggtcatcagtgaaaaatcagacagcttccaaggtcatcagtgaaagaataggtcagtatgtcttagtacattgattctgtggaatatgatgcagcaatgaaaaagaatgaagtgaatctaaaatgcatgactgtggaaagatatccaagacatgttattgtctaagactcatcacacaaatgcataacacaaaggtattttttaatatgtatatgattgcatagaaaaatgagaccaaggaaacaccctcctctggcaagagagtgggcttgaattcaggtaaaggggattttgttgcttttcacacttctcatttctatattattcaaattgtaatgacagccctgtattcacatattagctgtgaaattgcaaagtatgtaataggccattatgagaaagaaaaagccccacattttagccagtgtgtccttggagtctcccccgacaatgccagggaagtgggaaacattttttcctgaagaaatgtggagcagaggcgattctctgggtgtgtttaggaaatgatcccatccttcgggaatgccgtttttggagttcgacgttctctggaggcttgggagatgcagccagggcgcagagttggcagtggctgcagacatctcttttcaatgtggacctcctgccacagccacgagattcaaggattttctaggaaaatgaacgccagtggatgtgtggaattttttcacaaagtaagtgacgggggtccctttgcacttctcatgcccccatggttaattgtgtgtgtgtgctggaagtggaggagggcggtgggtggtgcagctgtttgaggactcacccttcttcggaaggctggggtcaatggggtgctgtttccccgagtcagttgaaacgcccatggctaaagcctgtggatcatctcacccctgcatttcctatttggctctcactttggtcgaaagacagcggagcgcagaaaatctgtcataattgtgaaagtaggacctgtcatcctctaagggtcattcttcctggcccaccgggcttgttgacacctggagttgggtagcagagagagggatgtcgggaccgtgaattaacagtggccaccacttcatggtgaatggcatccagacaacaccttcacctgtctggggaagaacataggctaggcctgggagaggctgtctactgaagtccctgcaggggtccaggctggactatacccctccagcttggcgagagagccaaggaccagcaagggaagtgatgtacgctgagaaccgtccgggcgcccagcacgggtcagggcctttggcttacaggctgtgtttatttctgagcagccctatgcagttggcattagcatcctaccgttcccactagccagctgggactcaaaccgattaagtaactgtctacctgcttcctgtgttctgtgtctgttggtgttgattaaaaaatataaaaggccaggttcatgcctgtaatcccagcactttgggtggccgaggcaggaagatcacttgagcccaggagttcaagaccagcctggggcaacatagcgagacctgcatctctatttttttttttttttttttgagacagagtctcactctgttgcccaggctggagtgcagtggtgcgatctcaactgactgcaacctccgcctcccaggttcaagcaattatctgcctcagcctcctgagtagctgggattacaggcgcccgcgccacgcctggctaattttt

SEQ ID NO: 84358 - DNA, 1062 bp, Homo sapiens
agtcctgaccccttaactcagaactccgtcagcagaggaattgggttctctgggctgttctctactcaggcacacccttgctgggcctcccatgccccagggcagtccaggaaatagtgtgtgcatggtggaggggaaggaccttgactgagaccagacagggttggaatcttgggtctcctacttcctgtctctgtgaccttggccaaccatttaacctcacttgaggaaattgagcctcagtttcctcatctgtaaagtggggttgttatgacgataagacaggataaaacacatgaaacagccagcattttaccacttttaacctacagaacggcagtttgacatggctcactcaagtatgtccatcatggagatgcctcagtgaggtgctgggacatggtagactcagtaatgttcccttcctctcctccagccctcagtgttgaaggctttgtcatcctgaatggcgacgaatgggaagtgagctctgaaactgaaaccaccatttggggacaaaagctggcattgtagttgtggctctctgggaaggtctcatctgtcttctcggggctgttccctaaagctgtcattacgctggctttgcggcaggggtgcagcagcagtgggtggtgatgcggctgctcttgagtggcctggtggggtcatttcagtttcaaggccttggagagtgtgcttagcaggtggggcctaagatttgcatttcagctgcccaggtagtcaagaagcggtatagcaaagcggctgtgagcccattctctggagtcctgctggctgggtttgaaccccaggtctgcctcttgcctgctggtgcactcagccaagttacttcatctgtctgcctcgatttcttcatctctagtggtttctacctcagagactctgggagccacaaacaggatcccacttcttgaacaatgcctagaacaaataagcaatttctatgctgtagagagtgtttgcttacttaaaataatgcttattaaaaattggcgggtgcagtggctcatacctttaatcccagcactttgggaagccaag

SEQ ID NO: 84359 - DNA, 1016 bp, Homo sapiens
ggaacaggaggagggcttttataccaaaaaatggattgttctggaaggcttttctttgtcactgcccggtcgccgtgactgtggaccatgggaccctttcagccccgaggcctttcggcaagccttcctgagtggcctctgcatcattgcttgctgagcggatggtactgcacggttgccatggtagcagcaggatgtggttcctatggtgatggtcggcagtggcaggaagacagcagaggttttagttatctggtggcttcgcatttgccacccccccccgaatagcaaacacgagctgcccccgctgtcgttctgctctgtagaaccaccggtgaccgccaaggtcggctgcctccctgaaatgccactgcaggttcttggaaggactgggttgcaacaatagcatttctgcttccagaagaggagggggctgagtgtctctaagggtgcgtcacctgaggggagggtgcttatattcacactctgaacctagcaggtcgagtctgtgcggagcttcttcaaaaagcccctccctggagtgaattttcttttccttctaagtcttgtgtatttgtagacagatgtgggatgatgagctaacaggagaaaccaattggcttttgaagctcctatgataccttgtagatttcaaaatggccagtttagggggtcagttgggttttcaaacataagatacttttctacaattgggagttggccgagattagggaaaggagaaaggtatcctgagtgttcccttgtctttttggtatcctatatcttacagatagaatttctccaagaaaggccagtgtctgatacagtgaaatgcagggtacagaatattgtttcctttttatccaggaaggcgagaagaaaagcgtataagcaggatttcagaggtgctgttacaatttaagagtaaatctgatatttaggagccaagtgcagacggatgaggtttctgcttgtccattcacacttgataaggctgccactgcctaagacaaggg

SEQ ID NO: 84360 - DNA, 1027 bp, Homo sapiens
cgaagtctggaaaagaaccaagaggacagcatcttttgtctggagagcaccgtgcctgttctccaaccacctcgtagcccctggtggagcctccctcctcccccaggaagaaggtgagctgagtcaccaccaggtaaccctgaacctcgctcagacacagcttcctttagctaggagcctggatgtaacacccagctcatcccttggctccctccaaacgtcaaggcgtcttgaactaaaagccagcgcctgcacaccggcagaactttgcagctcctggctcctgagttgtaggtgtttttgccaggtgtgcctgtacgtgtgtatgtgtgcccatgggtggacagtgtttctgtgctccttggagtaggcttatttttctgtctcttaaactggctcccttggcctctgcctctttcacgggttccatgcggaaccctctgacctgtgaggtgctaggcttgtcacagcatctattaggagacctgaaagacaggaccctgtaatgccacgatccattgcttataaaggaagccagtattggggtcagacagagctggattctctcaattgctcagcaagtgtttattgagcacctcctctgtagtgggctctgggggtaacatggcacatgaaacagagatggtgtctgtcccactggagcttagaggggcagagactgtctacaagtgacagagagatacagagagaattataagtctgagttcttcagccagtctggctctgctatgtcctagacaggtgaccttgggtgagttaactaagtcatctgtaacgtgttagccacaacctactaagctcgtggggttatctggaagtcttggtgagacagtgtctgcaaaatgcttatcgccaagccaggcacgtcatcattgcccaaggtatggcagctgcagccatcacggccctcattttgcagatgccgaaattgaggtcagagaggtgaagtaacttgcccacggtggcacagctcattagtgggtttggcggcacaggccctgctcag

SEQ ID NO: 84361 - DNA, 1061 bp, Homo sapiens
tttatggtcaccaacctgtaactgaaatttagcatttgtttccatgacggctgtaggcagtaccaatcacagtggtgttagcagtgcctgtgacttagtcatcaatagaaatcgcgggtgtttgcatatttcattcctgttgttgtggatatcttggaatatcattacattcatcagtaccccaaagttacagtagttatcaggcccacagctaggtcttgttatacgatggattaataaagaggggatctgttactccattggaaattttaagggatattttgatagctgtttttcattatgatcagcttcctttcctttgcagtttcctatttattttatacttttaagaagattactctaagaaggggcccagaggcttcaccagactaccaaggggtccaaggcacaaaaaagcttaggaagcccactcttgccttgcagaggtgcccccgggaggggtcacagtgaaggccccagcccgccagaggagcaggtttgcgtttggtttctgggcagctctgtggaaggcaacccaacttcctttggaagggccctgagcctctctctacccactccaatataagaagagaaattttgctttataatgagcaggaatcttctctcagttccttggatggctttggacatgttttgagtttgtttggattcccaggagtgagcacacagggcgtgagctttgcagtttggggcctggtttctgaagaagttgcaaacagggtgatggtgcagttcagacaacacgcgcgggccaggcaggcctggacctgaaaggaatgtgttttcttggtttttgtctgctacagaatttctcagctctccagctcgttggctcaaagtgtgtcaggaaagggggtgctgggtaacaagacgatggtggagagtgaggtttgcagacacaccctggcttggccgggagcccacggtgggggaggttggctgagtgtgtaagagcctttgggttcacagcctgcatgccagaaatatcatttatcgtcagtaataatgataatgcctgatggacgggtaaaggaatagct

SEQ ID NO: 84362 - DNA, 1528 bp, Homo sapiens
tctcctgaccacagtgtctgtgtttatttagtttttttagaagcttcaactttacagaaagcaaatcaatgcgtgttcttttatgtctggcctctttggctccacatgtgtttgtgagcttcatctacattctgtttagagctgaaggttatttatttttgttgctggatcacattttatcctaaaaatatcccattctactgacggtgggcattcacgttgttgccttcttaggcttttatgaataatactgctaggaagtctcttgcgtatgcctttttgggaatgtgtgcatgaaattctgttggcttatagttaggcatgagttgccattcgctggtattgcataggttcaccttttgtagagaaaaccaacctgttttccaaagtggttgtaccagtttacattcccaggagcagtatgggtgatttctggttgcttcatatctatgccaacttgttattgtcagtcttttaaattttagccattttggtgggtatataacagtattcaacttttctttaagtctgaaatttttcataataaaatgttggagaaaaatatccttcacattcatgacaacttcatagaaaaatagtatttttaaggagatggttgaaattggcgcttgtctggtcttggagtgaagacttttttttttcattctaaacaatgccaaggctggcccttcctcctatgaccctgtggctccccagtccaccattggtctcatgctgaatgctggatacatttttaaaagctgggtgtagccagagacaggggcccggagtgaggttgggagtaccttgaagctgtgctcatgcattgaattgatatgaccagaggtggagcgtggagctggttcctggcctggtagaagttcttacactttttgctggtcccagagagatgtacttttgagtcagcctgggaaattaaaatagttcattgagttttggctaattctggtaactattcctagaatcctcctggtcattggtttgaggtcacagctacctgcttgctggggcttccctctctgacttagcacaaatgatgcccaagtcttgagcttcttcctcatgttgttaactgctcagctgagttatttcaatggcatgaaagaaacatagaattaaggtcatagagcatggtcctaattcatgcctgctcgccctgctttactgccatcatcatctatctccttgctttcactcaacaaatatttggtgagcgcgatttttttgttaggcactcacccatgctccctcccttcctttctcctctccttcagtttgtttgcctaccagtccatgcacccacccgtccatccacccacccatccctccatctatccgcccatccctttatcccttcatccatcacttactgatggctttacccattgtaaatcaggccttggctagatacagatgaatgagctgtggtccttgcctttgaagtattcccccatactgtgacaaatgattaaatagttattcataatgcagcatgacacggatataa

SEQ ID NO: 84363 - DNA, 1067 bp, Homo sapiens
tgtgtgcacctgcgtgtgcgtgtatgttccacacgctgatgcaggaggtatacgcacagatataattgtcttttagaagattgactatcactaattttgaaaaatttcctgaatgacctttcctgccaggccaatacattgagcccaacagataaatccctgaacttattcgcagtctctaagtacctttagaatcccgggggtcgccctgagcctccccagggactagcgctgttgccctcgctcagtctcgccaccacaggaggcctcggcttgcccagcagctgagtcgggagaacctttcccaggtcccgaggcagcgggaggcgaagccaggagacccacctggtgccagggaagagctgtcacctgggcctttcctccaggagcctccaaggaaggtggaggtgtgacatcagagtgttgggatgtggaggggtgtgactccctgggatgcagctctgtgccctgactccagtgtgccatgcttggctgatctctcaatgattaactgtgtgaccttggacacaccgtgttgcctcctgcgcctctctgcccagacagcatggcaagtgaaagcctccctcccttactgatggtgtgatctgggctgcctccttggacacgccaagcctgctgtgcctcgaggcctttgccctgactgcttcctctgcctgggatgcctgttgtctaaacacccacaccacacgctccctcgcttccctcctgtctcctgtcagaagtcacctccttgggctgtccttgatcattccatccatccaaaaagttggcacccactcccacaattttttatttctcgttccctgacttacgtttttttctcctgagcatatgttatcatctgacagaccacgcgtttcttacttattttgtttattattccatcccactagaaaggcaggggtttgcctgttttttccccatgactgtatccccagcatttagaacagggcctggcacctgctagatgctcagtacatagttttgagtgagtgaacgaatgaatgaatcatcagtcagtcaaactttgcagcactcactttgtc

SEQ ID NO: 84364 - DNA, 1024 bp, Homo sapiens
gctccagattagggaagtggtagggagtcaagaggggctaaggcctgagtccgtctcattctcagagcgacacccataagcatgggctgcctgcccatggaaactcataaagtagagacacttaagacataggcggcccccggcggtggctcctgcctgcagtggcccagttgcataaacactgagagaaggctgccgaatttcactctaaggggttgttggaacaaagttgaaatgtggtccaaaacagcttcatcatcattagtgaatgtgctgtgggttagctttttattttctcaggggatttgtttggggccagcctgtgtctccatgttcttacttcgcgagctgagtaagttgatatctgcaatttaagaagagcctggttttgataggaagttgatttgattaccattttataagattttcttggtctggtcttgatcctgtggatctcttggtttcagtaattttggggtggtgatctatcctctgccatttaagccaagtcacactgatgttgagtccaccctgaagaatgtgtcaggatattctcattccaaggaaatagaaaaaggcattaagttcaaaatagcacgtgatattccaaaccaagactttgttatgatcttctcgggcaataatatgattatcaggtttttttttcacaggcaagttgattctaaggtcattaattttatctgtatccagtggaaattgtgttcattttaaattaaaataaaatgaacggtgtccatctgtttgtggaaacctgatctactaaggttgatataatcaggctatttacaagttcactgtgggtcagacaacagtatttatattcatgcacacagaaaattcgattagatagtgccgaggaagagcacacaccgatgggccgattaccctgaattcaggcagctcagattctccattcgcttgaatgtcatattagctggggatatcccttttgtgacgcagaatcttgcagcgaaacagttgggtgtagcctcctgtgagaaag

SEQ ID NO: 84365 - DNA, 1010 bp, Homo sapiens
attctcttgttcagggggtgtggagcactggatgggagctagacatccctctagacctgtgctggctggaagagtagccgctgccatgtatggctatttacattgaattaaaattagaccaaagtaaaaattcagcttgtgaggcacgtagccacacttcagtgctccgtagccacgcgtggcgaacagctcttgtactggagagtgccgatgtagaacattccctgcatcgcgagagctccctggatggtgctgggctgcaaaggccactcccccgggagtgcacagccttgcggtattaaagaccggcacatattctgtgacagtacagggcagtctgggctgggatgtgggcacacagatgtgggatggccgagccatgcctgggctcccggaggcagggaggtttcaatggtgtttaagtcaagtgaggaggatctggggcagaggaggagagggatagcatatctggtagagggaagcacatatgtcaaggcctggcctccagaaagagagacggaaggggttcagcgcggctgggtcgtagaccatgtcatgtttatgtggccgagggcatggggtgtgtgcagcgagggtgactctggagggggacacagaccagctcctgcagatgctctgccatctctgcagaaagacccccgctccaggctccctgctggcccttccagtcagatagagggtctttgcaggccatctcttgctgtgggcacgctgagcagagggtcccaaagccagtgacaaccagttcagaggagggcctggtttgcggggtcagggctggacaccttgctcagaggggtagctgggccttggagacaaacttaccgtttcaggcaaaagcgagggtttgcaggtggagggtgggaagcgggggaggaggaggaggaggaggaggaaggaagggatctcctcagaagcctgcagggtccagattgagtgtccgttagttcagtgtacccaagaaaacacttcaggaaatggcccctctt

SEQ ID NO: 84366 - DNA, 1046 bp, Homo sapiens
caatcagtgcctgataaatgtatgttgaggggagtctacctttccatgagaactgagttttatctctgaattaacaaatgccagatgtgcaattagcattcagagaaaatgctctcctcttcaaaaggcactttaacctgttattctctatctgagctcatttaatgcaaggagaagctaaggagcagaaagattcagagaaatatcctgcttcagagagttgggcaggagattcctgtagcatccgttctgctacttctcagaactgtgtgccctggcagacatcaataatcaatcaccactctttcctgttgagcccagaggcagctgcagaaccgttcacaacacacctccaggaggccactaccaggtgcttgagaagtttgcagaatcccagactggcaaatatgggtgtataatcgaattcatgtttacctccagatttctactttctggctcagagctgtcctttcactttctcattttcttcattcaccgctgtcagcaggtgccttttttcctgcagccacttctctggctgtgtgaccctgggcaggcaactttattcttctctgggcctcagttctttgtctgtagaatggagataatcgttatatctggtaagactctgtgggacccaacgaaagcatagagtgcttagcatcgtgtctgctaggaactaacaggccctgaagagatgatggcaactttaaaatatatttgttttcactttaatcttcagcaaattgaagccctggccgcaggtgtcattgggctggaagctcctagggatgccccccagaagggggggtttttccttggtccctggtaagtctgcctcgacacacccctacagtgggaggggcaccagctgtcaccttggtgcctcctctgtgccatcagtcttcccagccacagggaactttcccacacacgcaaggcctcatctcgggtctgcagaatccaacaaagagcaggagggcaaagaaagcctgtcatctcctctcttgcagaaatccacaagcagcatttccgatgttgtcatt

SEQ ID NO: 84367 - DNA, 1095 bp, Homo sapiens
gaggaacaccctgcttattcagagaccactttccagcaaacactccgaacccagcccagaatccaggtagagaagtgtaccaaagtcacggtggctgccacactctaactctttggttgcattcccagcagggcctcgctcccatgcagggcacagtcctgactagtgtattgcttgggtttccaagaccatgaaactaaaagcagcaaatcaggatgaagcaagagggaacgctttcatgaacggcgagcggaatgcccaacagcacaaagtcggcgggggtaaaacgaaaatgacagaaagaaaatgaagataaagagtgcacggcagttgggggacaccattcgggggccagcagctctccactgcttcaggagctcctgacggtggcagtgtggggtagcagatgctccaagggacaattgcatcagcaagaaagggcaaaggctactccctgccatctgcttaaagcgaggaaagaaggagtgtttctatctaaaattatttaaatttctctaaagggccttggcactcagagggtaagctctggctggcattgcctctgaccttggccgtctgatcaggcagtgaaagaaggaattgttcctggggttgcaagggagttgctgccaacatctggcctgcctggcccctttgtctccctattgacggcgacagcattgggcaagtcctgggcctcatgtctgtgcgaatgtccccaccctgtcaccggcacttccccccggggtcggggctccgggcctctcatacagctgtgggcctgatggtagaaaaggaggctctgttctttaaccctgaatgggatcggccactgatctattcttgtcacttgttgagcaactgttctaggctaaatctgaattctttctcagttagtgcccgaatttgctttttaaaaataagtcattgggaatacttgaccctgggcagagagcgggaccagcactcaatgaaacttgtcaatagagtttctcacggccgggtcacagacgtggagggagtgactgagtcccaagagaagacccactgtctcactgtgtttcctctcactgtcagccccaaccgaggcttatt

SEQ ID NO: 84368 - DNA, 1216 bp, Homo sapiens
tccagccactccctgcgctggccccgcggataccaagagcagcagtccctcagttcttgccctccagctgctcccactctgttcctaactctgcacctccaaacgtgtgggtggagttttacagtgaacccccttgcagctggatatggccagccagaaacagggaggcttgctttggtcaccagaggtgctgagctcctgcaccagctccatttgcctgtcgccagaggggcgatgtttccaaaaccgtctgagatgcggacgtcatgcctgctactgtaaccaatgcatatctcttctttttctttttttgctgcagccaactgggtacatggaaaactcagtctcctacagcgcaattgaagacgttcagctgctgtcctgggagaatgccccgaagtactgtttacagctcacgattcctgggggaactgtcttactgcaggtaggagaaataaacatgaacaagcagtttcttctccctcatcttcatgcacttgtgcccctcgtttcccttggagggagccagcagctatcaagaggaaaggttgtttaactttgggtgattttattccccaagtataagaaagctgtaaaccaggtctgactggagaaaacgaaaaggactgtgcatggcctgagcgtctcctgcacacctgctgcagtctaggaacttttcaggttgctcatttagtttcccttaataaacctgataaataagttttatgatccccattttacagatgaggaaactgaggcacacaggtgagttgttaggcccaagaaggccgtgaaaagcagatgagcaatagatactgactttttgcattactttgagtgagggagtttctgatatcttgttgatctaagtcttttgaggctgatagaagtataagctatctttttgggaaaaaaagtgcattctgtatgtactggtcaggacgtttggttggaaatggcacaaacattattccaactagtgagacaaaaagagagtttaatgctgttaactattaaattaactattaaagtaactgggaagccttagaggggacttcaggcattgctggatccgggggtcagatgacatcattaatattgggcatctctctctccatctcctggctgtgcttctgtgtgctggcttcattggcagaatctcaccatgtggtaggaaagatgacccacctgcagcccaaagccacatccttagagg

SEQ ID NO: 84369 - DNA, 1036 bp, Homo sapiens
catcatgtcaggggagccagccaattttcagaaggaaccccgagtctgaaacccctcatctagagaaaatttactctcttatcagtgggaagaagacctgccttgctttttcttttgggatcattttattcctaacttgtttttccagggaaaccttctcttagcccaaagagatgctttctaaaaacctattttagatctagcagccactggattgtgtaacagcattgggctgagagtcacccagtctgggctccaaggaatgctgagctcagtagcggagcgtaacaacttagcattgttagaaatgtcctgtttcttactgtcatctctcagaggactctggaaaccacgcctgccccagtctgctttcttcttagtgaatctctcacactctgccctctacgcttttcttttaaccctgtccccacacccccacactgtccctccccccctccccaccacagccagcaaagccttcctcttctttctttctctcctctcatctttatgatagaggtcagtgtcaccctcctgccagacacttctgccagctcctctgcctcttcactcgctccttcttgcccatccgatggctgcagcacagagtccatgaagggggtggtcagtgccagcccccctcggcgggggagatggggcgggcaatcacagggttcagtggccaacggagaggtagggtagccagagattgtcctaccccaatgactttgctgtagtcacagagctttgaggcagcctctcccctgtgctcggggaggccccatgcgtgaagagcccctcagcccctggggagacagagccataaacaaatgattacggaaataatggctaaattagaggcaaccgtggaggactgggagcccagagaaggaggaacttatttggcctggggggccaaagcaggctccccagacagggggcatttgaactgggtgtagagggatgagtagaagtgtgccagaatggtggggtgggggcacactccccgggcagaggggatgtgtgtgcaaagcct

SEQ ID NO: 84370 - DNA, 1034 bp, Homo sapiens
aagcttctgtggaacttccaggcaggcaccgtgggtccattcttggagggtcctaccctccgagaaggaaggcagaatggtggggaggcaaggatgggcgggagtcggccttgatccccttccaggcccagccacctgcctgcttcatccaggttgaaaaggcaggaattctatccagattaatttctggcactcagtcaaagagggctttgtgacctcttaagaggggatcaaagggattcagtggagaactgtgaaaggaggggctttccccagaggcagggggcccagcccactccaagactgcaggaggggccctcagtgggaggtgcagctggtgagtccagcctggcagcctctttgtgcacgtgttcaatccaaatgggaaaccttttggggccaggctgccagtcccccgcgagggccacagtctccagcatctcccagccacagcccaagccccacagtgggtcatcagggaccccataactagtaaccagggctgcttcagggattgaaactaacaagtggcagagggccgggagcattgggaaagagagctcatgtctcgcaggctttcgttacagtagagggagagaaaaacaattactaggcacctactagggtcgggagctctgctggggacttctcaaaatttggttaggcctgtcttgaagcaggagctgaggaagcagagaggcacgtccaggatcacacagctagagacaggcagggctgtgaattgaacccaggggacaggaggaggatgggccttttggcctcttccgttggagcccacagagctgccactttgcccagctggagctatctttggaagagacacaggacgttttcgaaataaacttctcattgaaggataaaatacatctagaaaagggtacaaatcaaaaagagttaccattcacctgggcccctcctccccaccatgggcagccactgctatcctgacttctagcagcacaggtgagctttgcatatacttgaactttatctaaatggactcagacaccctg

SEQ ID NO: 84371 - DNA, 1125 bp, Homo sapiens
gtgaacatgggtgtgcaaatgcacttttaaatataccggcgctcaaaaaagtcctgatgcataggttctgcctgcccccaacaccagtctgatgggattgtcctgaggttggactccgttattggaattctaagccccttgggtggttttaatgtgtagccagggtcaagaaccctgcctgatagagtcatttggggcacacctcagcacagggcccagtacataggaagcccggggatgttagctggtgtgatggtggctgctggtgtcggctgatgtacagctttgtgtgagaggacagcttggggccggaatcctcccccatggctcctctttgccagggaccctgtgcgagccccatgctgacgtccctacccgaattctcctggaagttcctcctgtagcctcctgggtccccaggtggctccctctgacctcactgatgatgcaggtgcccaggtgtgccgtttctgacgcagggcagggccagggcttatgcaatcgggtaatgggctggaggcgggccttagggtggaagtcagtgtttctgtcccctgctgcagcaagagcaggataggacatcaggcccccccccccccaattccccagggaaagaaaacccaaccaattccaaacccagctcccactttctcaaccacagttgcagagggccctgctgccttctgtgaaatgatggggctggacggctcagctcgagtcaccgcagtaagatggcagactgactgggaccaggcgtcctggggtcagtccttgcttgctccttacagctgtctgggcttccaacagctgctatgacaaatttccgtaaactgtgttgcttaaaacaacagaaatttgttctcacacaattctggggccagatgtccaaaatcaaggtgtcagcagggccacattgcttctgagactctaggggagggccttttccttgcctcacccagcttctgatggtgtccggctatccttgatgcgccttggcatccaggctctgcctccatacgtggaggtctctctggagcatgtgtgtgtgtgtgtgtgtgtgtgtgtgtgtgtctctctctctctccacatggcctttttataacgacgccagtcactggatttagg

SEQ ID NO: 84372 - DNA, 1050 bp, Homo sapiens
gctggctggtggggcttgggctcggatgtggggagccctcctgagttctacctccctggactactcctttacagaacttggtaggtgaaaacaatcagagctgctgtttagccaggaactgagctaagtgttttatatattatctcatgaaatagtcacagcaagcctttgacagtagttattcttatcctgatttgcagacaaggaaactggtgcaagtaatagactgtaagtttcatgagcaccggggcttgtctgctttgttcaccatggttatccttagtacttaacatagtgcttggcacgtcatagtagatcttcatgggatgattggatggaagggtgaatagatcgatgagtgagtgatggaagtatggatggtagatgggtgatgaatggatgatgaggtgggtgaaggatggatgggtgggtgggtggatagttgggtgggtggatagttgagagggtaggtgaatggttggatggataagtagatggatgaatgaatgagtggatggattaatggatggatgggtgggcgggtgggtggatggatggatggatggatggatggatgggtgggtggttgggcagatggatggatgtgtgggtgaatggtaggtgggtgagtagatgatggatgggtggatggatgaagtagagcttagatttgatctggagtctgctcgtgaagcctatacgcttcgccactgagccatactacctttggttttgtctgatgactacctccctaggatagcatttttaaaaaatagcattattgaaatggaatccacataccataaaattcacccactgtgagtacacaattcagtgatcttagtaaatttataaagttgtacagtcatcaccacaattcagttttagagcatttccaccatcttgaaagatgccctcatgcttgtttgcagtctcattcctgttctgtgccccaggcaatgaatgttccactttctgtctctgtgaaattgcctttctagacatttcacataagagaaatcatacactatgtctttcttatctggcttc

SEQ ID NO: 84373 - DNA, 1164 bp, Homo sapiens
ggtggtgagggcactggcttgagagcccgagcacatgtttctgtctcagctctgccaactctagagccctgggcagattttctaacctcttgtgtacctcggtttcttcatccttttagcaaaaacaaaaacaaaaaaacaggaaaaaagaaaaaggtaatctatcaaggattatcatcagggtgaagtgagcctgtgtgggaaatgagtctagtgtcaggaggcctggctgcaaatgcaccccgtgactttggatgagacccttcctctctcggggtgtcagtttccttataaacggggactgggccaagttgtcagtttctcagggccctttacaccctaacccatctgattctttgattgtcttccatcttctgccttccttacgtgagtaacatgttgctgtctctttatctctttcaaccagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagaggtaaaacccctcccctggacccctttacattgtttgcctttccctccaccgatcaccggctccatgccaagcagcaggcgcaggcagagctccgtgtgggctgtgttgttgccctgctgccgaaggaggtgagcagttgcccacccagccgtgtgtgggagttgggagagggaggcttgccccagctgcttgcagctgtgctgtctggggattgtaggcaccgaagaggaggtgttgccccgtgcagtgagagccagtagtcccatccccatctctgtcttcccctagcagtggcccacatgagctccaggggtccagggggattcagctttctgccctcgtcaccccacaaagcctgtagatgtgctctgtttaatttaaacaccattttaaaaatcaggagatttcacagtacagtgggaatttccaggttctctttaaaaacaatcagaaaatccagccgcggtttgcagctggtgctacctgatgccacccgtcggctgggcctcctgtgccatctgctttgctggcctcctcgcatattgaatgtgtgctttgtgccaggcaccatctgg

SEQ ID NO: 84374 - DNA, 1002 bp, Homo sapiens
agcaaagacaagccccctacccccctggagcttgtgtcccggcaggggagacaggcagtgaacaatgaaactcatcagcgagtctgtcccgctgttggttaggcagaaggcgcttcggaaatgtgcttctttctgttttctgtttcaggtgctattctaggcgctttacaaatattaatactgctctcgtttatttgctcacctggccctctgggaacactggagttgatgactcctgatttaaactgtgcacagccaccagactgatgcttctgtccccctcccctgacagtgatacccccggtcctgagtctcccccgtcaagctcccatgcaagtgcctggctgcctggagccctcccctttctctgcaggcccacactggccgctgcccgtgggacggggcctggcaccggccctccgtgtctgtggagtagagaaggtccctcactccaggaggaggcgaggtgggaggtagaaagtaggtggcagtgacagtctcaggcagagggacagaggtcagaggtgttgtcctcagttgggagaccagcatcgttccaagaggagtaaaaacccaggctgggaaatgaatcacagagtggctggaattctgagcctgggtgctggatgtccagctccaggtgcagacttctcatctggagaaggggtccctgctcacctgtagtaagccaggcaggtgccaggtgccacccaatctggagtgcagtggcgtgacggctcactgcaacctccgcctcctgggttcaagccgttctcctgccacagcctcccaagtagctgagattacaggcgtgcgccaccatgcccagctaatttttgtatttttagtagagacaaggtttcaccgtgttggccaggctggtcttgaactcctgacttcaaatggtccatctgccttggcctcccaaagtgagacagcctctcttttaaaactcacattctctctgaaagatgggcctttctgtcttcacttcacagatga

SEQ ID NO: 84375 - DNA, 1060 bp, Homo sapiens
atcaggaaaagagtatttcatcccatcccagtgccctctttagaaacaccttgttttcaggtggtgacaaacccacacagacagatacggttgtggatttttgggggattttttcttttctttttttttctgcttttaatatgaatgatgtgatgcaggatgtgttgctctgcatttatttttttcacttcacaatatggcctggagattgttcgaagtctttccgtggctatctaccccacggttcctgatgcttgtttgttgtgtttcaggcaatcgctcctttgctggaaaacaaccacccaccaccagatctctgtgaattcttttgcaaggtacgggattgctgagctggggctgtggctgcaggaagtaacctccctctgtgcgcataccagggattgggtttgcacagaaaggccaaaaacctgggccccaccgtcttgggtcacggtcccagacacaggcggagagggcatgcccggcacccattcttagggctacacccacgtctctgccagacaggtgacaaagagtcacaaggggaacatcttgcttttccttggaatcacttcccggctgtcttaggagacaggttgctgcagatttcctgggctcatgacgtcagagctgggttattattagccaaggttcctctgcgcagtggctggcccacggtggggtgcggctgtggggctttccctgaacacgggaggcagcacggtgctccaggttagcttagaggagctgtggagcagggcatccgctgccgggcacccggcgccagccttgcagtgggattcacataggacatgtccagggcacatctttgtggctcaggccgaaccatcacacaaacctgttttgttctttgctgtgtggtttttttagtgtaataattttatgtccttggagagacatgttctcagcactcccctgtcatacccctgctgccccgctcagctggtcctcatccctccccgctcccattacctgcctcctgccacggtcacccgctgtcctttggagaggcgtgggctgtgtccagcagtgggaccag

SEQ ID NO: 84376 - DNA, 1048 bp, Homo sapiens
caggcgctgcagacgaggtttgctgtcaactgcatttccattttctggaaaccatgagtcagggacaggtgggaggaaaggaggaaggtgattcttctggagggaagacaagctagctgcaaaaacagatgacccctcagaagggagcatgtgaatacgggggcataaaggggtctccatgtcctgacatgcacacgacaggcctcaggctcctgcagctctgagaaccccaggctgcacctgggccttccgcactcaagcactgcagtccagaggacctgctgtcagtcctcatctgcctcccaggcgtggagttcagcttcctcaccggcaccctctgccctcacataccgctctggagattaagtgagcaagtcgggtaggcagtgagtaagcggtcgctggcatcactgtcaggacttatctcaggcaacaggctttcctggtcattcttttctccgcgtctggcatcggagcctttcctcagaagcttccagggtatgattggggttctgaaggctgccactctatcgtgggcttatttggaggaaggtggggcaggaaaagccctcactcaggggttatctaaaccgcctgttgtcgatgggagtgaacatttgtacttggtgaaaaaaacatctcctcccgtttctatgtaaggcacagttagacacacagcacgcaaaccgatacacagtgtatctgtggtgagtcgtatgtgggtaggggtcccgggaccacccctctgcccagcccgggtctgagcaccccctggcctctcccgtgggtggtgcccaggtgtcagcggggcatctctctgcagcgcctccccaacacagaccactggacaagggttcagatcccacctcctgccccagtgcaagccaggatcgaagtcagcatcccactcgatcttggcacctggtggcacttgctagtcccccagatggagactcaacatcccttctgctctgaagccggtcacaggccccaggctctgtcattggcccggtcccagtgtgcactgggccttgtgttcagcagtccc

SEQ ID NO: 84377 - DNA, 1015 bp, Homo sapiens
acctggccagaaacagaccctctgcctctctcttgccggcccctagcaccatattgaattgatcactggaaactagagagaacgctgtctggtggataatggcctgaagagaaggctttgtcaaaataaccaggccctgaaatgcctccaggtctctttcaagaggttggaaggagcaagcctcgggaggcagctggggctctcgaaggagccgattaccaagcgtgtttaggaaatgctgcctctgtaagggcacattacacgcagtaattgccccatgtgctggcctggccagtccccgagggtccccagtacttgaggccggagaaatccacctcctaagaggcgctcagtctcagcagagtcgtgacgtcattggcctcagtccccgtccccataggcctgggcgctcttggctgtggcaactgtcttagaagaatggtcccccatggccgctgatgtgtgcagtaatgagtgccgcccgccttaatcgtggaacaattaatgaacacacctgggtctccggagcccacatgcacccacacatgctcaggcagcagcttagcccctcttattcacaggtgtgggcacagggaactttcgggaatggggggcccagtgtgttcatgttgctctgatctgccgcctcctcaaagaaggcctttgttttggagctttgagtggggacaaaatgttggcatttcactcacattcctcttcattctttgaatcagacataaagtctagacgtccccagaggttaatcttgggaacattgtgctgtttccgacgcttctgttaaccgccgtgttttcccctgtttttgttgcagagctctcgcacatgagaagttcaccaagtgagtgtctgggcaccgccctcattccattctggcacgcacggcctctgtcctgaggtcttccctccgtggcccatgcattctgggaggcagtggtggctcctcttggcagttctcttgagacacgtgtccctgatccaccgccttgcccagctc

SEQ ID NO: 84378 - DNA, 1612 bp, Homo sapiens
gctctgagccattccgtgagtttgagcacctacttcatgacagccactggggaaggaactggggagagagaggtgtcttaacttctggcctttccaccagtgctcaggggcctgcaaacatcccccgggggcctgccccatgtccagacaccgcacggtaagcagatgcctgggagactcccatgtccattgacatttgaacctggagaacctcagtgcgtggtcactggtgctaccattgtacaagcaggaagttgggcaggtgatttgcccaggcttacacagccggggctgcagaaaggggatagtggggttgctggttttcaaaacaaggcccttggggtgcacagagtgtgctgagctagggtggcaggccgggtccgtaatgcacccctgcggttctggacagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctggtgagtccccggctgctccggaccactcccctgcccagcaggccagggggggccagggcgggatgcggggcagctagtacttggacctgagtggacctcaatctcgttgaattctcctccaaaccccagaaattggtattaccacctgccacttttcaggtaatcaaagagaagcaaagcaatccccagagtcacacagctcattggggcctggccaggacattgcccaccctccctcctccatgtcccttagacccttccatttcagtacatgggggacccaacttccaaatgccagcacccacacctctttgctgaaggactttgtatgtccacatgcatatactcacacatgtgtacacagaaggacggaaggggcaggaaattcatgccttctgatctcctggagcagccctcaaccagtcccttctggggagagtgtgtagaaataccccagctccctcaccccttcagtgagatatgtttgagacatggcttctccaccatttcttagagtcccccggtgggatttggtgccagtacccacccagtgatagctggattgataacaccccttccattataggtagccacagtgtcacttccccactctcccactggtgtttcttgggatcaccctccagtaaaccacctgtgctcaaacctcatctccgggtttgcccctgagaccaagaccaccgtgttgccttgtaccaccaagaaaataacgatggctccatgagtgttgttaacagaggtggaagtctagaatggaaacttggggaaaagaatggttgtaaccagcctggtttctgttgcagcaaaggaaaggcgggcccaccaggctaacactgccctccaagtccacagtgagttggtttggttctctttggggctggatggagaaggtgggttggtcctctctgttggggaacggcaggtggtgtctgctgctgagatgggaggtgatggagggcggggcacaaggaccccctagtacttaacacgccagctcttccaggaggtagctgggttacaggaagagaaatgaaaaccaaaaag

SEQ ID NO: 84379 - DNA, 1050 bp, Homo sapiens
actctgcacagggcagatgaaggggccttcactgcacacctgtgaagtgcaggttctaccctcaccctaattttccagaggagaaactggggacagtccctgcagcctgcccccggcccagccctgtccttccactgtccacccagcaggagaaagccacctaggcagcatctcgaagctagggagagacaagttcaaagccctccttcatggaggcaaaactgactccaagggggccctggcctggctccactcccaacagcagaagctggattctaacccggttcagagaggcgtgggattgtttaggggacgtgaacgcagcccagaccccagggcttggtgggccatgggcctcagagccaggctctgtccccatccctttcctccacctctgccccagcctcagagtcacttccccaggagtggccgggagagggctgagagtttctgtgctctacagtttggagacgctggccttcggctcctgtcggaacacctcaccatgctccaggtgctgaacctgtgcgagaccccggtcacagacgctggcctgctggccctgagctgtgagtgcctccggggcagctggggggtgaggggccgcttgattcattccttccttgcttcagccaaactggccaagcactgactttgcaccatgcacagatagagaaattcgttcattcacaaacgtgttcactgcacacctgctgtggaccaggcaccattccatgtgccaggaacaacacagggaaaaatatccctaacctcagagagcttatattctagaggcaatagaaaaaatgagtaaggccagcccatagcctcttgacactcacagtccactgaggggtcgagttcaaggacggggctgtagtacattgccactgtggtcccctgaccagtggtggcagcgtcttctgggggctggtcagaaatgtacattcccaagcccactccagacctcctgactcagacaccgtacggtaagcagatgcctgggaggctcccgtgcccgttgacatttgagaagccctgtcataatag

SEQ ID NO: 84380 - DNA, 1050 bp, Homo sapiens
agattcctggtccctgctgcggccctgctcagcgtctctgggagtgggtggaggggtctgccccccgtgcgactccaacacaaaccagaggttgaggcttgctttcaagaagcagcaccgagtcaatgacgacggggggaccatccggggttcccttagtggggaggcctcgggcctgatctggggtgtggcaggcaagctctggggacatcaggtccaggcagtgggggcacacgacagagggaccagaagggagggaggctcagagggtgggaagaaaacgaaggctctgttcagaccagcacgtgcctgaaatagactttcggtgtctagtgggccacctaccctggctgtgtctacgaaacctccctccccagccccatctcctaacagggggcctggcacctgcattgagctcctccagcttggccatcccataccttcatacctttggggcctcgctctcctaacaactgtatctgtctcttgtgcagccatgaagagtctctgcagtttaaacatgaacagcaccaagctctcagctgacacctacgaagatctgaaggtaattccctccttcctccccactctcctcccctccttcttctagccagcatctggatgctggtgcatctcctgcacagagctcgttctccagtaaaggatgatgacatctacagatcaatacataaaataatggcagatcaaaaagagtgacaaagaggaagcagcagggaagtaattggaaataggaaggcctgtgtggcctggggtgatcagggatggtgcctttgatgaagaggccgcaggagctgagacccaaaacataagaagccagaaataccaagggcgagaggaaaagcaagtgccaaggtcctgagacagaagagatgggcgaggcctggctttgcagcaaatgtaaccaggaactgagagagggaatgggctggggccggatggaaaaagccctcacaggtcacagcagagcagcgagtcatgcttttcaaagcatgctctggctgttaggaaataaatattttgagagggagc

SEQ ID NO: 84381 - DNA, 1047 bp, Homo sapiens
tcgtgtttgagaaatgctgcctggattatcttgagttcaaagtgctgaaagtcagatgctactgtgagaccaagctggaaagagaacatggggagtgcaggaaaggccccttgggaagaaaaatcactttcagtcgatttttttattttcacacatttgagagagacatggtgccaacttaatgctgccagcctgtgaccggcctccctgtggaggggactcgagcaaacagcagctgcctgtcctttggaggaggggcctctgctcagtgccaggcaggccacgccccactgttcactgcccagtctggccagaccttcccatttttcaagagaaccttgaaatctagattcgtctgtgaagtctcctaattttgaaaggctggcttagtatgctttatagcactgcaggtggctgcaggtccccacctgtaacctctgcctgggcagtggggagccattgagggttgttgagcacaggagagcagcagcgaggaattgcatgtgcatgtgtgtatgtgtgtgtgttcatgcatacatacgtgtacatgtatccaaaaagtgtgctggccagtgtacaggaaagttgggagggaggatgtaaaggcatgaggccagttaggaggcagctacctctctgtatagtggaggcttgttaagaaaaaaagccaactgttcataaagaaaagtggaagtctgggtagcagaaacagaaagcagaaaacaatggagagacatagcaggtggaatcacagagtcgagtaatgcatccagcctagggggagcctcaagtgggaagaatctaagccaaaccctgggtacctgggatttcctgggatccacgtcactcaccctgtccattctctgataacgatgagaatatcactaacagtaaaaatgagaacaatttcctttcatagggcatatacggtgccctgggctttctacatttggtatttaacccctagcaccatcctttgagccagggactagagtcagatgggcccacagaggaagaaactgaggcccctagaggctgggttatctg

SEQ ID NO: 84382 - DNA, 1037 bp, Homo sapiens
tttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccg

SEQ ID NO: 84383 - DNA, 1051 bp, Homo sapiens
aggttttactgcaaacaacttttggggacccctcccctctcaaataatctcagacagatccaagatgtttttttttttttccagagcagcacaaagagagagccagacaggcctggggttccatcccagatccaccatttgcaggctgtgtgattttgggcaaattccttaacttcgctgagccttctcttttcctgtgttaactagggaagatgagactagactctccagtgtgtatgcaaagcacccttacgctgcagagatgctgcaaatagggagtgtcttttttttcttcctttttcaattttatcctctgtgcttgccctagagcttgttatcaatttctcttagctttgtcaattgtggtggggtgtgggggattgagatttggctttcctgggaagatgttccaaaactgtctttgaaataatactctcctcctctgcagatcagtggacagggtgttgaagggtcggcataggtggtaagcatgattgatggcccccagagatgtccatgtcctgctccccggaacctgtgggtatgtcatgttacttggtaaagaggaccttgcagatgaaattaagtgaagaaggttgagatgggagagtattctgggttacccaggtggatccagtgtgttcacagggtccttttaagaaaaaggcggggctgggggcagtggctcatgcctgtaatcccagcactttgggaggccgaggcgggtggatcacctgaggtcagcagttcgagaccagcctggccaatatggcgaaaccccgtctccactaaaagtgcaaaaattaactgggcatggtggcgtgtacctgtaatcccagctactcagaaggctgaggcaggagaatcgcttgaacccgggaggtgaaggttgtagtgagtgaaccgagttcatgccgctgcactccagcctgggagacaagagcgagactccatctcaaaaaaaaaaaaaaaaaaaagaaaaaggcaggagatcagagtgagtagaagacaatggcaagatgatggcaacagaggttggaatgatgtgctt

SEQ ID NO: 84384 - DNA, 1062 bp, Homo sapiens
taggtagaatttaatcatattgtcacgtttccactgattttattattttgcagttcctattgtatatggtgagtgttactggttttctttttgccaaaaacataaaatcactcttaacatacatcagttcaggtgaaaacggtgagttgatttaaagaaaactatcacataaatagtatcagcagtaggcagatacaacaaaccttataaggttgataaacaaatgtttgcagtttgagaaataatgtcatatggctccaaaccaccccccaaaactggtcaatccatgtgtgaggaaaaaaaaaaatctctatatagtctttgtataatgagagttttctgtgtaattttgatacacagtactggtttaaagaaaagcagaattagcctattaaaatattaataggctgtatataaagtaatgagcccttcctttattgccttaataatttttgttatatttgcataccatgagtactattttatatctaatacttattttaatattgattcactatttttaaacttaattttatatagaaaagaaacttgatttcatagtttagaggtgccaggtatgtattttttcaatatattttaaaatatactacagttaagacataacaaagggtgggcaccatttaaatttaattaccagcaggagggtgaaaaacaccaagtttaaatggcaccaaaatgatgaacatttaggctgggcatggtggctcatgcctgtaatcccaacacttggggaaaccaaaatgggaggatcacttgaggccagggatttgagaccagcctaggcaacatagtgagaccttgtctctactaaaaagagaaaacttaggtaggtgtgatggtgcatgcctgtagtcccagtcacctggctttgggaggctgaggcaggagggtcccttgagcctacgagttcaaggatgcagtgagctgtgattgtgccactgcactccagcctgggtgacagggcatgaccttgtctccaaaaaaacttaaagaattatttgatggcccatgctgggggtgttagtggtgagcacataaagc

SEQ ID NO: 84385 - DNA, 1037 bp, Homo sapiens
agggattcccttgtttcctaacccacagccctaggttgagctcccaggaaacatgatctgagacgcaggtttgtgtgcaggaggcttactagggagtgcagggtcatcaccctgggggaaggaaggcagctggaacaggcagctggggagtcacaaccatggcctgggcacacctgatggggagctctgagcatggcctgtggagctgtcctgaattgagactagagggccaggcctttgttcccttgcgtggactgggtcagagctggctgccttggaaggggctttgacctgggcgaggcactctctgtaggggatggcaggttgcagagaggggtgaagctgagccgttggcttcctcccctgcagcgatgggggctcagcctgcctgtgctggttttggtcgggctgtgcagcacgacacacacacatccagaggtgggagtgagggaggggctcgcctagggagaaagcgggtgaggctgtcccagagctaggagcccaaagaagctctcagcctccagtgtttacattgtaaggggaggcctttggaccaggtgggctcccatgtcccaggtgcttggatgctcaagcccctggttcctgggttttctccacttgttcttgagcagctgctctggcaccccaggcccctcagtctctctgttcctggacatgggatggttcctttgccctgctgctgtctgggctcctggggggccctggcctcttccttgctcccaggatgggctccactggggcaccagcatgagaggacgctggcctctcccttgctcccaggatgagctccactggggcagcagcgtgagaggacgctggcctctcccttgctcccaggatgggctccactgggcaccagcatgagaggacgctggcctctcccttgctcccagggtgagctccaactggggcaccagcatgagaggacgctggcctctcccttgctcccaggatgagctccactggggcaccagcatgagaggacgctggcctctccctttctcccaggatgggct

SEQ ID NO: 84386 - DNA, 1027 bp, Homo sapiens
tttcaaaagccatgacactgaaacaatgtggtcatagctgtctcttcagcatgccaataaaatagcatgccatttctgaaacaaaaattattctataaatagcatggagccattcttacggtggacatcaaaaatcatgtggtcacttttttcatatttacaggaaataggagcacacaaagatgagctcagctttgaacagttccatctcttctataaaaaacttatgtttgaacagcaaaaatcggtaagatgattcttgagcaagtgatcaagtgatgtttctgttttccatgtatttccaagtctggcatgttcctaagaaacccacaagaagtgttgaatctccattttagtcaaggaaacataaatgagaatgatgaaagcataccattttcatccattagattggcaaaattctttaaccatgacagagctgtgggcaaaatgtagagaaatggtgttcatatgccttcctggtggaaatgcgaatggccataagtttgattggaatttgatctgagtctgttaaaaaagtgcaactcactctactgcattatttcattctgaaaggaaatttagcaaatggctgttattattaatagccatctccagattgaggaattatatatatgtttcttctttttacacgtttgtttgtttgttttgagatagagtctcactctgttgcccaggctggagtgcagtggtgtgatcttggttcactgcaacctttgcctcccgggttcaagcgattcttgtgccttagcctccccagtagctgggattgcagacgtgcgccaccacgcccagctaattttgtatttttagtagagatggggttttgccgcattgggtgggcaggtctcgaacttctaacctcaactgatcggcccgcctccacttcctaaagtgctgggattacaggtgtgagccactgtgcccagccctttatatacttttattcatattttttatgagggcatattttttgattaaaataatagactatttaaaaattaagagg

SEQ ID NO: 84387 - DNA, 1012 bp, Homo sapiens
agaaaggaaacagggttatttgaggttgcagaataatatgtaaagcttgaaacacagcaaaaaattgtgagatgtacgtaaatgttataatatgatatgataccattaaatgaatatccctaaaacaaattctagaaggaaacctatgaaatgcttaagggtgactgcttcttgggaatacgactgtggagggaatgaggagggcttctaccttttgcttcttaagtttctgttatatttgaatatttacaactaacatcaactaaaatgatatttttaatgatcttgttgcatctgacaaaatgatgcttttttaacaacaaaaatctttccgtttttgcattaagtgacttgtctaaggttcttttttttgtgtgtgctttccatttcagattctcgatgaattcaaaaaggattcgtccgtgttcatcctggggtgaggcagctcttgtgtgtcgttcggggcggctgtgccggacctcggtgcctggtgcccagccggcctccaggaggggatgcctgtgtgtgcaggcgctgacctccaaaggggcagggggcccctgctggggaattggccatcccatgcctgtggcgtggatagagatgagcagtagcaacaggaaggtgtggagcactgggaggatggtccagaaagttctgtagaaaagcctgtgtgcctcagggcctcctttccccgaatgtgcctcatgagatgtgacaggttaatagtttttttttttaattacaaaaactaatgttaatgatcaaataagtgaaaaattccttgttaaacaggtttaactgaattaaaatgagttcaggtgtataaactgcttcacatgatgcttggcacccatgaggggctgatagatagtaatattattactaaaaagtcagagttgcaggacttatcaggacattcactgtgcctcatgatttcccaagtggggaatttctgagatgttatgtgtttccccagcctatctgactgggagaaatgttggccctggag

SEQ ID NO: 84388 - DNA, 2436 bp, Homo sapiens
cccgccaccacgcccagctaattttttgtgtttttagtagagacggggtttcaccgtgttagccaggatggtctcgatctcctgacctcatgatccgcccacctcggcctcccaaagtgctaggattacaggcatgagccaccacgcccggcctagtattttaataaaatatcccacaatttgggtttcatgttctagtattcaaagattctgacacctctgtattcaaatgagcttgtagtttcccaccttcctagctgttttgggcccctgatccaggcatatttgcaagagtcaacagcagttcatttttgtcttgcacccatgcatgtcaccagcctgctggtcaccacctgatttgtgtctgttcttctatttttcattgtttcggacattgcatccagcccttcccatctaagcacacacacatctggtcgcatatttgcttctattagtcataaagataaagttgttagaatatttgaagtgaagaaagcattgatcaaagttgaatttacatgtcatatttcatccccttttcctatgaatatttgggatttcagggcatggagaggaaagcaacagttacttaatattatgcattctttttttaaagggtttctagaatgtctaggactgtgcagcagctgctttggaactggtcatgtatatttcagacgttatcagtgtttcagcagccctgtttgcctattcttttgaaaagagggcatatgattacattccatatcagtttcgttatttggagctgagactctgcagtttacaagctgtgtgagcttaggatcatgaggtattgttcctgggcctctgtttccttttctgtaaaatgacaatggcaataaatgacttgcggagttgtgtggactaagtgagatgaccataggaggaagaaagatgcttgtttgcacaagctgccacggtcagagtactttctttttttttgagacagagtttcactctgttgtccaggctggagtgcaatggtacaacctcggttcattgcaacctccgcctcttgggttcaagcaattctcttgcctcagcctcctgagtagctgggattacaggcacctgccaccacgccaagctgatttaaagaaaaaaaaaatgtttgtattttagtagagatggggtttcaccatgttggccaggctggtctcaaactcctgagctcaggcagtccacccgcctcggcctaccaaagtgggtctgagcactttctgtgcaccaggtgctgcattaggcacataacctaataagattttatacaatgcttcatacagtgtacatttcatacaatgcttcacagaaactgtgtggtagatactcttattcccacttcatggatggggaggcacagagacggtatgtaacttgcccaaggtcaactaggtggaatgagatgccaacccaggtaagtgacctggaaggctgatgtaactactatgcccccaggctgcttcatactaacaaacgtaaagagctatcatagggcaggagctggcaaaccatgacctatggaccaaatatagctgaccacttgtttttataaacaaaatattgttggaatacaaccatgcccatttgcctacggatcatctgtggctgcttttgcaacacaacagcggagttgagtggttgcgacagacaccgtatggctcagagagcccaaaatatttacctctggctctctgcagagaacatttgctgacccctggcagagggccatgtgcagaatgaggcctcaacatgtggtggtcgattgcaagtgaattcggaattggttgatgtttcagtcttcgattgcgactggatggaccctgggaaatgaagaattttatcagttctcactttgctgatctctcgttctctttgtcattttaaggagcattgggctcaggatctgaacaaagtccgtgagcggatgacaaagttcattgatgacaccatgcgtgaaactgctgagcctttcttgtttgtggatgaggtgagtaggctgggcttgttgtcgcttgggggtgactttttgattgatgtctgtgctttctgaggtttattttctgtttgtctttccttggagaactttgctgtatgatgttgcctcgactgactggttagctgggattgtttcttttcttttcttttcttttttctcccaggttctagattactgtaactgtaactgcccagtgggttcattttgcctgctgcctagacagaaccgattgatcaaggcaggggaattgcaatagggaaagagcttaactcacttagagccagctgaatgggagactggagttttattattactcaaatcatcctccctttcagaggctggagtttcgtttttttatgtttttgtttgtttgcttgtgtgtttgtttttgagatggagtctcagtctgtcacccagcc

SEQ ID NO: 84389 - DNA, 1786 bp, Homo sapiens
cctctcacattaacgtcatgcatgacaataaaacagtgaccaaagctaagaacttaaccctggtactttacaataaaaccagagactaaatttcatcgggggaaaaaaaaaagaagtcattaagccacaaataaatattgaacgtaaggtctccagacaaactggctgggaaatcctgaaagttttaaaaggtagatggaatagaaaagaaaatgatgaggagttgtacctaccttagactcatggatctaaaaagtccaaaaagaagctcaaataccaaaagaagctcaaaatgcatcgatattttaaaaaagaaatgccttgtaaggaattgaattcagagaattcgccataaatgtctatgaaactgggaaaagcacatccatagtagatgctggggtgacgccctgcagggctcctgggctccacagttgatgaggtagaggacttggggggcactaataccagtttcactttctagaaatggactcggcactactgcgccattgccgatgccaagctgtccttcagtgatgacattgaacagactatggaggaggaagtgccccaggtagggggacaccctagccacatagggaggaggtccccaggaaccccgaggaccagccagtccccgggacctccttcccatgtggcttctctggccggctggcaaggggatgctccgctgaagaagctgttgatactctgggtaccatgtcctggctggcttgtctctgattggctggctgccccaggtgctttaaccagtgaggttcaagatgctttcctgctctctaaagtgcctgattggccttagatggaggccggtgctctggcttggtcccatgctttcctgttgccctctcctccagctgtggtcatctttcccgctgtttatttctgcagcccccagggcctcatggctctcagacttcccatagaacagaatggagggctttgctgggaaccgttcactgcatgtctcaggatgccaggaggccaccataaatgagggctctcaggagtgggaggcaggcagaggagggtagcaggtgctgttttcccataccccttcgggtggggaccagctgaggctggcctctctatgttatctggtaccctgggtcagggtgagacagaaggacctgtctagtgatgctggggtttggtccaaggctttcagaaacccctcctctctttgcggcccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggtaatgcccccgacccagggaacgcctaccttcttctccatgccaaccgatgaggcagggtggcgagtggttctagctcaggcaggaattgggcaggctgggacctgaatcccaggcttcatttgtctagctcttctaggccgggacaagggtgaggtgggtatgactcacttcggcactgtaacccagattaatgagatttcagggcaatcttttaaaaaatcaaaagtaatgcaaaaaagtctgtgatgaacaaaatatgaacattttaaacaaagacaagatctgaccctactcttagatgatgtggtctcactcactttccccgatcccagccctggagtgggtcatgtggctctggatgattcagccaaccttctagcatctctgtctcctcc

SEQ ID NO: 84390 - DNA, 1026 bp, Homo sapiens
tggattttttctgcttcatgtttcaaacagatgaaggaatgaaagacttgtttctttttttttttaaaaaaagtcactgttttgctagttgagtcaccgaagacaagatttaataattttgaggtgggggggattggcaaacattttctgtgaaggaccacagagtgaatattttaggttttgcaggccatatggtctctgttgcagctacacaactctgctgttacagtgtgaaaacagtcccagacaatgtataaacaaatgaactgtagctgtgtttcaataaagctttatttataaaagcaggtggtgggacacatttggcctactcttgacctagttccctaggaagctcctaaagtcaagtcctgtagttggggaggagaggaagggtaagaggagctgttgagtcactcggccatatttcttctgagacacagattcttctagatctgttttgaaaatacccacatcattgttttcttattgtcttgtattccataggaggactataccctgtttatttacccacttctctaaggctggataactaggttgtatctaatcagtagggtttgtgtaaaaattgtttggccaccaggatcttggcatgtcaaccctgtgttcttcctgctccagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggtaggtggtggactcccttgtgatttggtgggatttcttgtctgaggttgtaactcatctgttcatgaattcagcaaacctctgagtattcaccatgtatctgatactgctgtaggtcctggggatacaaattgagcacaacaaagaccctgccgttgtgctgcttatagtgtagtgttggggagatgcaacaaatgacatttaaa

SEQ ID NO: 84391 - DNA, 1065 bp, Homo sapiens
taaacattttgtaaaaatgccaagttgcttagctatattttaaatatttttaaaatgaacatgtattgttttagtaatttgtaaaaaatatttatgatgagtgtaaaaagcattttctaattggtcaaccaaaaagatattcagtgtttcttttgatcaagacgaacacatgtctataactaaagtggacaagagggtatttttttcaggttctctcatgcattttaatgtttgtttttttttcctgcatcttaagtgtccctctcctttctcttataaggatactcatacttgttggatgttggaattgccctaaatccaggataatctcatattgagatccttaacctaagtacatctgcaacgaccctataaggtcccattcacaggtactggtgacctgacacatcttttcggaggaccctactgaatctactgcatcccttgagtagtcatctgtgatgtgtacttaccccgatggaaagtagacgtccccatcagtgctaaccgtggtcatagcagtggtggttggtccatgagagaaacagctcaggcagggtgcagtctggtctttgtggccctctaataggctgattgggacatttcttattctcttaccccaagtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggtaggcacctgctcacccgggtgcaggtgggcctggcattctgagggctttggtgctcagttgggactgtgggtgggtccaggcagcaggatgagcaggcccaggtcctactcagaattcaggaaggagaccaggtggattcagacaattggagcacctcttgttagagagaggcagggatagtggaggtgccctgggaaggtgggtctggttgtctggttcgaaccttcagaaggctgagtgcctgcagcaatgctcattgatgatgtctttgcggccctac

SEQ ID NO: 84392 - DNA, 1043 bp, Homo sapiens
caatggtttatagcctattacgtgttgtacagtcatggccacaatcaattttagaacatttccaacacccaaaaagaaacctcacgctcattagctgctgccactcactccatcccccagaccccggtgacctttaacctactttgtctctgtgattttgctagttctggacacttcatataaatggcatcgtgtgatttgtgatcttttagagttgggctcattcacttagcataatgttttcaaggttcatccaccttgcagcttgttaccttgccttttaaggcccttaaaagattttaaattatctgcctcctgcctgccttttagttctcatgtcatgctgtttttttctcctctgctgggttccactttaagcgtgcagctgcttagacacttttgcagtcaggtaaaggccagaaggtgacatgtagaccaaaggaaaaccgggttagattaagaaataggatctacaggaaatgcagtcattatttcaatgttttgcaataaatcaacagtgtaaagaccaagcactttttaaactgcttgcttcccacacaataaataattgtgttttatctttctttggttaaaataggccctggctcttctgggctaatccaagttgcaaaacttctgccccatgctccctttgggcatgcttgtgagatgccaggttcacattttggtttggaaggtgtagtcaccacatggttgttctctcccctgcatcctccaggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggtaggtcagcccctccacctgcaaaaacttttggggggtctctaggcacggtgatgatgggcaccacgggccaggcttctggaaagccctctgagttgctttcttcagaaatccttggc

SEQ ID NO: 84393 - DNA, 1050 bp, Homo sapiens
ttgaagatgaaacagtagagcttgatgtgtcagatgaagagatggctagaaggtaaccgtgctgcgcagcagccttctaatctggacctagcattcattggctctcccaggaatgctcctcttaccccacagtgcacggcagctttcaagggagtcccccagtaggacgatgactgtgatcggccttctcttaatggcctacgggggccacagacctgtctcaggctgccagttgagggcccatttccagagctgctggaaatgtgtattttaaaatgtacatctctatttatttagggtaatgcaaacaccaaaatggcaaggaatttaatcactcttagagaagttcataaattgttaaatcagatggtttcttttaatgatagttttctttttcgtaatcttttttattgcatatttggtctgatattcttgacaaggcttgatccctacctttttatttgaaattaaacgtgtgctgcctgtcctcttgacagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatatttattatgtcaagccaattcgtacatacaatttggaatcaaatgtcataagaatttatta

SEQ ID NO: 84394 - DNA, 1018 bp, Homo sapiens
gctcagacctgtgttcaagaatcaacgtaaatgcaagtacaaaaaagactggaaggaaatattcaaatatactaacagtcctttttatcctcttggtaaggagcttacaggcagtttataaactcatactttattctgctttccaaattacgttccttaaaatgtgctgctttgataattagagaatggaatttttgaaatccctgagaacgaaagacaaaatatgccagaaactttattaaaatgatttggagtagtgtgtcactgtatactgtatgtgtatttttacatacatattatttcctttctgaaaaagaattggaaaaaaatatggtgaggggatgtaaacacaaaagaaactttgcttcaactttggcaaattcaagtttattgtcaatactttagatctttatattatgtagatatttatgcaaattaaatgtggtgtttaagagaggctgtgcctctagcttgctgctcttgtctcctaatgcctttgctgaccaaattaatcagattttatttttaaccctaagttagaaatcttactgtatttttacttcattctactgagaaccataggttgattattttttttattcaaagtgttggcttttgtttgctgtgctttatatatggagaaatgctatttttattttcccatttaggagtttcataatagaagagcagagtttcttactatgtgaagatcttctctatggaagaatgtcattcagaggatttaatcctgaggttgaggtattaaatataattgcttcaaattaaaaatttttccaattgaatttttttctgctaataattgggcttaggtgtttctccaccaggtaccatttctactcattatatagaaaataacaagtcttgaaatatcgccatagctatttaaagaaattggaggcattgcagtctagttttatggtagaggtgagtagataatttcatatagcagtatacagcccttgacagagccaccataaatattaaaatttcaagttgt

SEQ ID NO: 84395 - DNA, 1115 bp, Homo sapiens
ttacttatatatgcaataaatatgatatatgggaagtgtaactccttagctgggtaatttaggtaaattcacttctttctctgaatatctcttttcctcatctttaaaaagaagagcattaggctacatgagttcaagctcctttttaattttgataatacttcttttagtagagttcttcagagaaacagaatcaacaagatgtatatgtgtatatatgtgtatggagagagggggtatttttaaaactggatcacacgactgtggagatgcaagtctaaaatctgcagggtgggccagtaggctggagacccagagaagtactcagtccaagtccaaagacagtctgctggcagaactccctcttcttccagggagaagagggtgagtctcgcagggtagtctctaggttactgggagggtggaaggcacagcgtcctaaactaggagaaactgagttcagaagtctgagaggcaagaaagaaaaagaaaaccatggaaatttccaagaattagagacaattcagtatgtctggaaggcaagtactaagaaatggggttgcagagtaggcaatggtcacaacgtgcagggaatttgaggccagattaaagatattttcctttattttgtgagcaatggaaagctattgaaacggggaacagtatcaagaaaatggcaaatatttatagtactagacaatgattgaagtggtttgcgtatattaacctatgcaattcacataatgacactttgaggtgactacaggcagtaactctcttcttacagctaaggcaactgaaacagaaataagtaatttacccaaagttacacagctaataagtagtgtagacaggacgggaattcaggcagtctggctccagaaccctggctctttattactactctgtactctgtgatgcctgtcactaagcactacttctagagagtagcaaactgttacatgtcatgtttaaagaggtggaatttccaaaagagggaaggaagcattcataatgttttgaaagataggccattcgcagtggctcatgcctgtagtcccagcactttgagaggctgaggtagacaaatcgcttaagcccaggtgtttgagacc

SEQ ID NO: 84396 - DNA, 1118 bp, Homo sapiens
tctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagt

SEQ ID NO: 84397 - DNA, 1101 bp, Homo sapiens
gtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaaca

SEQ ID NO: 84398 - DNA, 1069 bp, Homo sapiens
tgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcc

SEQ ID NO: 84399 - DNA, 1184 bp, Homo sapiens
ttctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagac

SEQ ID NO: 84400 - DNA, 1503 bp, Homo sapiens
cgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaac

SEQ ID NO: 84401 - DNA, 1106 bp, Homo sapiens
ttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggc

SEQ ID NO: 84402 - DNA, 1024 bp, Homo sapiens
tgatgggcaccattgcacatgtcaggcccgccctgatgggcaccattgcacatgttaggacccttggctgctggctcatgggagctggataccaaagcatctgctgggacaggagagaatgcctgaacccctttattctggtagaagagtatctaaccaaccaacagaactgtatgtttcttctttaatgtgaataactgtgaaaacaactcttttcatttttatttatagctctctctccccctaaattcacacatgcatctctggggctggagatcagctcaagagatggacaccccattgtttcctgaaacactctcctctctaaccatgaagtcttattcctggactagcctatgtatctgcctctcctctgcccatcacccatgctcatatcattcacattagacctttgtattctgggtgaactggggagatgtggcccttgggttcactttgattacttccttgtaaaaataaacgcttaatagccctgcccactaattttttggatatgatattttaggcccaagccgggagtcatccttccatcactctatatttggaagagggaaggatttgtggcatcaaatatttaaaaataaaagtaaaaatattaaaattaattgagtaacttaattaaaataatagtttaaagtggcagcagggcaaaggagcatttgtagcttcagaaatgtagtgatcattctacagtcttttgaaaagataaacctgacaggaatttctagcgaaaatgaaaattggtgacggttgagcagctgcaaagcaaaagtgaaaaagtccttgagttgtcctagcacagaacgtgctcaccagcgccgttggatcctatccctgataccaaaggatccactgtgaatagcccagcaatttttagcactgcagctgagtaaaacagagtggcagatccaaatgtcattaaacatttataatttcggggaaacccttatttcaaatcaattcttcataaccatttcctcagtaaattcattcaacaagtatt

SEQ ID NO: 84403 - DNA, 1049 bp, Homo sapiens
caccgcggccgcgcgtggcgtctgccgaggccccgtttctggaagcgtctctggccgaggctcccggccaccttgacccccggggcgctcggtgcgggccagtctccccgcgggcgcccccaagcccgaccccttccagtagccccattcatctgtcgcgaacgccctccgggtccctcccgcctacctctgacaccctccccgcccttcaactcctcacacacccccgggtgccccagcccggcagaaacaacctaaagaccctgagctttgagtcgcagcggcctccccagcccagcagtctaattggacaggttggaaaacggaagcccagagaaggaagatcttgctgaaggccgcacagctgtccagaggcagaaatggggctggaaccccgggaccagggcttgcgtcctgatcccaggaagttgtctcaggatcgatgtggaccgtgtttgtttgtttcggtttttcttaggtgcagacactcctgcagcagatgcaagataaatttcagaccatgtctgaccagatcattgggagaaatatcctttttatctgcagtcggcctcctgtgggcctttggagcctatttgccgggcagtggtggggataaatgagtagttttcaggctagcttcagccattcacttgtagaatttgagcttggattgtactgtgtttctgagaaggactgcgccgagagctaggggcaaagctgagttagactcctggctcaaggagcatacgtctaccaatcctaatagctggtgtggtggaccatgcactgtgaactaagcgcttttgtgtgtgtcttttgatgctcagcatgaccttatgagtgggttgtagtgttatcatctttagcaaatgaataaattgaggtttaggggttccatcactagtaagggtcagggctggaatccgatgcggggtagccatgccccacagtcctgtactcttacccaccagcgtgtaacagtgtcgaaagaaaattggaagaccagtttccctaaagtcgttgtgtttaaggctgtagtctgcagggac

SEQ ID NO: 84404 - DNA, 1918 bp, Homo sapiens
tttaagtcactgtgaaatacagatttgggatgttgaagacagactctaaaatttgcttttatcttcacagtaggtggggttcattcactgtgtgagtaaatcacataactgctttctatgggttatgtcatcgttattcttatccagagataatttggaaaaatgtcctaccagtctcagatgcttctgtgggtctctttttatattatgtggcaatcaaaactgccatcaactgactgattatcttaccacaagaatttcaggatggtagactggctagtgatgggggtcattcaaagaaaagagtgggagtaggaaactgactctgaaacttttaaagatatttccagttaaatctattgctaaaatattgccagaagaaaataagtttaactcagtaggagagtggaaagggatttgtagttgataggtctatatgtcatttttacttgtgctcatataatgaaaaacatgttgatgatttttccttcttcaacaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcg

SEQ ID NO: 84405 - DNA, 1055 bp, Homo sapiens
tggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagcttaaagatactgtgtaacggactctttccacttgtcccatttctctttgatgacggtctggaatgggttctgaatcaacctgctaattttgtgttcactgagacgtaattcacataacattctccactttatagtgtagagcgcagtggtttttggtgtattcacaaggctgtgcaggttccggaacatttccatcaccctagagcaaaaccccactcccaccagcagtcacccgcgttcatcacctgcccctaggctgctggcggc

SEQ ID NO: 84406 - DNA, 1486 bp, Homo sapiens
tttcttcagagacaaagatgctgtctggttcccggcaccagtttgcccacttccttatatgcagtggttctggaatcaccattgcctccgactgctccaggccttagggagaggacctcgatagccccaggctcaggtccactcagcaggcttcagctcctccccctgacaggctccttccagggcctcgcttggagtgtcctcccgaggcgcttggtcatgtttagctttatgcaaaaacaggctcctgctggtcatattgtaaactcagtagaatctcatgaacagggacttgattttgatctttctccctcgggacgtggaaacggccaccatagttgctgtcagtggcatttaggtggccgtggacgcaaatggcatttcacatctccccgtagatcacttgctctgtcttgagtttcagttgaacttcctagactagtacctagactagtacaatggcttatttttgttttgttttaatccattttcctgaagtaacctttggaaacatcagaagctactctccattgacctggacaaggtggtgttacccaactttcgatcgaatcgccctcaagtgaggcccttgtcccctggagagagcggcgcctgggacattcctggaggtgagttctcggctgctttgtgattgtgctcagtcatcctgtattttgttcaaaggagtctccctccctccccaggaggcgggccagactctccctgtctctgccttcctgggagctgtggtggccttggctcttggcttcttttgtggcacaaaccagcatgagcaagggcaggcctgacagattaagagattgttgtttcccttagaaaatgctacctagattttcacatttgaatttattttacaacggctgggtgatctacttaaacatgttcaaagtaacttgcacgctctttatgaaagttctgccagccacctattaacgtcccttacaggatgcctgtctgctggtttgggtcccagccaatggcagcagccgccctggctcccagccctcagcccagaaggccccttcagttctctgccctgcccccctgggagggacttgactgagctggggtgtgtcccttaggtggtctcatcctgtctgtctctccagggatcctgactggctacatagactgcctagggcaggttcttctccactacccaaggcaattggtaccaggcctttccagccgagcctgggcagttcttttgctctagagtcccctgtactcttccaaagagtttatagctaccaagaggagtttctctgggttccaggaattgtccagaaatgggatcaggaaggggcacccctgtctgtgcagtccagccctggacaccacgtggtggtgccagggtcctgagggccttgcgcataggtcacggggtgcgctgaaggtaaattccagagcccttggccttgcccagtcgtattgacattctgaaccagggtcctctgatggcctc

SEQ ID NO: 84407 - DNA, 1779 bp, Homo sapiens
ttaaaattttccaggagctgcgtttaaaaagtaaaaagaaacacagatgaaactattttaataatatacttgagcccaagacatgaagaatattagaatttaaacacgtgataccttatttcacttgctcagtagctacgtgtggttggcacaatggtgcagatctaagaaatagaaagaattttgaaaatgcagagtggttttttatttggccagagaattaaatattttagaagagaagtattttttccatgaaaccggtctgtagcttagatttcgcaggtgtagccttgcgtgtgtcagtggtggtcagcaaagtttgaccagccagtgctgtgcacacatctgcccatcttcaagggaacggttctgattttctcacccaccttcagcaatggaaacacacattgtccgggaggaaccaatcaggcgtggctcctgcggctcatggaggatagcttaatagagcacaggggctctgtgctgtgttgtgggaaagcagacagactcataataaggccctcctttttcctttgcattttagtaatagagatgattttcctttttgttgatgttgctgctaaccacaggaaaccatcttcatcggtactccaaggttctggaggcccatttgggagacccaaaacctcggcctctaccagcctgtccacgcttgtcttgggccaagccacagcctttaaacgagacggcgcccaggttagtgtccgcctgtgcccttccactctttccacggggcttgtgagtcattgcttttcttataggagagaatggaattttactgacatcactatcgaattgtcagatcttcaagcttgtcatttgcgacagttatttagtgaacctcgtattggcctttggaaataggctctttggtggtatcctgcataaaaagtgctttggataattagcattttgttacatttggttaattcttttttaaaaagctgggatccaacagagtgatttcatgggagctggagctctaagtcctgtggttggggagttaagagctgccggctgcagtgtgttccctgtttcagacattgatgataagatacagatagttcccttcttctgtcatccccgggggccgcggttgcagcctgtccaagaagagcatgcttctgtgtcattacgtcctgtgctgactgtgactgggggtgaaagcacccgcctccgatggcaggctgtgacctctgctgctgtctccacactcctgtttgcagtgccgcctggatcccttctccagctcactaactcggcttcttcatttgcatcgtttcctttccgtacccagtgtttgaggtggacctgctgtttccctctgtggctaggaccagctcggcatggctggtcccctttttctccagatgccacccccttactttttctgtgacgtccctggcccaaacaggacaatataagaagaaagggggagcttctcctgagaaaggggatgaagccagggacagctgtcagagctgtgtccgtggccgggcaggcacacctcccaccccatcaagcaggagtcttgccctccgaggccccctggccgcctggtacccggcccctctccccagcccctcaggcaggaggctaccctcttgacaggccccctgcctgccttcttttcctccagtgatggtatggggccagggacggaggccaccttccgtcctgtaaggcgaagaggagagtgcccgtgtgaaggtggcgaggctgccttccgcctttactcctcatcataaaccgaaagtg

SEQ ID NO: 84408 - DNA, 1019 bp, Homo sapiens
caggtcatggctgtgtgtgcttatctggctgggctgggccactgagaatgcatgtcttatgagaataggggaatctggaacatgttggatttactttgacctaaactcgtgacttctgaactcccatttcccccacttttggggactaacttaaaaaaaattcctttagagatttcttcttaaaagctaaattccgggccacgtgtggtggctcacacctataatcccagcactttgggaggctgaggcaagaagatcacttgagcccaggagtttgagaccagccagacccatttctgcaaaaaataaaaaattagccgggcatgctgtcatgtgccttcagtctcagctacttgggaggctgaggcaggaggatcacttgagcccaggagctcaaggctgcagtgagctatgattgcgccactgcactgggtgacaagagcgtgactctgtctggaaaaaaaaaaaggaattcctaaacaggcttgttgacttcgcagactgcttttggcttctggatgccctcctccagtacacatcgtatggggtgacaccgcctagcctcagtcactctgggaaccgccagcgccctcccagtggagcaggctcagtcactccagagaggatggaaggtgagtggatgggcaggatgccttggggagggaattggatccagctgaacatgatgctacttcagccagtggctgtgcctgccagcaagtggggccagtttgtgtgcgccgctgagtggttttcgtaatggctgcgggtagagcagcactcagcggctctaacctgccgagaggccatccttagtccccagagggccatgatcgaggacccagtgtgcagctgctttcccacgtgcaccccgaccctcacgccactctgagtgtgtttaccgtcccgctctcacaggtgaggacagtggctcctacagatcttcaggaagaatcaccaacattctagagcacttgccaggtcccatgcagcaggctgggatgctcccatggattacc

SEQ ID NO: 84409 - DNA, 2231 bp, Homo sapiens
ctgctggctgccctttgtgtaggtgtctgaaaacataggcctttcaggataataagaggggacacaatttaggttttttttttaagatagaggcagcacctttgcaattgtaaatattatgtactgccatggcaagtaaaaatgaaagtggatagatacggaaatacacacaaagtgaattttgctaaaacaaatcaatggcacttaagacatttctattctaaaaggcttattcttaaggcttttctattctaaaaatttgcaatgttttaattgaatattagattttgtaaatgtggtttatttgtcacgtggatgaaatatcaggaaataactcactgctcagtggaaactctcatggctgttgttttttgttgtgttgtttcaggattggaggttttaaagcaggaaacagcagttgttgaaaacgtccccattttgggactttatcagattccagctgagggtggaggccggattgtactgtatggggactccaattgcttggatgacagtcaccgacagaagggtaggaaaaacgcagatggactttgtgacttcggcactcagatcctttcttccctttgtctctggaaaggcgcccgtgagatgctggcagatcagccgacatctgttcacttgagccaggctcagctggagatgttgcagtcactttgattgcttggaatattttgataggtgtctgagtgtgcacacatttaataagcaaaacaaagctacttgttggggccatgatgcctcttctccatcttcaccttcctgaggccagcggaggcgggactcccgcgttgtggtggagagtcccttccctgacttccttggggcctgcccctcccaggcttcctacgccgtgctgcctggactttgtgggcactgccacgagggggcgcccttctctggtctgactcactcttttactggagggctggctcttggctgtccttccagacctggaattcgggcttttcttagcctttatcagtgaagagcgtttgttatctcgaggcgtgaaggggaggcaaataggcatgccagtcctcttccctccgcgtctttatgtcagtctctcgatgcatccgttggatttgggggcttgaggttgggcacagactatttttctcattttgtaaaggggagaaagaatggtaaaagtgctccatgtttttacctggtgagatgataatgacaccaggactgaaaggcaaccttctaatgcgctgtgaccactggggaactcgaggcacagggcgggtggtgagtgacaagaatgaggcactaacagcgtgcgctgagaggtgtgtgtgtgcccctccgtttcaggctgaagttgactacattcctggcatttatgtaaatccctagactgggatgggtctttttaaaaatcaaaaatgggccgggcgcggtggctcacgcctgtgatcccagcactttggtaggccgaggtgagtgggtcacaaggtcaggagttcatgaccagcctggccaacacagtgaaaccgcgtctctactaaaaatacaaaaattagccaggcgtggtggcgtgtgcctgtagtcccagctgcttgggaggctgaggtgggagagttgcttgaacccgggaggcagaggttgcagtgagccgagatcgtgccactgcactccagcctgggtgacagagcaagacactgttttaaaaaataataataaaataaaattaaaattaaaagtgagggttaaagtcacagttaaaggaggttaatgttttatttccacagagattttaagacctgagatctcctggtaagagtctttattaaattgtaaatgcctgagagggtggtcctaggccttacatttaaaatggcagcttttttcatctttcaggggcattaagcacttgaccagaagtgccctttaatgagaggaaagtacttaatggcatttttctcacacggatcttgtctagtccaggttgatgttaatggaacttgaaggggcagacacaggagaaacaagatggaaacagaagctccaggtttcaataccaggttgcgccttccctctcagaaaggatcctttgtgaacgggagctgttgctagcccagtgcctcgactctgaggtgtccctgaaaacaaattgccctttctctgctgtcacacttccagtggtcagggccctgccgactcgaagcccagctcaagtgaacagatgctgcatgggtgttgag

SEQ ID NO: 84410 - DNA, 2009 bp, Homo sapiens
atatgagatacttcaggtttaaacttctgtttaattcttttccactctctgttactgagtatatataaatttaaatgcaccaaaggaactgtttcttaaagaatatttcgagtaaattattgtatatttaaatattgtatatttacaataattaatttacttatatttatagtaattaatttactcaaagggaataatgtccttccctttattgggatcaaggactcccaatgtattataaacataatcacctttatgttttgaatcggtttctttagaatctgtgactgaacatttctatgcttctttctcatctccttctccttcactgaaccttgctgggtctaggctaagcagttatctctggtgcatttcggtaaagtactgattttcatttcataaaataaattttgctttaattaattctacacatcagccgaagcacttaaatttgcagttttacccaaacccagacagttggtttcagttgaagccttagtgtggaaggactggattgtggcaggagaaattgagttttgtcacagagactaaataactgtgtatggagtgtcttcattccctgttccctgtgtgtctgttaccactttcccaggcagtggtggatgccggataccggaggagctaacatcccagctctgaatgagctgctgtctgtgtggaacatggggttcagcgatggcctgtatgaaggggagttcaccctggccaaccatgacagtaaggctctgtttcctgagggcgtggtcttaggtgtgagagcagaagctctacacctctgaagtctagatttcttgagaaagagaatggtgatccctcagttagctggagtctgtggaaagaactcaccagtattttcaaaagtacatctgtgaggctctagttttgtccagattttttttaaatgaaaatattttatgtagccattcctaattttagtgccacctattagagtctttatgtagtagtcccaaataggaactacctcacagcttcttaattatttacaaagtgctattcatgaaataactttgtgtttcccgtgtaggaagttcccccacaggtaaggttttggtagctggttttgagaacaacgtcgtaagcattcttactacccattctgcaggtctggacagcttgttttgagcctttcactgctctgagttataacatctattcagaaacctaatgttaatagtatttttctttgattataaaatgtattcagaaacctgatgttagtagtgttttttacttgaattttgaggagattacttgtactttatgtgtgacaaggcaatagcagctcctccctcaagattaaaaacaattaaaaaaatacatagcatctgaagaatgtattttgggtaaacgagtagctattatttattaaagtgttcggcgttcctgtgttcccttgactttgaacactctttcctagtgtattatgcgtcagggtgcagcatcgcgaagtttccagaagatggcgtcgtgataacacagactttcaaggaccaaggtaaaggatgccattcatgggccttttgcttcttctttctctcgctcccttttcccccgcttctctctctgtctctcatctctgtctcttttttaataaaagctttattgcatataatttacataccataacagttgcccttttaaagtgtacaattcggtggtttttagtgtatttacaaaattgtggaaccatcaccattgtctacttccagaacaattttatcaccgcaataagaaatcccatgcccattcgacattttggtttcttttaaaatttattgcaatattacttgaatggtacccaccactttgagaggctgaggcaggcagatcatgaggtcaggagatcgagaccatcctggctaacacagtgaaaccctgtctctactaaaaatacaaaaatttagccgggcatgatggcacgcgcctgtagtcccagctactcaggaggctgaggcaggagaatcgct

SEQ ID NO: 84411 - DNA, 1066 bp, Homo sapiens
cagggataatttaaggatgaagaatgaccctttagactggtaagcacctcacaggatgcacttcacctccccagcctccgtggtgggaggaggcaccactgttcccgcaactcttggaaagatgttgctcagcttctcgtggagcctggactctgatgacgctgagatgttcaggcttttgccatgcacttagggcagcctgacttctcttttgaaactttcacaagtatgattatgcagtaaaaagcttgaagttctcttttccttccttctcccattgcgccagtcagcaaagctgtcagtcttaccctcaaactgcatcctggatccttccatctctggccttctccctgctcccaccctagtccatgccattgtcatctcttgcctggaccacatcagcagctcctgagtgccactgctgttgctgttgttgccctaaattccactcctcttctggcaaccttggtaatcttaaaacaaattctaacacagtttgcctcaagctctccagtgactgcctattctgacttcctcacccggccaagccccctggtgtgacccatgcagcccttcagaagctggcactgcttcccccgcagtccccatagccgctctccctgtgcctgttccctgcagggcagctgggctgactttctcttggtgcattagccaagctcatttctgcttttatgtttggactacgtttgaactccatgctgaaagtaggggaaggggaagcattgaaagatgtgaccaggatagttacagagtcagacttgccttttaaaataagatgtctctggcagccagattggaggggctcagaccagagacgggtagacaggaagtggtgggaagttcatagaccaaggcaagcccgttggcctgcaggagaggacctggagtctgtgctgctgggaggtgagaatgaggtgacccctagagggtgtatacagtgtcccataggaaagtgagctcatttgggagggacggggatggaaagttgaccagtggcagtgatatcagttagctgtgccgctgtcttagcaccgtggccctgcgt

SEQ ID NO: 84412 - DNA, 1056 bp, Homo sapiens
tgtttttgcccagggaagccctctagagactcaagtccaagtttccattagggctggtcacgtactcattctctgccagtgacaactcccaaagctccagacttgcaaaagcagaggtgtccctgcacatcacactgtctgtatagacagcaggctggcacagaggccttatctgtgcaggagcattccagagccaagttcccagatgccagcctagggcagcgctgtaagcaagcccttctgaagctaggtctgctttgttaactctgtcttgtacagttgtgttgcttcattgtagttttctcatatgatctactctaacactgtattctttatttcagtttgagccccagctacatagatctgactgagtgtccctacatgtggccctactgctcccagcccatctactatggaggaatgccgacagttgttaatgtcaccatcctcaacggcatgggagtcacaggaagaattgtagataaggtgaaacttctctctgacttggtctctgacttgatggtgaacttagacacagcccagacctttaggccatagttacttctgctgaagttaaaaaaggaaaagttctaggccgaggagagaggatcacttgagcccaggactttaagaccagcctgagcaacaaagtgagacctgtctctacaaataataaagaaattagccagggatggtggtgtgtgcccgtggtcccagatacacaggaggctgacgtgggaggatcacttgagtctaggaggttgaggctgcagtgagccaagatcatgccattgcactccagcctggatgacagagcaagaccttgtctgggaaaaaaaaaaaaaggaaatagccctgtctagggtaccagggctattggaagtagtgatttgttatatgctaagtctgttacagaataagtcagggtataaattaatgaaaccaattttacttttttgctttggcatcttgagtttggctcctgagtcagctaattacatttgatttttcatctatacaattttgcgcctataattaaaggcccagttgtagtat

SEQ ID NO: 84413 - DNA, 1043 bp, Homo sapiens
cgtcagctctctgctgttgagtaagcgggcagccgaggggttgttccttttcccagcagcttctttaagtacagatattttcagcaacaaggaagcctttcagtctcctcatctccctgcagcagatgaaactgccgttgtgatctctgtgtgtgacagtcgctcataatggaagccgagcagcagtggcgggcctcccgagctccagcctgatgatgctgtgaaaggcagtggaacgcaacccttgagttcactttataggcaggaagaggaggaagattgttgacccatagctttgagcacttcttttcttctgtcattaagaatctactttatctcctctacttatgtcagatttcccatttagaaaacctgcctagactccaacaccaaacatcatcacatacgaatatttaggaacttaggagagttaagttttccttttttgtgtactgatattcccacctcaattttaggaattaaaattcacttgtatttataatacataaatacacaaaaatggatgttgtaacgctagtatcaccaggctaagttcctagccaggtcacactgtgtgttaaagcttgttcagatgcattctcatggtgaaactgaaggtggccttaggtctatgtcgttctgaaaggcatcatccatcagggtggctcatcccagacaagcctcccaatctggaaacaaaaaggcaaggattggctttggaggcggcggtcctcactcagacctgtgcctcctgctagtcctgtgtcgtggcccctccccaggatctgaatgtgctcctccttctcccagccaggcggtgtcccatggcatcttcttcctgtgaccagcaggcttcctctccccagaggagtcagtacctcctatacattcatgccttctgcagcctatgtggttgtttagttgaattatcacaaaaatatgtgttactgatgcatttagcataagtgggtcccgtagaaggttgcggagtggtcagtcctggattgggtacagagatgagtgtgcactcattctctcatgca

SEQ ID NO: 84414 - DNA, 1049 bp, Homo sapiens
gcgtgcggggttctggcgtgaaaggggggtgccgggccctctcagggaccagtgttgcttctccagtggttgcaggtgctgtcaccttgttagtgaggtgagtgctgccccctagagaccagtagctcccacgtcaggacaggagcactcggtgccagcagagcaggagtcgtgtcttgcttctgccctgtcttgggtttgagagcttaggcccttcacagccttgctctgtctctccttcttcatctctgcaaagaggtaggagtcacttcttttatagttagatgaagtgaatgtgaacacactttataagcctaagtaaacaaagtgctgataggcaaaataacctgtttctttatgtttgtgttctgttttctaatatcccatttatgtgctagaactgtgatttttatatccaagcaagcataaatatcaggcagggaacaaatagtaagatatttccctgccatatatcctccatttccttggggattcactttaaaaaagaaaaacaaaaaacaaatcctactgcgtatatgtaagatatacaacatgatgttatggaatacatatagatagtaaaaaggaggttactctagtgaaacgaatgaacacatccatcttctcacagtgttacccatttgttgtttttgtgaaggggactcaccttttaatgttctctatagcaaaggatgtcagagccaccagggactgacagtcaccactctgctttgtctcactgaatctcatgcagttggaatggagcttagtgactggcccttaatcttgcagataatgaaactggaagaaagttctcaaggaggccgggtgcggtggctcacacctgtaatcccagcattttgggaggctgaggcagcaggtcacctgaggtcaggagttcaagaccagcctgatcaacatggtgaaaccctgtctctactaaaaattacaagttagccaggtgtggtggtgggcggctgtaatcccagctactcaggagattgaggcaggaaaattgcttgaacccgggaggaggaggctgcagtgaa

SEQ ID NO: 84415 - DNA, 1912 bp, Homo sapiens
agctgctgtgatgagcaccggctgattctaagcggtgtttcccagtttaacttattaattgatttctgaggaactcacctttaggtgaattgggttcctgcccgtttaccctatctagtagtggtaagcagtcctcctcagtggtaggtgagatgatattttttgggggaggggagccttaagaagttggagaaaccattgagaacagcttaatatcaactctgctaacacagaaacaattgtatttagctggacaaattcaaaataactgctacagttaataattcagctgtttggggtttaattatgcagcacattcacccacctttacctgtcaaagtttgatgaaaaattagacgctcgtgcagaacagcagttgggcacctttgccctcgctgtggccgaggggagcatctgcccttctcattcttcagggtcagagcatctcttggtgtttaacgtcacatgccacactcggaggcctcagataagtccctggaaagattcccaactgcctgggaacactgtgggcctcgtccacactgtagccactttacaggatagccttctgcctgagcctttgtcctgtgacagcgtcagcccccagcgtccccgccactcagccccaccaggggtccccgcctcccacactcacgtgcctcttcctggagctgacctgttggctggggaccattctctcatgtgacagtctgtgcagggcaggctgcgtgtcctcccatccacgctccctcagcatgttccttgtgctgccggataatgggaaactgcatccaccactttgtccccagctccctgtgtaaatgctctcaccgaactgtggtgagatgtcatccactttgtccccagctccccgtgtaaacgctttcaccaaaccgtgatgagatgtcacgtccatggccttcatcaccagccagctttttaatggcatttgagaaatgtccttccatcatcacagctgcagtggaggatgcctttactcggtatcccagtatgtgcatccatggtccttgggtttgatggtcagaaaagggcttcccttcaaattgggctcctgttttctgacagaatatgagatcctattctaattttcgttttgccccaattcttaagaagcttaagcaagtacttattaaaacgttatcccaagttagtcgtgtggttatcttgttccttctcagtggtttcttatttcctcttttacaaccgtttgaaacatccactcataccgtgtacttttttccttgtaaagaaacatgtttgggtttttttacattttaattttctaatttttctaacatatttctaattttaacttatctagagataaagcagtttccagtttctggtcttggtgataagccagtgtccactttccagtctggcatgtcagcaaaattaaaatacttatcttttaattgctttatgcctttgccattgttctggttgttataaaatatatttttaaaaatttactttctacattatcgtttaagcttattttctgtattgtagtgaatttctttgtttttttctctttttttttggggggggggcgggtgcggggctgagggggacaggatctcactgtgttgcccaggctggagtgcagtggcacaatcacggctccctgcagccttgacctcccgggctcaggtgatcctcctgagtagccgggactacaggcttgtgccactacatctggctaatttttgtattttttgtggagatgggggtcttactgtgtagcccaggctagtctggaactcctgggctcaagcagtccacctgcctcggcctcccagagtgttgggattacaggtgtgagccttgcgcctggcctggagtgaatttcagactaaaaccagtaccttcctaaggttatacagttttt

SEQ ID NO: 84416 - DNA, 1113 bp, Homo sapiens
caacctccgcctcccaggttcaagcggttctcctgcctcagcctcccaagtagccgggattacaggtgcacaccaccatgcccggctaattttgctatttttagtagagacggggtttcaccgaattggccaggctggtctccaactcctgacctcaggtgatccacccacctcagcctttcaaagtgctgggattacaggcgtgagccaccatgccctgccaattctttcttacctaaacatgcaattcgtgttttcctcaaagtgactagaaagtcagcatctgctctgtgcactgcgtgcttctccgtcccgggtggtatcctctaaaaatgcaagttgccagcacatccgcctttataatgggccagtgctgcttttttagaactgtttttagacgttgtgtatggttttttttttttttttgacagttatatgtttaatgaaagggatactttcattaaataaatgctccttttgtaggtgtgggaattaacagctaacaatgtaatcatggtttctgctattggcaatgacggacctctttatgggtaagtagccccagcagggatgacctcggggattttttcccccttaaataactgaaaaattgttatctgtttgtgtatctacctatggttacttgtttatgtctgtctaaaacttgtcttaaggatgttttcctcatgtaaaaaaatactataggatgtagatgaacacccaggtactcaccactcacctcagcagttgtcacctcaaggccggtcttccttctatttatatatttttaaaattttgttacaaatagtaatttagaggcctaaagtttttattctaactactttttttccccaaaaatcaatcagaaaagtgaatctattagggattctgcagtgttgatgagatctgtgtgcaaagcatccgggtaaagaggcaaacggaagaggtttctgcctctctctgaaagagcaggtgcgagcacagtgacactcattcacaggggaagtgctggcgggcctaacggcaacatggccggtgctttgggagttgatgagagggatcatttaggagggaggcagggaggacagtgtcacaggggggcctttgtgctaa

SEQ ID NO: 84417 - DNA, 1056 bp, Homo sapiens
agccttgttccttcactcttcatttggaaactatagaaaagggagagggtcctagtatttgtttcttttttcgttatttattttttaaggttaatttttgaataggtaatgcatagctcagaaatgtcagaaggtaacacagtgagacccccacccctgtccccgtccagcaggttctttcctcactggcccgtgtgtcctgtgtgatgatgttcctttcttatacctcctcgtagaatttctttggtgtatatgagaaaatataagtacctggtcttttaaaaacctttaaaaacataatcttaatcattacattgcttctcttcctaccataaacttaattttatattttttaaaaaagcaacagctaaaggtgatccacaaagtaatgaagcttttgtaaggaacataggagcacttgaacatcagaagactaatactgtgaaataactgttactgctgccatttgtccttcagtctgtttaggaatgaagaaggttagatagataagttgaactattccaaaatgcttaacttaatagaagtgccttgggataagtccttttgtaggagaggggcggttgggagcttgggtgttatctaggaaggcattctttgtgtagagagctgtgcatttcacctagagagataggccacctgcagaacacagctgcctcttccttaggttcagctccaaggacttagaacttctacgtgttgtattttactctccagagcattatgcatgctcaggattcatttctggttttaagtaaaaaaaaattaagagaactacttgtaattttaaaagagccttagaaataaaaactgtcctagcactttaaaacttgattgaaacactaagcagactgttataatatttaactaggtatcttacacatcttggtttttggacgccttcaactatgccattttaaagaagatcgacgtgttaaacctcagcatcggcggcccggacttcatggatcatccgtttgttgacaaggtttgtggagtcactgcacacggggtttgggtgacagctcctgctctttc

SEQ ID NO: 84418 - DNA, 3890 bp, Homo sapiens
gccttcttctctttggctgctagaatgctcaggtccagtgtgcttaatatttttggtgttattttgttgtccttacttttttccatttttctcattgattttattgttttatttttgaagatgcctaaaaaaaattttcccgtgaaagcagtgagtaataagtaaataaaaatgaaataatatgtttcatggttgtatggcacattaatttgtcttaaaaccaggatatctcttttaccctcttatttattttattattttattattttagacatagggtctcactttgttgctcaggctggactcagactcctgggctcaagtgatcttcccacctcagcctcccaagcagctgatctacaggcacctgccaccttgcctggctgacccacttgcttaaattataaatacaactaaatcatacctggctatgtcagtttgctactaatgtctgtgtgcactgttttttgtttcatagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatggtaatgatgttgtcttaagtattaggaactcccatcctatttttttaaagcttacttaatataaaattagctattgctgaataacatgttcctcttttctacagtaaatttctttcttttttttttttttgagacagagtctcactctgtcacccaggctggagtgcagtggcatgatctcggctcactgtaacctccacctcctggattcaagcaattctcatgcctcagcctcccaagtagctgggattataggtgactgccaccgtccctggctaattttttgttttgatttgttctgttttgttttgttttgtttttgagatggagtctcactctgttgctgaggctggagtgcaatggcacgatctcggttcactgcaacttccacctcccaggttcaagcagttctcctgcctcagcctcctgagcagctgggactacaggcacccgccacaactcccagttaattttttctatttttagtagagatggggtttcaccacattggccaggctggtctcgagctcctgacctcgtgatccgcctgccttggcctcccagagtgttgggactacaggcatgaactatcgtgccaggcctttttttttttttttttttgtatttttagtagagacggggtttcagcatgttagccaggctggtcttgaactcctgacctcaagtgatcaccctccttggcctcccaaagtgctgggattacaggcatgagccaccgtgcctggccttctgtagtaaatttccaatgggttgagtgcacagcacatgaatgttaactttgcttaagtttgttttcccagtagagtaagcttatatgataaaaggaaattgacatgaattatttacctacaccttcttttctttttcttttggagacagagttttgctcttgtcgcccaggctggagtgcagtggtgccatctcagctcattgcagccttggcctcccaggcacaagtggtctcccacttcagcctcctgagtagctgggactacaggcacctgccaccgtgcccagctaatttttttatttttgttttttcttttttcttttttgagatggagattcactcttgttgcccaggctggagtgcaatggcaccatctcagctcaccgcaacctccacctcccaggttcaagcgattctcctgcctcagcctcccgagtagctgggattacaggcatgtgccaccatgcccggctaattttgtctttttagtagagactgcgtttctccatgttggtcaggctggtcttgcactcttgacctcaggtgatcctcctgcattggcctcccaaagtgttgggattacaggcatgagccactgtgcccggcctgcccagctaatttttttattttttgtttcaccatgttgcccaggctggtcttaaactcctgagctcaagcaatccatccacttcgacctcccagaatgctgggattataggcatgagccactgtgcccagcctacaccttgattctttggaacaggtgccattgtaattggtgaaggtggggagctgggaggtgcagaatgtttatgttctaaagtttgagtgaccagatgtgaagaactgagcaaatagtctcacataatccactctggaattttgttactgttttcgttttaagaaacactaactgagcattcagttctctgaatttctttttcctacttgataaaaattatatacatttctttgttgtgtattcaaacttctgtaggtatttgctttttaaaaaaatatcacgggtatctggtttcgaatgatgtattctttgtggttaggtgattcatagagatctttttttttttttttttgagacggaggcttgctctgtcaccaggcaggagtgcagtggtgcaatctctgcttactgcaatctccgcctcccaggttcaagtgattctcctgccttagcctcccaggattataggcgcccaccaccacacccagctaattttttgtatttttagtagagatggggtttcactatgttggccaggctggtctcaaactcctcacctcgtaatctgcccacgtcagcctcccaaagtgctgggattacaggcgtgagccaccgcgcccagccccatatagatcatttttcctcaaagctctgcagacagctgtctaggtacttaaactagtctttgtgttttctctcgtctgctgtgggctttaagataatttttcttttgccagattttagattagatacaatatagtatatgttataatgtatgtgcgtaaatcttatttttgtttgtggtgattggtttcagaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatgtgagtattgtgactgtaggcaaatttctctctgctgtttactttgaaaatctcaaactgcagagtagttgaaaaatagtacagtgagtatccgcatccttccatctagtttgctaattgtgaacattttcctggtaggaattttttagtttagttttgtttagtgcgcagggtcggtgttgggggggcagaattattttttaaaaagagacttcgtactgttctggtagaagaaaatctgagggtttgcagtagtagatggtagtgatctttgtttctgttggaagcgattttcgccagcttcatctcaaagccttcagacttcaaggctgcggccgccttctcgtgctgaaagac

SEQ ID NO: 84419 - DNA, 1923 bp, Homo sapiens
caggatggtctcgaattcctggcctcaggtgatccacccgccttggcctcccaaagtgctgagattacaggtgtgacccatcgtgcctagctgttttctctccttcccaaatgtagtttttatcaccagctaaatactgtatgttttacttgtcttagttacggtctgtctccctgcactggaaggtaagctccgtgaggtcagagatttctatggtattttgttcattactctatccctactcctagaacagtgcctggcttttagtagtttctcactagatgagttggatgggtgaacacaggagctcagcagtctcgtcgttgggctgtgttttatctctgtgctcttcactgccattggatggaagaggtccgtatttccggctgttggctggggtgtacctgcttgaggtcctctcttcccccctcgtctttcagcctcgctagacggacacctccttgcctccctcctcaggctgggcagtgctgatccttgtgcacatctgtgtcttcctgtggttccagtgttgccacgcttgggatgctctgctcctccctccctcacgcccatctttcagtgctactgagctcagattcttccagagctgctgcagtgccccctccccagcagaagccgcctcttcacagcccggagagaactgtgtgtcagttcagcatctgtggcctggatgcctgcctctcctttcacattttcatttcctgcattttgtttagttgtccttaaatttaactacatcacacttggaaggttgtgccctgactagctaatagtccgtgtttgttctgtagtacctgatagtatcttaacttggtaagtattctaaaattgcctgatctaatgaatgagttaaggtaaaatgtcttatgataataattgccttctctgttttccacataccccacatttattattatttttaatttggggaagaactgattaccttagagagtttttttcatttatttattttttttttttgagacagagtctcgctgtcacccaggcgggactgctgcagtgtcccaatctcagctcactgcaacctctgcctcctgggttcaaacgattatcctgcctcaccctccggagtagttgggattacaggcatgcaccacaatgcccaactaatttttgtatttttttttttgggtcggttggttggtttttagtagatatggggtttcaccatgttggccaggctggtctctaactcctggcctcaagtgatccgccggcctcagcctcctaaagtggaatcacacccaggattacaggtgtgagccaccgcgcctggcctttttttcatttgaaaaccgccaaatcctttcttttcatttcttttaaaggcaagtacctgcctaagttgtaagagaacatcagccatctcttctgcatgggctgtgttaaaatttcttacctaagagtctttacctttgagtgaattattttagaacaggttgaattaaagttgatttaacccagttaggtctaagattttctcagtactattacttaattatatttgtgttatatggagcccacatgtgtcatagattctttagcttgaggcagaaaagttttaagaggcttttttgtttgtttgtttgttttttaagtggagagagagtctcactgtgtcacccaggctggaatgtagtggtgcactcttggcccactgcaaccctccaggctaaagcaatcttcctgagtagctgggactataggcgcgccaccatgcctagctaatttttaatgttttttttgtagagatgaggtttctccacgttgcccaggctggtctcaaacctctgggctcaaatgattgttccttcctttttaacaacaacaacaaaaagcctgccttgagtgagaaacgcatttaataaatatcttttaaat

SEQ ID NO: 84420 - DNA, 1041 bp, Homo sapiens
gggattacaggcgtgagccactgtgcccagccagcctgttgctttcatcatcacatctattactacctgttgtcatctcctgcctctctcttatagacacccttgtgatgacacctggcccacctggatcaccgaggatactgtctcagtgccttcatttagtcacagctgcaaagtccctttggcctgtatgcttttgtgtgtaaagtaacattcccaggttctaggaatgaggatgtgagcatctttgtggggaccatttttcagcctactgcaggaggagcatttgaaattgctgcgtggcgttctgtggtgtgcaccgaccataattattgagccagtctccttgtttatgcacattcagatggtctccagcttttcctgctcataatcttgcagtgtgtatctttggacataaagccttatgtgcttccagattcatacttcttggattgaatccctaggggagattttaggaaagcaggcgacctgcctctgaagagtgtggcctctggagccaggctgaccacctgagttctcagcccagctgttctacttgctggtgttgtggccccaggcaagttgcttagctactctgggtctcagttctcatctgaaagtgggggtagtaacgggttgttgggaggattaaattagttaatatttgcagactacttagaatggcacctgctacatcataaatgctcagtgagtgtttttcttattttggatttgttagacgaaaagtttttaatgttcatttttaagcgttttaatacatatgtgaaaattgccattctaaaaggttgtttttttttaatattcaccagcaacatatgagagtacttattttattggatttgttaacttaataaacataatttttattctagagggggtgcctcaggtttttctgtcaaaatgttacttgatttgtttaatgtaaatcatagaaacacaggttaatgttagcagaaatttaccatgaatcctttcaggaattctgtcaatttcctagaatgagatatgcttttagtttcc

SEQ ID NO: 84421 - DNA, 1405 bp, Homo sapiens
tggcggcagagcgagactccgtctcaaaaaaagaaaaaaaaaaaaaaaaaaaagggaagacacctttgttttaccatagtttggtctggcatgacttaattgttagcctgttaaacaatggtaatatagccaagtatgcaattagttctgaaggtggtagtttttcagccgacttttaattggactggatagtaacctttcgtggtctaaacacaattcagtctcctttggagctattttagtaaactagtttattacaaagcaaggcatagctgcataattagatgattgtcgggtgatacaagtcattttcactcacctaaattatgttctaattatttttaaagagataatttcagatgtattttagttatgcccagaattataatctttgtgatattcttttattgtgaaaattgtaagtgggagactccaagagctgcaaagaatgctagccaccagctaggccagttgcttgcgcaagtaatacatttcttctactgagtctcccttctactcaaatcccattaaatactattttctatttctataatttgaacggtgtctttttcagttagtacttgatgtcaaaaatttttaattatacgtgtattagaggtgtaatcattctcatgaaaaacccataggtacgggaataccatctttgaacgttatgcctttatatggaaagataaccaggtcttctgcataaagaatttatagaaattaaatccagttaacatttagtggatacagtaacagccctaagtaggctctctaagttaagtgatattacaaatgataataagcctttcagaatgaactagccaaaagtttaatattttcaaaggctatcttttccttaggctggcaagtagctgtagacagatctttgagaacaatttgtaggagatagatcccttttaagctctagtatatatacaaataaaattaaatctagcatatatatttgaatttttgtgccactctcttaccagaaagtatgatttattcttttttttttttttttttttgagatggcatctcgctctgtctcccaggctggagtgcagtggcttgatctcagctcactgcaacctctgtctcccaggttcaagcgattctcccacctcaacctcctgagtagctgggattacaggtgtgtgccaccacacccagctaatttttgtatttttagtagagatggggtttcaccatgttggccaggctggtcttgaactcctgacctcgggtgatctgcccgtctcggcctcccacagtgctggggttatagctgtgagccaccgagcccggcgtattctttttttgtttttttttgttttttttgagaccgagtctcgctctgttgcccgggctggagtgcagtggcgtgatctcagctccc

SEQ ID NO: 84422 - DNA, 1040 bp, Homo sapiens
tctttgccttatctcggtctgtgcatattgcgctgctggtttttggaaatgcggggattctgttcggcgaactctcagaaccagattgccttttaaacctgtagcttcttaaaaatcttgcctcgccttggcatggttgcgctacctaagaccgttgtggatcgtcagtatttttattaagatgtttacctttcatattgggttgagcccctgagaatcttggcctatttgtctacacaaattaagttattagattctgattgacacttcgaaattacgtggagtggaatacgacctgcgttgaattctggagactcatcctttagtctgaactgtgtaggtaagccctcctaacgtcaaggtctccaattgtatgtctacgaaaaggagggcttgcagaagagaagtaattcctctcatttttttttttttcaatctggagaatccgcttttattatttatacttattttttaatgtaagagcttcattgaagtagaatttacataccataaaatccacctgttttaagtgtactattcagtggtttttagtaaatttacagcagcacagccactaccaaatccacttttagaacatttccgttaccccaagacctctgatgcccagttgtagtcaatgcccatttccaggccccgccacaggcaacctttcatctactttgtctttctagatttgcctttaatgactatttcgtatattcagatggaaacatatgatatgcggccttttgtgtcaggcttctttcacttagcatgttttcacagttcatccatgttgtagcatgaatcaggatttcattccttttatgaccaaataatattcagttgtatggctataccacattttgtttaagcatttatgcagaacacttttgacaaataaaagtttattttatgctctaatgtgtgatgcggatgacagcaaaactgttgattgagaatgggagctgggacctgacccagacacgtgtcaaacgactgcactccccaggcaccccgtataatcaagagttggtcct

SEQ ID NO: 84423 - DNA, 1042 bp, Homo sapiens
gactccatctccaccgctctccacctcgctcactctggctgcctcattttctcacacacttcactgctctaggattttcacagttgttgaccgttcggcctggaaccctcttcccagttgcgtacatggttctctccttcactaggttcaggctgtgctcaaacgccaccttctcaacgaggcttttcctggctggctttgctgaaaccacgccctcagcccactaccagatccccttctcctggacgggtggttggctttaatacagttctcactactgcttggccttgggctacatatttgttttttgttatctgcttcctcaaagaacatatgcttcccgtagtgcacttttcactcctcaggaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagaggtgaggatgcaggcagggggccctggcagctccagggacatcccttccctgggtcccccgtctcacattcacatcagttgacaaggccacagagtggtggcattcacacgagtctgctgagacacaggctctgccacctcctctggggtacatgggctaccctgccatccctagacggatgcccccactatgccgggtcccttatgagaccgtgagaatgctgcctgaatcagtcggttgacccctcccttcctggaacggagagctgagttgagcgagaataaacaagtgaactttatccaatggataaggtgtttacaaaatgtgatcagagcttggaatgaaagcagaaggatgctgaaacagcatagtagggttgggagaggggaggatagacctgcagggtttctgctgcctctggagggacactggccctttgcttggaatcctcagccgcctagttcccc

SEQ ID NO: 84424 - DNA, 1788 bp, Homo sapiens
gccagggtcagaagagcagccctgaagctgatgtctgtccccacccggcccgcagcctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagtgacaagctggcacgctgggccgtgctggggctgggtggtgccctgctggcccacctggtgtccccactctacagcaccagcctcatcctgggtgagcacgtggtgagggctgggggggtgagaagggagggcagggaggtcactcaccttgtcctgtcccttctgccctgcagctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaagtgagaagggccccctggggccgggctgtggagcagtgctggtgatggagggctcatgcatgagcttcctcacctcagtctaatcccagcgcaaccccttcgctcaaccccttcgctcaaccccttcctagctccgtagtggtggccacacctctgtctgccctgtgagtcctgtgacattgtcacagtgtgagaggaggtagtgtgaggtgtgtagcaggcctgctggtccagcttgtatctctctgatctcagtggtatcctctcttcatccagtgccgccctggggcctccctcccgtctctgcaaggcctcctttctccgggcctttcaccaggcggccagggctgtggggaagccctacctcctggccttgaagacctacgaggctgccaaggttggttccccaccctccccccgtcccggtccctctccagccctgcagtccctgccccctgcaggtacctcctctcaccccacctctcatctcccgccctaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggttcctgtgtgtgtagttggctgtgtgtgtgtgtgtgtgtgtgtttatgtgttggggtggccaggggccctttgtttgcggagagagcccctcactcctcctttgggaggccctgtgttcactgggttcccacctggatcctctcactgagccactgaattgtcacccccgcccctgttcacagggctggaggcaggtttaggaggggaggtgacctcccctggttcctcctgttttccagcctgtgtgctggaggagaccacggaggccacgggttgcgggtgttgtaaagggtgggagggcaggctgcttggatgtgtgagcattttgtcctctggccgctattggggctccaaatccttgcctttctgggcccccaggatg

SEQ ID NO: 84425 - DNA, 1039 bp, Homo sapiens
tgtcttggcttttgttcctcaagtacagcagggtcgcgtcactcctgagctacgagggtttgacacaggtgcctttgttcctgaatctgtcaaacccgagcccgtgccattttgatctgttagtttttccctttatctataatgactcatgcctattataagaacctgttccggccaggcatggtggctcgtgcctgtaatcccagcactttgggagaccgaggcaggtggatcacctgaggtcaggagttcaagaccagcctggccaacatggtgaaaccctgtctctactaaaaatacaaaaaatagctgggtgtgatggcgcatgcctgtagtcccagctacttgggagactgtggcaggacaatcgcttgaacttaggagatggaggttgcagtgagccgagatggtaccactgtactccagactgggcagtggagcaagactctgtctcaaaaaaccaaaaccaaaaccaaaaccaacaaacaaaaaagaacccattccttttgagtaaattataccttgctggtagagtttttaaaacctcggtctttcaagcactttgaatagttgtgggagggaggtgtaggggcctcggtggggttggcagcaggtgcccagtgggtttcatagctgtgtgttttcatttggctcctcttccttggggattgccttgtctcctagcaagattcagggtgctggggactgtggctgtatttcttcagcagttcagagtctttggtttattggtcatcatcacccacttgtggaaaagacacattcatgtgtccagcacatgtcttgtctatccccggctccatcttatgcctgcgggaggggagattctagtccccacaccgtgttgtgagggtttgggaaggacctgaagccagcaggcagccttcattgtgagagctatgctctgatcccaaagctgacttttccatgccaggtttccccattgccctaggatctggtgtccctggtggaacttcgtcccgtgtctatgtgctctggaggcttaggtgtaggatccctg

SEQ ID NO: 84426 - DNA, 1083 bp, Homo sapiens
taaatttttatttttaaattttttttggctgggccctggcactgctggcggcacccacatctgtgcaatgggcccacccagactttgagccttgattgtaggaaggctgtaggcgttgcagccagaaaggcctgggtttaaatcccagcatgaccttgaattccctcacaaccttgaaagtgccatgtgacttctctgaatctccatttcccatctgtgaaatgggcatgaagcctgcagcactgttgccaggattcaggggagtgtgacaagggcagcggatgagtgcttccctcctgtcctctgcacatggtgctcccagggaactgcaccggtctcctgctgtgctgctccaggcgcactcgtggctcacagcctctccccagggacatgacatgggggtgttttaacgcagcaccatgttctcttttcgcttttggccacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacaggtactgagttcctccagagtctggaggtcaaagctcgccaagggtcaccatcctgcaaggagggagagggctgggttcgactcctgggtctgtagcttagctgtgacttgggacaagccatgctatgtctctgcaccagtaaagccattggtgaaatgtcaccagaattgtttcaggatgctggctaggaggagttaactgtgtttacgatcccacctatcccataacagaagcttggcagctgggtgcctgcctccgtgggtggggcaggttgcttgcttctagagacgggaactggtggggggaccagaatagcggccactaccctgtggtgtcctggctgactgtcggcggtggtcgcaaggatcccgtgggagaattcatttgtaccctctctgaacagtgcctactttaagtcttttccattctggccattaaagaaaatggacatttgcaatgtcagaaacttccaaggttgt

SEQ ID NO: 84427 - DNA, 1054 bp, Homo sapiens
gtgggttcgaatccctgaacggctgcttcctggctgtgtggtttggaacgagttccttaatctctgggggtcttggtttcctcacctgcactctcacagtgctgttgcgaggataagtgagtcagtatgtataaaatgctcagaacagtgcctgtacaagctacatgattgtttgcgaaataaataaaaagtacaaaattgtgccagggatcatgtgggtgtttctttccttaactgcttccataatcaaattatattttgcatttagttcaattcaaagggtatttgtggtgtgactactagaggatgggtgatactgagaacccgcgtgcgcgcacacacacacacacacacacacaaaactaaaattactccttgagcgctgcctgtagacattcattcattgcttttgtaaacagttggcctaaaatcgcagcataaagcactgcaacgatgtggagagttggcagggcaggatttgaacccaggcctccgtccctccgcctctgtagttgaatgcttttgcaagtggagtaagtgcaaactcttaactttctcccctccggtccgtgaacagccaggagagtcagcagtatttctgctttgccggctctgaggctatgctttacagaccagcttccctccctaaattcagcttctttcctcccgctggtcacccatccctcccttcccccatcaaaccatgttctgcctctgaagctactgttctctccagcaagtagaaggggatgaggaaaagagcatccatcccatcaggaggctcctggcaggtgctcccaggcctcagcccactctggtgtagtgggagaacacttccctcctcccacaggcttgtggttttctgctcagacccacctcctgccccccagggatgggagtggggagtggcgcgtgtctggcgaggaagctaaaaatgcttccctgctgtgtgtggatcctcatgaatgggccatgggagcttcagctgcagtgctttctttccccagccatctgttggacaaatgcataggagaattatggttgccgtgtctgc

SEQ ID NO: 84428 - DNA, 1050 bp, Homo sapiens
ggggaagggagaaagagggggagggaagggagggggaagaggtcagggaagtgggggaagcaagcagtgggggaagaagaggaaggaggagggagaggaggaaggcggggtgggaaagggggttggggtagtgggagtttccagggaggggtcgggaggggaggaggggaagtgagaaggagaaggagagagaagagggatgttgggggagaagagagcgggagggaggagggagagtgagagggaggaggcaaagcccctactccagcccccaccgcggagttgcgcaagccttccggtctgggattggccgccagagaatcaagacgctccgcccccgcagcccgacggccaatgaagaggcgggccgccgcctgggcggccaatgggcgcgggggggcggggcgggccacggcctggggtccccgcgcgctctccgtccgcagtggaagccgccgccgcgctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctggtaggaacttttcattcgtctccacgccccgctccccgggctcgcgcggggcctcgtgcaccgagccggcctccaggcgggacggattcgggcctcccgcgctgtcttcctcgccttattccgggacggcgtgccaggcccccgcgggcttctccgtggccagcgcgtctgttagattgtcctctgcaagcgccgcgtcgcgcggccaccagcgctgatgtgtgtgtgtgtttttttcttctcccaacccaaagggtgacttttaaatatgacggctccaccatcgtccccggcgagcagggagcggagtaccagcacttcatccagcagtgcacaggtagggaggcgcgcctgccgggcggatg

SEQ ID NO: 84429 - DNA, 1026 bp, Homo sapiens
ccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacatatcttgcttgaataactaaccctgggcccaggcagtgagcaaccccttgtatcttcacaggtctttgccccgtgttatgattcctcatgggtccttgctgactgtccccctgagagtagctggcacgtgggtaacacagaaatttctgtagtgaagcttgggcctcaaagggttctcttaggccacctagtccaagcctccccaaacctggctgaacttttaagaatacagatgcgtgagccccgctcagaattatggaatccaaaaccaccaggaacggggaggaggtggtgcccagaagctgtattttaac

SEQ ID NO: 84430 - DNA, 1072 bp, Homo sapiens
accctgcctgaacagtagctaaagcttgggggccctttacaataatcccgtggtggaaagaaagagctctttttgggagatgtgcgtgtagagttaagctcttattcccctctcccaccccttctctcacatcttctcccccctccgccattataattattctggacaaaaatcggcatgatgtattatttgtcagccttgctttagactgctaatttgttgacatctggtccctataaattgttgcacacttttaaaccatctcattgtgtatttgtattaaatatggggaaatgaaacaaagtagccattcgggaaactgattgcgagtaaaatcataacccttcatgagcaattgggttttgttgcccttctgcagatgaagtcaatctgactacacctcttttgaaacatgattttcggaactattgtaatgaatgcgtgttgtggaatctaaaatgcgaaaactttttaaaaaattagatcttacgacaagcttcaattttgttaaattagctgtagtttagtttgcatcagaatttccccctttaacgttttgttcccttattcatttacttttgtaagtagtgtaggtctttgcgccaaaaaagggatcagtagttgaataatttttacaaatgtatagcccaaagattttaagagatttggtgtatttagctttgtttagacctttctgttaaaaaaaaagatttgatatttgcttttttctcaacttaaatcctaattaactagcttattagaattggtatgaacaagtaaaaggctcattatgaattaatgtgtaatattccttgtgattttgacatgaagaaagcatctttaggcatagctcacttcctttatttaataagcatcaatcacaattcaaggttgattgaaatgttaattaatggggatggataatatgtaaacttaattgtaatttcgtttgcattcattgtcccagtatttacgttttatacaacagtctaaagcgttatacacatctttagaaaattggagtagcaaaagttggcggaacgtaaatgttagcaacactttgggtttattc

SEQ ID NO: 84431 - DNA, 1446 bp, Homo sapiens
tgagcagccgcgccgtaccaggacctcaccatcatgctcttgagcccatctcattgagagcacagcgcactgaaattccagtgaatactaagcgggcctaccacattctaaattcctcactaaagcaaaagttaggacatgtattccagtgttctgttacgtggaactgataggatttaagcagtgattcacataggaaaacttaaaggagaaaaggattacgaagcttaatgattgctgtttaatgccaagcctaagcggcacgttgcactgtgctgtgctcagaatataacattcaagtaattgagaaaagtggtatcatctccaattgaattagttacatcagggtttttgtttcggttttttgtttgtttgtttgtttttaaagatataatttcagacatgtaggtacttcctgttaatggttcctggtattcaggtggcacattaaacgtggttgctgaggacacttattactggtactataccaaaatatgaaacgtagtgggaagagcttgcttttgaatttgtaattaggctgttacttttctatttactgccacacatgcaagaatcaccatcgcacaaaacagataaatctgtttgcaatggaatttgctggccttgggccattggattactgtcatttgtcactttagtgccacttcagcagtgtagatgttcatttccagagacttgtatgtgcttggactgcagttttcctgtttattgaagtgttctcccaaaaggtctttctttgaccatttctgtcaatacaggctggatgaagaattagtgtaggaaaataaaggtagcccttggggtatgtgtatagtatttgtttcaaggatcagaaaatgtagaatttatcataaacctcgatgtagaatcttcagatcctagattttttctgaactggctattttctggctatttgaaagctcctgggccatgatcccattttcatcagatgacttgagaacccagaagctctaccagcactgccattctgtcccgtcttgaaacatcatgccctggttgccctctcctggaatagggcaggtaaggtgttgagatagaaatgtggtttggggctgttacagcctgaattcctcgactttcccttttgggctcacatgagaattgttaggagaatgtgcatgtggagtgcgggcccagcacctgctaccgtctgcgctgtaatggtggctgctcctaagagtcctcagtctcctccccgttgggcttgtgtgtacagccttatcggttgtcattcttcggatccattctcagtttatttttctggtattagctggagggacatctccttaagcctgtactctatggctcaggagtctcaaaaccagtccattttgaagtgagagtatccctaataaaaaggtgagtgtccccactcctgtgccttgttttttttgtttgtttttt

SEQ ID NO: 84432 - DNA, 1055 bp, Homo sapiens
tttcaccatgttagtcaggctggtgtggaactcctcacctcaggtgatccacctaccttggcctcccaaagtgctgggattacaggcatgagccactgcccccagcatccctactcattctttgaaaaaaacaatttgttgttgttttgtagagacagggatttgctgtgtttcccaggctggtcttgaactcctggcctcaagggatcccttctgcttcagcttcctaaagtactgggattacaggtgtgagccaccgcgcctagcctccctattcattctgcaagtatcagtctttttacttttgataggacatgttgaagttttggttaaaaatagaagaggatttgaaaatgaagttcaattctagaggttttcgagattcctgcccaatataaaaaacttctgatacattaaaacaatttttttatacttcattttttagagcagttttaggttcacagcaaaattgagagaaaagtacaaagagttcctatataccccttctcttggtattttaagtaataatttcccttacgtggctgcaaagactatatatatatttatatgtatttatttgtatatgtatttatatttatttatatttttatatttatatatatttttatatatatatattttttgagacgaagtcttcctctgtcacccaggctggagtgcagtggcgcaatctcggctcactgcaagctccgcctcccgggttcacgccattctcctgcctcagcctccggagtagctgggaatacaggtgtgcgccaccacgcccagctaattttttgtatttttagtagagacggggtttcacggtgttagccaggatggtctccatctcctgacctcgggatctgcccacctcggcctcccagagtgctgggattacaggcgtgagccaccgcgccgggccaagactatatatatatttattcaagacctgaagtaggctttctgggtagatctgatcattggagaaggagaaacatatttattacgagatactaagcattgtagtagtcatcatttgaagcctataaact

SEQ ID NO: 84433 - DNA, 1045 bp, Homo sapiens
ttccatgaattttaacagatgtattcatttgtgtaatcacctccacaatcaagacaccagttctgtcattccccagaatgacattgagcccccttgcagcctcttcttttgttcgtccttggccccagcaaagatagaactgcttctgttacagtttcttttttattggtttcatcttccatttctttttttcttaaggtcagcaccaaggtgattgtaatgaatatgaaagttggtggaatcttgaacttctactagggctatcccagataaagttgactgaatttactccctaatttatctgctgtgtttcatacaatagcaattttacacaggaagttattcaataatgagggctatctatattaccttgctatttagtactagttaagagcaaagcgagttaaaatttaatggccattttgtaatacagttctaatatagacacaggactggaaagttggtaaaagtgggtttctgttaagtgaatcatgttttctaatttggagattcaatctgaattcaatctaaaatttctgaaggaaattttagctcggaatctccatgaaagcacttaatatacagccaacctgttaaaaaccatactttgagaggtaaaatgattactttttgatagcactttaatagtagaaatagaatatacaaacagggaagtagacactcaattgcagtactttgacatttgagtttcaaggagagaggctgcctgtgagagtgactttgtgatagtttgtctactttgttcgcttctcaggacctctttgccccaagaaagtaaagcaaaattttgctatagccctattagtgagggaacaaaacttctcttcctccttcttcctttgtctgcttctgccatttgtaacacttagttcagcttgcagttggcttgcactgtaataaaactgtaaatgtcaccatgccctgacccctgtgtgtgttgtgttcaaagttttactctcgtagtctcgcatagttgagtgtggattgttgatgctcagtgcatattgttaaattggcgaacttc

SEQ ID NO: 84434 - DNA, 1056 bp, Homo sapiens
taatgtagttaattaaggcactgtgttaaaaagggagctgcagtcaccaggctttttgtttatagtgcgctttcctctgctctccgaccatggacctggtcccagcctctactggctgtgttgcaatgtagtgatcgtgaataagaggtgcagtcaggaagagtcatcttcgctagtgcacaaacaaaagtgtctgtggtctggatggtcagtcactgacatcctgtggaaagaaggatgtatcataagcatttcattgtagctgatttacatgtccattggagttcatttttattccttttggcttcattttcggatctgtttaatagtgataaatatttgaaagcatttctattgtgtttttttcgttaaatgaagatgatttagattgcactgactcttcatgtatgttattctgctagaagtaacggcatgcaaagttgtatggattaagagttttaatgaattgttgccttaattaaatggtaagcgttggttttaacattttgttgaattaaaatttgttttctgattccttgtgcagcttcctccatacagtggaacagttctgtgtggcacacaggctgtggataaactacctgatggtaagctagttctctccttatttccctgaagggaatttggccatacgtgctgggtgggcaggctacctgtaaacattgtttcccatttgaataaacatttctttgtagcttgaagtttttgctgtaaactgtaatgtatttaattgctgaatcactttgactagtgaattggttttaaagcgtatcctgtgcttcggagtgccagccatgtaagatttagtttaggaaatggttgttgagttctttttttcctaacagttctgagtgcaacaggtatgttactcttcatcagcacatgctggagttgaagcgaactttgggtcttgttgctaagcagcctgctggctccagcgccagctagcttctgagcctgtgttctttgtaaactaaggggcagctggcatctgttgttcttgcagttcacattcatgtcctggtctgtcgctgactc

SEQ ID NO: 84435 - DNA, 1113 bp, Homo sapiens
gcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataacaatggcagattacctgtgtgttaatagcaacgtctgaaggatgcctatgtcttaaatgttctctaaaagtaagataatatagaaacaaatgggaggagagggttgtcgtaactttatgttaagtgaaagatccatgtctgttagcagttcttttctgttgacaagttacatttccatttcttgccttttgttcaagtaattctgctccacggtatgaatgtataatggactttttctgtgatatacctttggtatgataatcctgatttgtactcactgtgtgctccttttttatatttcttaagatacaagaaatcattttgtgaaataacatggttttttttttttggattgagtaaatggattttattcagaattttgatacaccaaggtcagctcttgaagagaaaaaaaa

SEQ ID NO: 84436 - DNA, 2518 bp, Homo sapiens
agtatttttactcactgaacagccattgaacacacacagtgatgtgtagggtcagcattagatgctggggatgcagagaggaatgagacgtgggttctgcaagatatctttctatctagtgtctgaggcgccttgctgctgatgagacacacctggctaatggtgtttaaggaagaaaggctgtatctctcaaatctattctctaataatgatactgtgttaacatttttttgtttctcattaaaataggtagttcttgtgttccctaattctgttccccccaggaagattaaatgttgctatttgagggaaaagattagtttcaaaaatgttctaattgaataatgtacttgatgttgaactgaatgaagccttaacagtatgcattttctttggctgtgtgttttactgaagggattttaaatgctgtcccagagtagagcatgtgaaatgatttgaatgttcttcactagatgtcatcaatttctgaaatatgcttcttcactctttcagagttgctggagaatgtaaccctaatccataaaccagtgtcgttgcaaccccgtgggctgatcaataaagggaactggtgctacattaatgctgtatccttcctggacgccgtccgcaaggccagcttgttgcagctgtccctcctttgggtgcatgtgacttagctcagcttccgtgggccatctagctctccatttgaatccctaagtctggtttattacttggtctgcctaccttgcttataaacaggattattcctgaccccagtccatctccctctaaaagagaggatatgttggcacgtgaatgagggctgcagacaagctggctctcattagaatagtcacaaataatagggcagagcaaccacttacaactggaaatttggttttaactgattgaactgtcttggttaggtcaagttcttgaatacaaacgactgactgcttcgtagatccttatatggacatcacaggacacttaccctagtaactatttggtttattccttttcgtggtgacatatctaagtagttcaacgtccttagcttccttgtgtttttataaacattcttgtgcttcatgtgccttcaggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagcttgtaagtaaggtggtgaaagatgtgttaagtggtggggtttttcccgtctgataattagaattgaaatagtttagtaaagctcttgatttcctgcaaatgagtcctataattctgtctttttttaaaaatagactgttggcgattttatatggaagttaaccagaaatggaattggagcattgatgatctgtgttctttagattcagtagaaaatattttagcgtttaccagcatatatcacttgaaatagaccaaaaatgcatatagaagagacttgagttcactagctgttacagcattggttacctaaaatctactatactcgtatagctgatattctacttagccatcaaagctctttagtaaaagtatatattgtttaaaactgcactatttaacattttttccccatgtttagtgttcggctaatgaatgagttcactaatatgccagtacctccaaaaccccgacaaggttagtaaaaatgagttttgttgatgctattacatattgggagttatggagacagatgacttaaatttggtaaattcagtcttgttgggaagatagtgtctttacacctatgccattctcaacattcagccaggtgggaggtgggggagttttgatgatgttgcttttttcatcatttatgagttcattgtagttaggaaaacctgtgtcctctttccattgcagctcttggagataaaatcgtgagggatattcgccctggagctgcctttgagcccacatatatttacagactcctgacagttaacaagtcaagcctgtctgaaaaggtttgagacttctctgttgtcactagtatcaagtgttgccttttgttccagtgtttgtgtggtaactgttgcttattgatatttgccctctgtctccagcgctataagtagatgtaggtttataagagtccattgcttggatgatatggtgcaccaagcactgctctcagtactttacatatattaacttagttgactctgaataaagtatgattatggtctccttgttacggttaagagaagtgaagccactgtctgaggtcaggtagctaatgtacatggcagaacccagctttcaagtcagttctcttaaccactgcactatatgccactggggtagaatggagtgcactgggcctggaatgatggcagtattcagaagagcttatgtcttcatcatacttacaggctttagtagctatttgatgtacttgattcctttacc

SEQ ID NO: 84437 - DNA, 1043 bp, Homo sapiens
agattagccaggcatggtggcacacacctggagtcccagctactcgggaggctgaggcaggagaatcgcttgaacccgggagctggaggttgcactgagctgagattgcaccactgcactccagcctgggtgacggaatgagactttgtctcaaaaaaaaaaaaaagtatatttattgaagaaaatttcaaaaatacagaaagtataaataataaaaatccccattagtccacccatttagagatatgtgtttagtcagtttctccttttcctcctactcttgggatttcagctatgcaagggaaacccatgtcatcatgtcattgtttggaaatactttacatcttccatttcagaggaggcatggttggactttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagcctataaaaaagctgaaagaatcgtttgatgaatacctttataattgccgagtgtacagttttaaacatattttctgatgctatacacacactgtgtatatatatatatgtcttatctgtccatccatatatacatacatacgcatacattttccctgaatgattcaaagttaagttgcagctaacagtttagttcatctcaggtgctaaagcatctcctgcgtaaccacagtcccttatctaactgagaaaaacaactgtaatgac

SEQ ID NO: 84438 - DNA, 1024 bp, Homo sapiens
tcaaatttcgccagttgtcccagggatgtcatttctaggagtttatgtaaacaaggatccagtggtggtgcacctgttgcgattggttgccgtggatcaagtggcattgcaatgggttgcagtggatccagtggcattgcgcctgttgtgattggttgccgtggatccagtgacgttgcacctgttgcgattggttgccgtggatccagtgacgttgtgcctgttgggattggttgccatggatccagtgacgttgcacctgttgcgattggttgccgtggatccagtgacattgtgcctgttgcgattggccgtggatccagtgacgttgctcctgttgcgattggttgccgtggctcctaatgtagaccacaccctgatttcatttttaaaactgcaatcgacagatctgtgccttttttttttttgctgttcttgtcgtaaatagtagtgtaagcagatgctctccttttcagaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggcttattctctccctgctggcgcatgtctgcaggggacagggagctcctcccttctactctgtcaagttcagctgctcactgctagggagtaagagaaaagccagctaattggccatacgcggtggttcatgcctgtaatcccaggactttgggaggccaaggcgggtggatcacctgaggttagaagttcgagat

SEQ ID NO: 84439 - DNA, 1857 bp, Homo sapiens
tgcagccatttttcacgttgcagttggatatccagtcagacaagatacgcacagtccaggatgcactggagagcttggtggcaagagaatctgtccaaggttataccacaaaaaccaaacaagaggtatgttcacacttgattttgaacctttctactaaggtgctctggtttggtggaaagaacacaaaattaggaatgaggggaaatgggtttgagttatgcctcttaaatcagttgcttaaccattttgtactgaaagtttttatggttttacaatgaaatggttgaaacgtgatcccaagggcctcttttagctctaaatcatattacacaaggtaatgatctccttttggattgtttatcttgagctacatttaattttctggcaatctaatgatgatatcacaacatcaatactacctctgacagaggccaaatagcttatttatgttcatgataccgtagggtacaactgtcattagattagttaggatgtcagagagattccagacacatctgttttgcatttgattgtagatcttccaggtcattgtaaatataatatagtcattgtaaatataatatagtcattgttctgatgcttgttactctttgatttgatctggaaaaggtaagattcttgagtctttcagtcttcatgaatttaagagtatcacattatagcttggtggagtccttgtcaactcagttgggcgagacggatagcattctgccctgtgagagcttattagttcctggctgtccagatgtgccagcttatagctattttgtactctgcagcagagagtgtcttctctgttatatatcttaggttgtggcagtgaattcataaaaatgcactggggagatgaatgcaggctgataattatggacggtccatagcattcctgcaaagcgatatttgaataatgggcagtggatggcagctacaaggtaaaataaggtgccccaacgtagaagacctgtcatcacattgcatgactgggatggatctatccttggcttatcttgtgtgctctgagtcagaaagagcaaagtaggacatagggacccttagcaccttcggggtgtcctgctgtggactggttcacccaggctctggggggatcagtagaagttatgcctaatcttctaccgtatttgcagacttgcatctcatgggtgattttgtttaaaaaatagaagcagtaggagccagaggcagaaacttggtagttgacttcagtgaatgagctaagaagagtctggcggtggacctcgtggaagagagagagggaaaaagtggtatttgtgttggggaggttggttgggtggttcagttgtgcattgtgggtgactgtcggcttggctcacttctgtggcagctgcaactccagagatagctccctggccctggctgctggtgcactctgcttatgctgtttcttgagccagctatgggagtctttggccacccatgctgttggggaggtggtcagcctttccatgggctgcctagggaagacccttttgtgatgtgtctgtttttctcttttgcttctgctgcaattacagtttgactttgctggggtgggctggtaggggtggcggtgtgggggcaggggttgaggcgcaggtagttgttagcctgttgttagacggtagtgaagaaagaatggtttatcctaaatagcaggtttggatgaaggcttccagaaagaaggcgggccaggtgtggtggctcacgcccttagtcccagcactttgggaggctgaggcaggaggattgcctgagcccaacagttggaggctgcagtgagctatgatcacgccactgcactccagcctgtgcgat

SEQ ID NO: 84440 - DNA, 1440 bp, Homo sapiens
cttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaggtgtgtgcgtgtttctttgaatgcgaatgccttttcgggtaactgaaattcatgggggcatgagtttgcctgcagaattaaaatctgcccttcgatcagctcgacgtgtttgtggaagctgaaccaccactcaggttatgcttgtttagtattttcaaatggattagtgatttgggtacacgaagtttttgactcttcgattggcagaaaggaggaggttttctccccttcccctc

SEQ ID NO: 84441 - DNA, 1006 bp, Homo sapiens
actatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattat

SEQ ID NO: 84442 - DNA, 1730 bp, Homo sapiens
gttcaaagcaggcttcacgttgcttacgtgagtgaccgaccctaagcaagtgtagtgaaaataggtgctcgttatcctaccttagatatgcagtgaggtctggacaggctcatcccaccccaggggaacatggtgaacagactcctgtgagcactgctcactggtatgggtgcacacaactcttctggtctggcttcatttgccatttaattcataaatacagtgtcaatagaaacctcagaaaatacagactcttttgaaaccactggccaggaagtcatggtatgaatttttgcttggaagggtggccctcctctgctccttggagaacaatgaatgtgcccatttagaaagtgaacaacttccccctggaagctggccaggggctggccctagaggattcttctctgagccaaacattctgccactcggggtattcaggaccagttataaccaacttcctcttgtccgcagaatgcagtgatttttcacctccgataactgtaatcctgttgatcttcctgtgccttgagggtcttctgtttttcactttcactgcagttatgtttggcacccaaatccactccatatgcaacgacgagacggtaagctttgttctcggctgtgtggacttcatatgtggtccaagcttgagtaaatgaaaagtcctaatgtcaacaataggtgcctgtggactgactcgggaacgtaatgggacggtcttgatgagctgcaaccagctccctgtgtttgctgtttctttcattctgggcagtgcatatttctagtctcagtttgatttgcaagtcagcagagccaggcagattcccagctcccagtgcagtcagtaaatttcagggaactgactgcctttagggcctggctctgcaggcctggagtggcgctcagtaaatgtctgtacacagtaactaacgagcgacaaatgttggtgcctggctgggagggccattgtggtagtctgggctggccacgtggctgcagccgggctgggctcacagaggccacggggtctggatcggggcagagctgggaaggagagttcactcacctaccctccatcgagcccacactgtgcttgagcacggtgtgattctgaggcttggtggggtctgccgagcttcctggagccgctgccacttgcttttctttctgcttccaggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagca

SEQ ID NO: 84443 - DNA, 1163 bp, Homo sapiens
gccggcatctcaacaggcccctgatttgcagcatgaaattcacagcagccatttatgtggtttgtccccaagcttcccagccacggaggtttcttggtggggcacagtgggcggggtgggggcacaagcaaagggagacagaagccagagcaaccgagaagtgccatgagggcacccggcatgcagtcggcgcccaatactaaccagcgtgcaaccgagaagtgccatgagggcacccggcatgcagtcggcgcccaatactaaccagcgtgcaaccgagaagtgccgtgagggcacccggcatgcagtcggcgcccaatactaaccagcgtgcaaccgagaagtgccgtgagggcacccggcatgcagtcggtgctcaatactaaccagcgtgcaaccgagaagtgccacgaaggcacccggcatacagtcggtgctcagtagtaatcagcgtacatcctgcaatgacaatagctgatgtttaactagaagccaggtaccatgttcacagctgatagtcatattattatcccatctggctctctcaacagcctaaaaagtaggcacgattacactcttacagacaaggacactgaggcttggaacagcaaatccatgtccccagtgtcagagctgggaagtgttaaagctggactgagacccgatctggccggagcgcctcactctcatccgccctgctgtgtgctcagctcctggcctgttgggccaccttcccagatccttcctgctagaggcgtccttgtccctcaaggggtcctgccagggaggctgatggtcaggcctcgctgcaggccttcgagtcctgcctatggcttcatcagcggccgccaacttcaggacaggtttccccagctctctggcactggaatactcagtgggccgtggcaggtcccccgagctgccgaacaggagggcggtgaagtcaacagcagcagattatttccagctgctgctctgagtcaccgaagcatgttccaaacccagccgccagctcgacttccctggcctctgatttatgcggctggtgggtcgttgctggactcacggatggggacgtgaggtgggactgaggcatgtgtctgacgctacactggggtgtcatttttaaaaaacctttttacactgaagtgtcgcctccgtac

SEQ ID NO: 84444 - DNA, 1065 bp, Homo sapiens
aaaacacaagaggaaacatgagaaaaataaagagaagaaagaaagaagaggaggagggtgtcccctgcaccttctgctttggataggatttgcacttttccctccagctgggccccgggtccccagagagcaccatgctctgcaggcacctgactcgtgcctccttcgccagggctgtgtctggggtggcctggggagggctgaagcctgctcttctgggctgggcacccctgccccaaggacggacccttccctgcaagcttcccaaggaagctctgtgaaaccctggaaggaccccgggcttgccttaagacaagcctggcttcaatcttcatgctgctgggagtcggctgtgtgatgttgggtaagactcttgccctgtctgggccttggaaccgagtgagccggcctgggtgagagcgcctggctcgcagtggggttgcggatgcgttgacgcccccttccccccgcccccgtgaagtgctgctggcgcgacgctgggtttctgagattgcagcctctgcctgctgcctttctgctgggatggggaacggctgtccctcccttcagagctagaaacaaggccagccaggatgttgggggcggcatttggggacgtgataatgcgggtgataaccattatggagtgcttcccaccctccaggaggcgtgcacacttcacctgtattcacacatactgaagcctcgccgcagcccggtttcaggaggtgccactgttcccttttcgtaaataaggaaataagttcagagaggttaagcaacttgtccaaggtcactcagctagtaaccccaggaccagcgtcgggcctgagtccagctcttgagtctgtgctccagcctctacttggtcttgcctttttgtttgcttcttttcttttgttttgagacagggtctcactctgttgcccaggctggcgtgcaatggtacaatgtgcactcactgcagcctccccctcctgagctcaagcaaacctcccaccccagtcttctgagtagctgggaccataggtgtgcgccaccatgccaagctaattttttgttgtt

SEQ ID NO: 84445 - DNA, 1047 bp, Homo sapiens
atccttctttgccaaggctccctgtgttgggagggagtcccattaggccctgtgtttagaccgcatgtttagacggggcgggggggcctgccggaattttcattccctcattcagaagctaaatggatcttttattaagatcagcagaatccatttttaactgaatttgaaggtcaccctgggcttgggtttctcccctgtgaatatgtgtccaggacacttggagaagcctgtactgcgtcagaggatgagcactggccagggagtctggagaccccggtatgggacctgctgcttatttggtgatctcaggccagccgcttaacttctgcgtttcctgtggggtcagacgaggggttggatgtgattgatttatcgatcagccatttattgagcacctcctgcatgccaggcacagagacaacaagacctggcccctcggagctcggagcctggcggggaagccagacacagggacgggcagttcagaacggtggacccagagccacttggggatccacgtgggaagggggattgtgggaccccagtgagccccctccgtccacttggagaggggcgggaagggagtcttcccaatgcctgggaaagggagagatgaggctcactagccacagagagaagagcaggcagttaattttaaaggactccagccctttctcttcctcggggaatttcttacatataactggttttttgcttacagcgtctttaactcaattcctgttccagcataacacccagggtgtcacttctagctttaaaatcccaaatcttttatctcagcctagggcctaaaacccaaataattcaggtcttccacttggttccagaagatgggtcctggggacagtgtttcctgcgtcgccggcagtcacaagagcgctggcctctctgcagactaaagtcaatccctctctatgctaggaagcttggcagctccctccgggatcaaggccctccctggtcctggcgtccccactctgtgtcaccttagagcaagcaacttcatctgcctgccccatctcc

SEQ ID NO: 84446 - DNA, 1028 bp, Homo sapiens
ttggggtttgccgtgtgtttactgagtccagtgtttctgttctctgctcactgtggccctggcctgcagaagctgcgcaggaattggctcctttaactctcacaacaaccccacgaggtaggcacaatgctcccattttacagatgaggaaactgaggcaccgaggattaaggaacttgcccaaagtgtcatagctggccagggcaacatcctccgtccttgttcgtgacctcgatgtgcacctcctggctgtcagtgcctggctcccgtgcccccgcccctgctctgatcatttggcatgcagaggaacctgccgcattctgttcttgaagtcttctgcatctcttgtggcccccagctggcgtgcatccccctggaccactgacccctcccaccctctcccccatcaccatcgctgccccacattagggagaaacccataagcaactcacagttccagaaacggcttctgcagcaccggcctcccgcggccagcccaagggtcacgcaaggccaggaggtgttccccggctgctcagcccacattctgcaaccctagatcgaggtgcatggccatggtcacgacacgtgatcccgaggctgggagggagagtctggcaggccgcctgacgttgcctgctgggcctgccctggtgatccaggcagctgaggctgagggggccgctgggagagggttaggggtccctaccctaatcctgcctttgacctggtccagaaagtgaccagttggtgacctaaagctgttggccaccagagactggtactgagctttcctacctccaggggtgctgtgatttagcaggggattttaacagctaattcaaatgagaggagacacagcagtaaatacatggggacacggttacagtctaaactattagcataatagtcccaactattagcataccaaaaagatggtcagactcggtgctggtgagctgcaaaaatatggctcattcatattgccgctggcagcatagttctgtgtcgtattcgtctttactgaa

SEQ ID NO: 84447 - DNA, 1069 bp, Homo sapiens
gagctgaccttacgggcgccggggcagctgttcgcgatgcacatctggcagcggcgcccgcgccccgcccccgcgctggccgggcgctaccttccaggaatgcgcgcatctggggagcgaggctgcagcagccggcgccccctccggcgccgggcctgggcctgggcctgggcctggggctgaggctgggcctggggctgcggctggggctggggctggggctggggctggtgccgcccctcccggatttcccggctcctccctccctggctgcctgtgtggctcccgggcaggctgtaagctgggccaccggaccggaaaagagggcggccgggctcgggtttctcctggtgggggctgggaccggctcttggggcccccatagtacggagggagaaactgaggcccggaggggtgaagggccgggtcctagggcaccttggctggcccccgtggtgcgagctgtggcacaacagatgctgacttctgtgtaaaagtcaaataaggatctgagtgtggtcaagtccacagagcttcattttcacatcccccaagttgcatggccctggctgggtctgggcctctggcccagtgggctaaaaactctgagacttggggtcccactgggggcataggaatgagcggaggcaagcacatcatgtgtgactcccgttgtggggagaacggcctgtgcataggcctgggtgtgggtaccttccgtgtgtctcatggtgtggagagagaacagtgtgtgcataggcctgggggtgggttgggccagcttgaaggctgtgaatgcctgctcttgggtcccaacagcctgtatttctttggactttgtggttgagtcatagggagccattgaaggttcctgagcaggagagtggcctgtggagtcctggccaaagttctctctccagcctgggtagagtgccccagagattatgagggaacaactcctgctgcctgtaatacctctaaggtgtgcctcccctgtacctacaaggccccctgggaccttgggacctctgcctggctccccccgaccatcccttccttagacctcaca

SEQ ID NO: 84448 - DNA, 1101 bp, Homo sapiens
cacacaccccacacgctgtctacacacacacacacacaccccatgctctctacacacacacacacacacacacacaccccacacgctgcacacacacacacacacacactctacacacccccccccccccgacgctgtctgcaggagatgtgattagcagctgtgcaggagcagccgtgatttatgtccccagtcgtctaattatccccggccctggaggaggagaaatgaggcgctttgcagggctgggagcctgaaatctcagcaggggttctgggcaccaggcccaccccactcccaccctcggaggccccagaaccctagtggactagagagggcctggggggcagccaaaggcactgtgcctggaagcaatgaaatgggcaccctctgggggagcctcccccctggatgtctgtggcccctactgagcaccagaggaagggggtgctcaggaaatcagcccctttgtcacggagtcctggctggtttgtcccccacaccatagcccaggggagcttggtagaggggctaggttgggttaccccctgctaatgttgccaaggcgcttcccagtgctcttagaatacaattttaagtggctcgggggtgggggtccctagaggggggcaccgccttcttctctgacccatctcgtcacctgccccaccccccagggctgctgctgctgctctttgctgtcccggaagctttccttgaccgcctctggtacacctctctctttcttctgtttccacccaggctctcatctgtggtttctctggtcacaagtgtcctggtcttgatttcgccacgggctggatgctctgaatgggagggtgtgtgtctccctgtccatgctctgtccccagcacctagaaaagacctagtgggtagggagtgctccacaattgtgtgttgtttggacacataattgtccattggacattggatggacaatggatgggaaacccaccgcagcactgggagatcctcagagctcagtggggtccctgagcagaggaaggtggcttggaggactgtacaggctccagaaggcagtggctgcatgcagggaccgggcctgagccagagaggagg

SEQ ID NO: 84449 - DNA, 1075 bp, Homo sapiens
cagcagcgttggggctccccggccagctggccctgggcaggtcattcacagcccctgcctctcatctttcacttcattgctgcccctggggctgctgtgagcactcagggagggaacgcggggagggaggggctgggcacatgggggacatgccagggggctggtctttgagtgcagtggggacacctgagccccgttctgaacagtggcacaggccctgcatccaagcatgcacctgaaggccctttctgcaaggaggcctgggctctgccagatggtggcttccatcttgtcacttctggctgtaggaattcctcggggacaaattgcccagtgctgttgggctcaggacagctaggggtgaccctggctttaaaagagcttacttaaggcctgcctggtgcccccagctctgtccacctgcctgtggggctgagagtgggtggggtgcgtagagctgcaggtacaaatggagaaggatgggcaggaccctgctgctcatcttgtggggaccccgctgggcaggtgggcttgggacccccagatccctgtacccctcagagagtcttcacagctgcctactccgcctcggcctccctctgcctccctttacctttccccttctctgaccgtttgtcttcccgcctctgcccggtttggattctgggtccttctgtgtcctgtgctgccatcctcagtagctctgtctttctctctccttttgtctatctctccccttttttccctcttctttctgtttcctctgtctcttttctcttcccgcatctctctctccctttttctctcacgctccctcctttttccctccgtctttctctctccctccctttctctgcctcttcctccctctttgcctctctctctctctctctctgagcagctgttacctaataggctgttaatgatgatacagtaagtggaaggcagagtcctgggggagccgccatgatctgtgtaattggtctcgaaggagacagaagtatctaatatttacacaccagtattagtcctttgggaaccttatcttggctagaaccaagcagggaggggggtg

SEQ ID NO: 84450 - DNA, 1050 bp, Homo sapiens
agtgaccgcccagcggggtcaccatgcactcctccaggagggacacgcttgtcatgttggcgcttgtcaggcccgcgaagggagctgtggcggtttagcctctgccccttgtggtccccgtgccccagcctgacctcgccctctccccgttgttctgcccattgttctgccaacctccccccgccagctgccctgccgcgtggttgctatggcaatcgctcagctgtcaggggcccactgctcccccttcttctctgggggctgagcttctgggaggcttcttctgggaggcccccaggagctgccaggctggggagaagttccccagaggcccctcttggtcctggagagaggagggggccttgacctctgcccgggcaggataggggctcagtgcaagggaggaggagggttctgcaggggccaccgcgtctgtggaagggagaagtaacatcatgtcaccaggggcgggggctcgtgcccctggtctccaaggaaccccggttgcctcccggctgcccatccgcacggccccactatgtgcagcccccgtcctgccctgtgctccaccctggcccaccctgtgctccaccctggcccaccctgtgctccaccctggcccaccctgtgctcgccccttccctccgtgctccacccctcctgccatgggctccaggcacctgaagacttgttttttgtgtaaagaggccaaggatccacaaacagccagacaggggatctcagaataaagaccgaagtcacagctgtcctgcggggtgtgggctggaggccctcacggccggcttgttttgccccagggcagccagggcacagagagggtgggcagctgcacagagctgcccagggctagtgggaggagctgcttgtcctgctgctggggttttgtcccctgtggaagcatcagtgccagatgggggccacacaggtggcagaggagaggggaattgagagcagtaacagtcccgagggcagggctgtgcccctgcccgtgtgcccaccacctgctctctgcttccctgttgctcctgc

SEQ ID NO: 84451 - DNA, 1007 bp, Homo sapiens
tttgtcccctggtcaaactcctcatctcgggcataacctccttcaggaagccttccctgattgcctccaaatcagctgactccagaggctgatgcctaccctgctattgctgggagcaggcactgaaagaccatgtgtttggggcaggttctggttttcatgagggaggaatgttttgatcaggccattggggggctctctgctgtgctcaggacctggggtgcccgaacatcccatgcatcgccggggtccaggcttgtgtgacgtagatgattgaattttcctgatgagcagcccagggccagggcaggtgaggtcccaggtccacggtcacagggctgggtgagcctgggtctctgcagtctctggccttgacattttctgggtccgctgtgcctggttctgcccgagaatgtttgctgtagtccctgtaagagtggctgggtggcctgcgggtccttggacagacaaagtggaatgatggatttcaggccgcggcgctgggctctggagtgaggaagggaatcgctcatgctgtcatgggaaggccgttccaaggagcccgaggctccccagggaggtgggggagcgccccaccccacccatctgacaggggcctccctccccaggaagggcaaacttgtccctgtttctgggcaccttgggggccgtagtgcccccttccagctccgggcgagactgctgggcatgcgtcctctctctctaggaaaactctagcaatgagcgagcttgattgctcagttagagaaactgaggcccgaggagtgaattccctccctgcttctgttgagccaaattggagattgccaatggcaagcattccagaagcatcccgaggcctccctctaactggacagggatggcaccgtctgccaggcagggagcagggctggcaccgagggtctccggcacaaggacctgtttcttcccaactttgaggtagcttctgttgtgcccacttcacagagggcaaggctgaggctgat

SEQ ID NO: 84452 - DNA, 1179 bp, Homo sapiens
ccctcccagcaattaaatgcatgcccgtggctgtggcatgcgtgaggacagctgcctgccagccttcagaggccagttgttcagctttcaagatgcccccggcccaggagaaggcccggcgggtcgggaggccgggagaattgagaatctgcccggcgggtcgtgctttagctgtcgctgtagggcgactcttggcgtgtaatcacagcatgtggcgcgaggacaaagaacatgacagcagagaaggatcagacagggagaaggcgggagagggcagagcaggccgagggaaagagagagaggtctcccggcgggggccgggcgcgagagcctctgcttccatctgctcggcgaggactctgggaggtgccaggtgagacctgcctccctgccctgcgctcagcctctgtcccagaaacctgagctccaagcggcacaaactccccaggcccccaggactctgttattacagcacaaagccctggattttcatgtccaccaattaagggatttgctgggttgacgattctcgggaactcggtgcagatgctgtattcgagccagcgagggggtggtgagaacctgctaactggatattaaacgcccgctgctgggagagtcgtggtccacagtaggatgtgatcgttcaggctggagggatcgtggggaaaatggtggctcatggaatactaaggggaaggctgtcaggtgcgggcggggctggcacacacagctcaccttcagctgaggaagctgcctgctccgctgccgtcctggcagtcagtgacaggtattgctgagatgtcagctcaagggtgtctgggttcttttttggtattagagtaggtctgtaatcacagaccagaatttgaacttaaaaattaataaacctagaggggacaatggaaatagaaaatcgccgcttacaaatagcactgtggtcatcgtttcaggcaaaaccatcaacggatgctgacatcagcgagcaaaagtgtgatgaagaacggcgatttgcatcgtttcaaagtatctctccatgagatacttactaatttcaaaggggacaatggccaggtgaagcctggcagatgtcacttacactgagtgatccatgttgccatctccagggtgacacggtgtgcctgtgacatgaagcgccaaggggaacccaatgtcatt

SEQ ID NO: 84453 - DNA, 1059 bp, Homo sapiens
tcacctggggagaggagacacagcccaggaagggatcgaggaaataaaagagagagagagaggactcgaatgcacactctaatcttcgcttggcggttcagctttcaggagccccaattaatcattattaatttaatccggggtgactcggagtcatcctgacagagatcagccacgatttatcccacctgctaaggggcgaccttagcagaattcaatgaattcgtcattgtgttaagcaaggaccctaatgaatctcttgtcggcccagtttactgaatgaccattagccacaaatgagtcacagcacaccgcccccccccgcccccacacacacaccgatagtactgctatcaaggctcttcttgacagtaggagggggctgggctcgggaggacagcaggcgtgagaggttgtgctttcctgcgctgatactgacagctctgaaatgcacgcatgcctcagcatcaccagggctgctggtttaaaatgtggattgcaggacctcatccccagagcctctgaatcaaaagagctgattgggcccaggaatctgcattttcacaagcacccctggtaattctggtgtagggggcccaggcatctgaacctgagaacgtgatgagctccaggaggtcaattcttggccttggccttgtcgaggtgcggtgtgctgggcagggtgggtgaggtcagcggctgtcacaagtaaccctgcgtcttcagtggcgtgatgcagccgaagcgcattctccttcaatcgggtccaacggggtgctcagtgggtcttccacaaggtgactcggggtccggtttcccggagcctcggcctccccactgctagtgatgagcagaggatggcacagaggtgacgtcacctcgacctacattgcgctgactggagccagtcctgtggcccccgcctgcagcgagggggtgaaaatgttgcttagccatgtgtccagagcgaggaaacgggtttagtgaccatccctctggccgttgttgcccagcccggaggcctagtggggtgcccggcattgaggacaggtggccaag

SEQ ID NO: 84454 - DNA, 1089 bp, Homo sapiens
gacctggcaagccaggagcccctgccctgcggccgggtgggggcaggtggggcagggccggggcacgaacctgcgtctgccagctgctccctgtcaggctgcagccaagtccgggcagctcctcagccagagacccaccaggagcatgtcccgcagtcaggccccgcctgggcagccactgctgctcagaaacgtgacagtgactaatggtttattacacacctgccacctctcatccggcaggcgggcgggcgctgtctcccgggcccagctgtgcactgccagctgggcggcggggcgggtgcagggggagggggcacgtccagacatgcagacgcacgagacagacacagacacagtacatacacgcaaacacacagacgaaagcaggcactcggagacacagctcacagacatggcataggcacgggtgcacgcgtaagtcagacacacacacacatacgcagacacatgggcagacccagcacacacacagatacacacacagaaacccgtgacacacacacacacacctgcatagatttttcccaagcacacgatatgcacgtggatacacagacttacaagcacagggccacgtgcagacagacacagaccctgtctgcaccacaaacataccacacacagccacacacacagaagccaaacatcctcgcataggtggatacaagcacagactcacatacacatatgcgatacacatatggatacatacacagagtacccccacaaacacacagacacacacgggcagagacagacagagacaggcacagaccccccccacacaaacacacagacacacacaggggcagagacacacatagacaggcacagaccccccacacacaaacacacagacgcacacggggcagagacacacatagacaggcacagaccccccacacacaaacatacagacgcacacaagggcagagacacacagagacaggcacagacccccccacacacaaacacacacacacacacacaggggcagagacacacagagacaggcacagacccccccacacacaaacacacagacacacacacacaggacacaca

SEQ ID NO: 84455 - DNA, 2286 bp, Homo sapiens
aggaagcaggtacaggaggagcctgtgccgacctgggccctgggcagagtcccccagggaaacacgtggccgtcagctgccttggtctcccccagaggcgggggttgtgtgtgttgtggaaggcggtgatgagtttggtaacactgggttccctgccgtcccagactcccggggcagcccacagagcttatcagacttgcgtcactacggtcggatagggccactgccgtgtccagagtggggccactcccgggcaaaggctcctggtggctggccaggctctcaccatgtgggcagctttggttcccaggtgttgcatttgaagtggccgtctgggaggtggccacttgctggctgccgggagtacagctccagggctggggactctgccctcctgtgaaggccatgaggaaccctggggctgggattcctctggcaggcaaggcccaaacggactgaccaggcatcttcagctgccgggagaagggtgcaaccgaaaccttgtgatggatgtccttccctcgtggggcgggtgagcagttgagctcatctctttccaatactcttcggcctttagtcaaatgaagacccatttctcatgtgccatcgcatgcagtataaaatctattgagaggacactcctaatttatcaccagtggatgggaacaggcttccctagaacaattatctttgtgttgtctgcagccaccttgggagagaagcagcactggttggtgataggagggaggggcttggactcaggtccaagtttccaagtcctagcattactacttcccggccatggagccttctcaaggttcaggaccttccctgggctcagctgctctgactactgaataggcatggtaaaaataaaatccttctggtagcgtggtgtcagtgacattggatgaacattgagaaggcactgagggctgccatgcaaggctgtgcaggttgcacactgcacaactcccggaggcaccattcttattgtggtctctgtgaatgtgctttctgcatggccattggggctgccgtgtggcacatcagtggtggccctggagtagtgccacgtgggccctgggtatccttcctgagctgtgaaaccgtttctgaagtggttattgatatcttttttttttttttttttttttgagatgaggtctcactctgtcgcccaagctggagtgcagtgacatgatcttggctcactgcaaactctgcctcccaggctcaagcaattctcccacctcagcctcccgagtagctgggattacaggcgtactccaccatgcccagctaatttttttgtattttaatagacatggggtttcaccatgttgcccagggtggtttcaaactcctgaactcaggaaatccacctgccttggcctcccaaagtgttgggattagaggcgtgagccaccgcacccgctggatatcattattaatacagatagcagatgccacagaccctaccgctgagtttggggtggggttgcagaaaaccaggccaagattgactctctgcttatggccatgttccaggggctcctccctttctcacctgccatactggggtgttgccttgcttgacaggggtgctggggctgattgcccctttggggcagtctatgggttccttctgccccagtagctgtctgctttgcctccacccagagatcccttgttctcagcagtgcttgctccaggctttggggaaccactgggccaggccttacctccaaccctggccgaccaggactggacttgcgttccctatacatgggtgtcagagcctgtggtgtctccacctcctcctggctcttcccatggggtttctctctctgttcccagggcagggctgatcccagcatccacacacagcagaggaaggagggagcgagggtaatcaagagaatgaaagcactgagctgttttcccaccagagggtgcagttgcaaaagcctgattttcccatgctgtgcctcagtttacccgtgggtactgtcaccaccagttgccctctgttggccacctgaggaaaggaaagccagcctctccctgtggtctgggacagtgggtggggcgggggagaagaggagggggctggcagggtgggtgggagctgctgcagaagacacagcatgccctccgtctctactctgggctgatccagaaggtcccttccctctgcctgctcttgtgacttctgccttgccgatcaccatggcaggggcttacttaagaagaggtctgtgtttgtttcccatggctgctgtg

SEQ ID NO: 84456 - DNA, 1094 bp, Homo sapiens
ggaattcccacagggaaccagaccccacactccaacttggcctcccttctgctatgtggatttctccttgggcctgagcaactgcccccaaccctcacggtcctcacccccgccaaagaaggtacagactccaggcttctctcttttcatccccagcccaaacaagctctgcacccgctgttctgcctcccctggcaagcagaacatggtgagatggccgcagagaggcccaggaaccagaccccacaggcacatctgagcctgagtttctctctccgggaaatggggatgatcgaggagctcgacctcggttagtcctggggaggtgcctgggtgcctggcacagtgcccctgcccgttaggattactgcaactgttggaaccctgcccttctgctcccggcccattagggctgggctggggtgagttcggtggctgcgcgggctggtctggccacctcctggctccttgatggcagatttgggcacagaaagagcctgtggccgggtggtgtgggcagagtgggctgggggctctgccctccctgcctgcctgccgggcgtgtggtcctggctggagacacaggaacacagccctggctctgttctcgaagtcgtgggaggcgggctgtcaccacagtggctgggagctggaggccagcccagagggagagaggacgccatgtctgtgccctcacccttcagcacaggccctgccaagccacaggtgcctctgctgcacagggagtgagagggggctttgctgggcagagagcagggggctggggctgggagatggaggtgggggctgtgaaggggaggacaggacagcaaggattgctgggaaaagaggctgtgtccgtggtgccataggcctctctgcacacccctccgcacaccgcacaccgcacacccggccccgcgttacccgacggcccctcctgttgtgcaggttgcacgctgtgcagtcgcgggtggccgtttggccagagttgcccagtgtgagtgacccaggcctgcctcccaccttcaccgaccacgtgttgatttttggttctggaattctgatcaccttattttttattgtaagcctgg

SEQ ID NO: 84457 - DNA, 1649 bp, Homo sapiens
aatggaatcgtaccgtttgtagccttttgtgtctggcttctttcactcagcgtggtgtcttccaggttcatccacgttgcggcccgaatccgaacttcatccctttttatggccgaataatatttcattgtgtggatagaccccatgttatgtatttgtccttctgttggtgacacttgggctgtccccaggtttgggctatggtgaagaatgctgctgggaacatgagtgtgcaaattggtccttgaacacctgttttcccttcttctgggtatagatctccacagaggggatctgataggccacggtatccttttcattttgtttaacaagcacatacgtagctcttgttgggtgccaatttaatattcataacctcactaagagggaggtactgttacctccgttttacagatgagcaaactgaggctatgtgggtttaacaggcaggatttgaaccaggcagccagatgctgctggctttcactagtcagtgtagtaatttggcatcaaggccaccaggtctgagcggcccttgggaactgcttctcagggttgcaggcccaggaggcctcccttgtgcaaatcactcctcaggatgctgttgggtgaccctgaggccggtgcatctgttcacagaaatgtcactgcaaagcaagctagaggggcagcctctccctgtcagggtcccctgcctgacacccgcctgggggcatctcaccgggctggggccaggcttccaggcctgctcacagagtgcctgaggaagtctggtcccaggcccaggaataaataacaggcgtgcaggctgtcagccaagctggctctcaggtctcctggagctccacagagccccggctttctgttgatctgatctcctgtggtctcttggctcctccgctgtgatcaatcttgcggccctgggctggccgggcagtcacccccacgcaatgtggttatctcctggccacacatcgctgctggggcccggggctcgctcaggcggccctcgatggctcatctcccctgcctgatctcccgtcctggtcattctccagcccgcccttatctcagtgtctgggctcttcctttacttgcaaaccgtgactgtggtgggggcagggacggccgccttgtagtcaccagaccctctgagacaggatttgcttcccacacaaggctaatcaggtccataggccctggacgagggctcctctgtttcagaggccacatggtgacccgctgcccctgcaatgtgcagaattgggtaaaatcgctcccagtcacacagctgggagggaccctgggaagatgcacgtggtctgcccctcactttcccgatgagacagcagagcccttgaaagcagggggtacctgcctgtgcccgggctcggagcccacacccggagatgctgggtaagatgggagggacagaatggggagcagggaagcagatccagagccaaagcactgccaaataacagcagaagccccaggccatcaagagcatggcacctcacacatgcacacacacacacagccatgtgcacactcaagcatgtgcacacacatgtatgcacacccatgcatgcacacacacaacacatgcacacacactcatacacacatgcacaaacacactcatgcac

SEQ ID NO: 84458 - DNA, 1137 bp, Homo sapiens
caagcggagtttgtggctgaggtggaaccctggtggaggaggggtgtccgcagcctctgcacccagcaagtcccgtggcacccccagggccagcctggctgctgacagatggtcatgagacccggggagtctgatgaagttcatttttcacctgcacgtgttttcgcctccccgctctcgcgaggcagccggccatccatcctggagcccttccgaggcctcggcggtaatggggtcatagatcactccctggtggagacagagctggacagggggaggggagccattaagaatgaccgcgggtgacccccgggccaggacggctccagctccagctccagcttgagacggggcgtgcacagccctgaacctgggtgtgggctagataggggtatggggtgctttcaggcctggctcaagccccattggggaggggtgggcagggagcgaacccccattccccgagggtacacccagggagggcatcactctgcggggctgtctgggcctcccgtggccatgggatagcggcgcttctggtcaaggcctctctgtgacaggtcagggttgaggggtcactggctcagagactaccaccccctcccaccctgtttaaatatggtggttcaggtggaaccctcccacgccctgccccctgtttgggctcagcattgtggccagcagagctgaacaaggccctgacgccgtggcaggtgcctggcccaatgcatcctgcctgcgtgcctgacaccaggatggacggctgactctaggtggggagttggatgctgcctgggtcaaacctggtcatgccatcttactgtgcaaatgagtaagtctcttgccccatcttacctcagtttcccccataggcaaaatgacaataataaagatatgacgtaacgcacgggggtttgagatgatagggtgagctgtcgccatgacgggctatgtctggcagcttgggcacctactgcctcagaagcggtgtctgtggttattgtcatccttctcatcatcactgtcatagtggtggctcagagcatggcttctggtcccagctgtgtcggctgtgtggcctggaggagatgctaaaccctctctgggcctccctcagttttgtgacccgagtgttca

SEQ ID NO: 84459 - DNA, 1099 bp, Homo sapiens
aagctgaggccacaggggacttgtgtgtgcctaagtccttggtaccccaccagccccatgtagtcaccccagaaggcaggtggggtctggggctcccggatctcaccagtgtggttggcgtgggtctgcatttccagggccagaaccctgctgggcagcttccagaagcttctttaagctgtctgcatcatcgtaccccccaacctctacagccttccagaaacgttaggagtcaggggtcactgagtggccttgcccagccctgggttaatggggtagctccttgaacttcctgttctctcctccaaaagttcacccctaaactcctctcctctccttcccttgctcttagcaaagcagcccgtgaaggtatcagagcgcaggagtcctgcaagccagcttttcttattccagttctgcaggtagggaatttgcccagagagctcaagacactgtctccggccactgtggatcctggcccagcccatcctagccctgagtccagccccagcatcccggcgtctctgctcagtcagccacactccagtgcgattctgccaatctgccctctccctggttgatctttcattttacttggggtaactcttagcctagaatgcaggaggtggaatttgtttttcccaggaacagggggcctcccttcctctgtgggggctaacagtgaaactcggcccagagtgtgaaggcggggacctcggtagccccagtggggttaggatttgacctcccagagagtcccgggaggcagctctagccccaggcccggccaactgggcaaggcccaaaccccgaagggcccgtgggcgcctgtctcctgcccgaggggcgggccagctgcctggcagagtccccgctggccaggtgcctggttccgggctgggaccccacgcgcgctgccaggctgccgggctggtggtgggagcccgcaggccagagtgtgggctgggctcggttcccccatcccacgcagtgggcggcccgggactgtgggggcgggctggaggcaaccttgagctcatcagtgggagacatctgcttaaaaaatgtggggatggggaggggaggttaccgtcgaggt

SEQ ID NO: 84460 - DNA, 1029 bp, Homo sapiens
acatgcatgcacacaggcatacgcagagacactcaggtacacagacacacattattacatatgtgcacatgcatgcatatgcaaatatgcacagtacacagactgcacagagctccacagacatacacttgcaccttcgggtttaagccctgagcaaattgacatcccgtgtcttgttctccacagtgtctccagtgccaagcatggggctgggtgtggtaaatgtttgtcgagtcagtgaatgcatggatggctcgaaccgtgtcttgactcagcaacaccgggaccagtggggtctggaggtgaggatcaggagacagtcagccctctgctttgctggagactggggaacacctttaggacattcagagaaggacagctgcaggcacaacttgctctagcaaatcacaagcctggattgaggcctcaggattccttgtaccgtgttcctttccactgcccagagatagccagctgctggactaagcacttgccatctgggggaggcgcttccttgggttccagaagtttcacgtgcatctgagatgaacctgctgcagcaggagacggacagctggccagtcctaaacatcgtctttctcacacccaccccagaatgaggactcggctgctgatcttcagccgacactgggaggacctggggttaactttgccaagggccacaccagattccctggctggggtcagtggtcactggtcagctggatgctaacctgactgggtctcattccctgcagcttttacttttttcaggttgggtaagttctggtgctgaggccccaggaaccatcacgggggcacagcgcggcctggaatatgcccgtggaggtggggccttgctgggagcttttcctgcagctttggaaactgtgggctgcagtgaagccaggcaggccacatctgtgccctgggaggccaactggctcagccccggcctggcttcccgaggacgcggtcccaccggagtcctcacccatcatgcggggcctcgtggcaattcgagccctg

SEQ ID NO: 84461 - DNA, 1012 bp, Homo sapiens
ggggtcaccacacgggtgtctcacggagggtcagctgccaaaatgacctggtggagaggcagcccccaggagggaagggtgtgggcaggtgcagtccttcctgccctaactccccagcctccacctgccctcagctgccgctcctcctcctcctcctcacaaatcatgaccacctagtgaaggacctcggccttgagagaactctggggcctcttgctctgagccaggtcagagcctccacaaaattacagctgtgagacacggcgaggggagcggggcctctggccctgctggtaattacggcccacggagctctgattgccgcagtccaattaattaaacaccgcagcgacccaaattatgatctcttgccttgtaccaagcagtatttttaaccttaactgtcggggctgaacttaaatttcctatctggacagaagtgtcacccgagggagaaaaaggcagtgtcgaagcaaacctcgccgatgacagaccctgtaattagaaactgtagtgtccccgagactggtctttaaaactgtcagaagccaagcggccgtcatttgatacaagactatcatcacccgtgaacccattagctgcaggtaaataacatattatgccagggacggaaagcagccaggctggggaattcgccggcgcttaattaggaccggcagtgcggaagatagatggtcatcctttttgctcccttcattaggagggagggtcaggtgtggcggtggtcaccggagcccgggctgccgaccctgcagaaaagcgccatcctccgcccgccctctgcctcccacggtgctgcccgcacctctcttccaggcctgtgtttactgctgatccctaccagctggtagtgttctgcaggagtccatgtgtgaagagaggttgcgtggaacaggtaccccgctcagcagagggaatcttggtgaagtgggctgaggagggtgggtgtggaccgtccctgagggccacccccaaagcccacgatgtaaga

SEQ ID NO: 84462 - DNA, 1020 bp, Homo sapiens
cgaggaggccaaggccaaggccctcccagccagctccagagtacgaaggggtcatcgtccttggtcacccacctggagggtccgagctccgtttggccagcgacccctggccctcgctgtcatcagcttgcctggtgctttgcgggtgcctgatgactgtggagtgacgttgaatggaaaggccaggaggctccatctgaggatgtatgctggccctgaaggccagcgtggggaacaagagccgaatggccatgccgggtgggagacgtgtgtgctgttcacggcacacctcggctgcctgccttctccctgactgtgtgccatgagccacattcgtgagggtaaatgtgtgtgtgtgagtcccttcctcgcctctgtcagagactgcaggaaccttggaggtgtttggaagggataggagacccccccagcccccacgtcctgatcccttcgtcccctgcagacggttcctctgacagaagctgacaagagccatttccaagatggattgattcaatttagcacaaatttttgccggatttggtgacgtatggctccctgttggaaccgcattgaatgtgactccaaagagagaggctttattaggccaagccgcgctgagcaggtggggccccgggggccaagcacccccatgccgccaccatcagatgtacccgccctggagccctcagggctccctgcctgcccctcggctctcccatcattagggggccgctcagctgctcagaaagaaagtgctttgtgagccggcttttcattatactctgggggctgaatttccattttattcccagaagcaaagttttgctgccacgaggaccccactgtgtgaggcccagcacgaaagactccttccctctgggctgataaattcttaatggggctgtactccagcatcccctgggctcacccaccgcttccccgcagcccaggaccagggcccgagcgtgcgtgtgtgtgtgtctgtgtgtgtgtgtgtcagtgtgtgtgtgtcggtgt

SEQ ID NO: 84463 - DNA, 1129 bp, Homo sapiens
tggggccggaaagtctcagccggggttgaggagcctttgggagcccaacgagccggtttgtctgggttcttcgtgaagatctcagggatcaacatgctcatgctgacaccctgacctccgggctgcacctccgtcttgactagtgctgggaggccttggactcctgaccaccgattgccatccgctgatacttgatgtggtcccggggcagggtcagagatcagaggcactggcgccaggcgtgggagctggttttctgtttagatttagagacataaacccaaagagtgaccctgtgcctgtacttaaacctcacctcgcgctcacctttgtagaggaggaactggagctcagagcaaacttgtgaagcagccaggatggggtccaaagctcctgtctcccatccactgccgtcctcccagcccagcctccttgggcacactcactctcctcctgcctgcagcagaatcctgtccagggcccagcctgcgggcatcaataggccagggtttcaggcccagctttacctgcagcagttcagctctgggcacgtttgggtcctctgtggacctcggtatcttcttctttacagtggtgtccctgaagtccccttcctgctcaggcatccttcccttgcagtcagtaacatgtgtttgcagcctccctgtccctctgcatctgagtagcggctaaggggtttccatctcccgcctggaggagcaggagtgtgttgctctgtggagggcaggggcctggttgtgcactggagccgccctgagaggggccagcctctttctgtctgagtgttctcaccccataaaatccggagcgcgctggcgctcagcccagggggtcgtggagggttcccacacgactcttgtaagatcctctgctaatgaggtcccggcagtgccaagtgttcccgtgacagagcgtgccagcgtgaagctgggccccgctcacagaagccaggggcatcttctagctggcaaaggtggcaggggaaccagcctcccatgggaacctctccagagcctcctagaaactccaggagaccccatgggaagacggtctttggaagccaggcaggcatatctgggcggatggctgctctaaggatttaatgaga

SEQ ID NO: 84464 - DNA, 1144 bp, Homo sapiens
gaccagcctgggcaacatggtaagaacccctctctacaaaaaatgcagaaacaattagtcgatcgtggtggtgcctgcctgtagacccagctactcaggaggctgaggtgagaggatcacctgggcccaggaggtcgaggctgcagtgagctgtgattccacgactgtactgcaacctgggtgacagtgagaccttgtctcaaaaaaaaaaaaaaattattcatgaggaagaggcagtggctgcttcgtctactattcccattccacgccagacacggtgcttcctcagaacagctctggaggtgaggctactcttaccccccttgacagccagggaaactgaggtacagagagattgaggtcacatgtgcgctaaatggtggagcagggcgccgatcctgggcagtctggctccagagtccctgcttcataaatatttgttgactgtgttgagtgggagctggccgctggcgttggcagcggcgccctccgagccccttatctggttcctgtcgtttctggagggaggactgactcctcagccatcagctgaccccaccccagccccacactgaactctgggtgaccctggccttccctcaggatcactgtccactgctagaaaggctgccctcggccctccagggaggaaactgaggcccagagagagctggggcttggcccatagccatgaagcctgctggtggttgctctaggactcggggtccccctggaacatttccccggccccagctgcccccggaggccagagcaagtcataaatatctcatccggcctgtcctaggcccctttcttgaccatcctgggaggggcttgcaggaggctgaggcttcccctgctgagagctggggtacccagagtgaagctcggcctgtgggggccgctgggttctatttcccacccatctaaactgcttccagaaagtcaaggtgtgaggcaggggctcaggcccacctgggttgggggtggtgtctggaggtgaggtcaggctggaacccaactcccagggtgcttggagccgaggcggggacggggcacccgcagggaccaaggtcttgcatagcctcaggcttgtcatgggacgttagcaaaccatagctgtggcgccggagccacccaagac

SEQ ID NO: 84465 - DNA, 1004 bp, Homo sapiens
gccttttagggagctactaatgagctatgtctgatttttatgaaactccatggtaaattattaatttgggccagaaatgaaagtgtggaactggataggctcatgaatattcatcgttgacttcagtacagggttggttgatcagtggctagagcaggcagccagcctcgtgacccagatacgggcttattacccagggcggaggctcttgggaaacccttccccattcactcccttagtttcttggtccagaggtggggctggtaactcacagctcattagcaaagttgaagctcgaccagggctgggctggggccagctcaagatgggagcagaaatcagagggttcttgaccccctggatcaccctgggttcacagcggtctgttctcactttggagctgctgtggatgagggtgacgtctgtgcagaaggagccggaagctcccacttctctgcctctactcccctcttagagcctcctgggaaggatggagacccctagaaatgagtccctttaacagataatctttggttctggagtatgatcatggttagtgtcattgaggtcactttctgggtggcatgcaacggagcctcctcccaaattcaagccttcttgaaatagtaagtttgcattttttccaagatggttctgctgggatccttttctccccgacagggccaaccctgcctaacactctagcctgcccttctctacctgtcctccacacctttggccaggctgttcctgctgcctagagcgctgagcccaggtgtctgggaacggtcagtgctcactcctgttaggagtggccgctccctgctctgtgctcttgggtagatagtaagcaaccgtgacctaccactgtagctctttatttagtagctgagcccctgggcctgggggccaagtggtcggatgtgaattcttgctccgccttgagtccttgtgtatgagactgtgggcaagttactgaaactctctgggcctcagtttacttg

SEQ ID NO: 84466 - DNA, 1064 bp, Homo sapiens
ctgtgtgccctgtggggaccggcttccctctcgtctcccctctcgtctcccctcttttctgatctcctccttgggctttcacattttatttttattttttcacttgggcactgcaaaaacacacggctaattgcgatttctttttcatgacgggcgggaggggcatatggatgtgttcattttatagggtttttttcctcccccttaataataatgctttaaagatgtttgacatctgtaactaacagctggcatcctgttatggaagaatgtccttttatttcaaagcaggttgaactgtcattaatagtataattaggtgattatcactatatagcagaaaactgcttaattgtagagatcgcttttctaggattccagtctttttatggttatatttgttttagctgttgaattttcattatattttggcatttggtatgctgcctcgtttctgttttttttttttttttccccttcctgttttttaatgtgtctgacagctgtctttgggagcatttggttttgaaggtgctcctggtgttagagcagtgacgggggagtattacctggaagaggtttcttatcctgggccctgcttaacacattctgtgccaggccagaggcccacaggagcaaggccaggaataccggtgccctttgatttatctgatctctctctgggtaatagtatggaattagacatttaaccctggagctaaggttgtctgttaagaggccagcttttacaatgcaatttatttttatggtgcgtccttaatacacaatattaccaaatgcttcggagtctcttggattccagagggaaaggcacatttaaagggacatggtctccgatgtaactggaatttgaaaataaatgggttttccagactctacgaggaaatagtttatctcttaacgaaggactttgaaatgagcatagaggtgggcttgcttttgaaaagcgaagggaagccaaacgctgccccttccacacttttggagcctagacgtccttattggtctctgctagaggcctggggtagatgctggagctcgga

SEQ ID NO: 84467 - DNA, 1370 bp, Homo sapiens
gggagaagtggggtgaccttggtggtgtcagcttggagcttctgggcttgggggaacccgagtggtttaggagcaacgctggtcggggtggaggggaccctcccctctgggtggggcttggggtatcagagggctctacccttggggcggggcttctgcctggagggtagaatggggtttttccaaaaactaacccacccacttcttttgaaattctggctggggccagcttgggtcggtggcagacacagcaggtctttgtatccttggaatccttctgaagccaacttggggagggcgctttgtattgtaaatttccgcagagtaattatgtcttaatgtatgataatccggcctggccctggcgctgggcagcctgtgtctgcagcggttgctgccggggactcacaggccgggcaggcaggtcagagggacgcgtcctggagatccagggccagcagggtcgatcctgaggggcctgggggattccccagacctacgcctgggagacccatgaagggcttgtgtttttggtgcggcctcccgtctctcttcctagtcagagtcctccaaggagccccatctcagatcccagtcccgggttcctgctgaaagttccttttcggtctgggccaggaagagagtcatggaactaccaagtcttaggttagaactagccctgaaagatcgtctaggcttggcttgaaatagctccatggatggggagctcaccccagtcaatcagcaagcagttattgagcatctactggctgctaggcactacacactagtcactaaggccctgaggaaccagggctaaactgaaaagacaaaaatcctggagcggctggaactgacttagtagttagagaggcagacagtagacaagggaaataaagtggaatgcatgttagggctgcagagaagggatacagctgggaggagggtgagagaagggtggagttttgatgggacaaccagagagggcctcttctctctttctgggggaagggcaggccatgtgaagagaacagcagtgcagaggccccatggctggaacgtggctcctggactatgttgcttggaatgttcactctgtggatgtttgctgagctcctgcaggggaagaggacattctgggctgtcccgatgatgttccagtctcacagtggaaaagcgtgtagggagagggagaaggggtgagtgcagagagggagagagcaagggagggcccttcctggagaagcgggaggccttgggcagcagccggccagccctgaaggctggccagcatccgaaccccgccaaggagggaggctgcgtgctctctgcctccccactgaactgggctccttcctgccattgagcct

SEQ ID NO: 84468 - DNA, 1798 bp, Homo sapiens
ccatcccttcgccttcgggtggaactccactgcagaagctggctgcggttcatgggggatggggaagcccccacgtgctgggttcctgggaatgctaagtgcaggagaggaaatggtgttcttggggcctttttggggactggccagagcccggtcacttgggaaagggtgaagcttccttggacccgacatcccctgggaggaccctccttggcgaggggaggagccctgcctggcttgcttcctgggtggctcctccctctggtggtcctcagtcagcactggtggcatccccagagctgacacccagttcccccttacgcagccgcctggggtgcctggagctcagtcctccccgtgttgataaattgagcttctcttctccacggttcagggcgtcggggtggggacggggccatcctgcacaaccccccctcgcctcttaatgccttttcacccctgagagcctgtctgcacagcctgcggttggtcggccgccttgtcatttagctgttccgagccagtgatcgggaggcagcacaaactgtggcatttgctgagcgtaaaaattcaattaattccagaaggcagattaaatataagtgagttttaataatttgctgtaaagtcggaggattactgtgggcacggggagggaagccacacatgcgtgcttgagcaggctggcacagtctcggggatgccagccagggtggcttcctggagccactcattcctccccgcagggtacacccccagctctccagaggacaccctcctgcgagggtggtgtcctgggggtctcccgctggaattctgggggacggtaggaaacgctggcccagtctttgattccaaccctgttcccccgattacaagggtaataggcaggacatacagcgattctcagttgggggttccttctaggatccccagggagtgagctgtctgcccaggcagacctggccatgtgtgccctgtgccctgcagctctgccagcagcccctggtcctgttccctcaaactcacctttctctgcctgcttccagggtcctccatagctgacggcttccaggtctgggccccagggtggttttgttgtcataactttttggaaagtaaagcagtatcaagaatgggctgcagactcctcagattccaaggctctcggcctttccaggaccgccccccacccccattccaacacacacacaaacacacacacacacacgcctgaagtcacacacgcaggaactcacacatgctcacacattcgcacgcaaactcacacacgggccctgtgctctcccagcatgccagtgagtgagtcaccttcctgcagcacccccatattcagatgcatgtgagagtgggggcttttcatgcctgccttttgtctttacccactgccaaaacacaaaaaaacaaaagaggaggcctcacccgccccccgtcctcctcctgtcgtgccacgagaaatgaggcctgacccagaaaaggcaattgctggaggggctgtctggagcctgcctccccggcggcctctgctcccagggaggggagtgagggaaaggaggcaggcagcttttatgtaaagacagtgatggtccagtgagtacaaaacgctgtttcaaagccagcgttcatcactaccacttcccactgtgatctccatagatttctttgtctccttcaattggccctaattatggagctggaggctgcctgatcagtttcattcttgtcatgaaatcctgagggcacgcatggggacggggacacaggctcgccagctgca

SEQ ID NO: 84469 - DNA, 1371 bp, Homo sapiens
agccgtttgccgctttccacctgctgttgtctctggcgaggccacagaggatgggacaataaaaacgtgctggcctgcaggaacccctgctgcagccctgcctgccctgctgtgtgtcaccggcgtcctggggtccagaggcttctacccattggtccccaagggctccaggaaccagaggcccatccaggatggctccaagccctgccctggggctttccttctctcttccctttttggcggttcttctgtatggcagccgagagggcattttcagggtgcccaggcatgacccctgagcttggaggcccgtgccgtgagaccccatggagtacgcccaggacagcaggactctcctctgtgtcgcctacgtttctccaaacactcgctttggcacgtggttgcctttggggtgtctttctgcccagctgggtctccatgtggggaggagggagggagactttcctgccctgtcccagccccagtctagacccctcccatcattgcagtctgctgcagggcccaaggggcccatcctggttctggaactcttcctgcatggccatgggcaagtgccgtcccttctctgggcctcactttccttgtttatagagctgacggcgatgacacgagcatcatcccactctgagagcttcccagccagtgtcttaagtgtctgatccacatacatttcctttggctgcagggtgcgacttgggacctgtgtgaggagtgtggacttggagccagcctgcctagggtcacttcctgcctctgacaattgttagctgtgtgaccttgggcaagttactcaacctctctgtgcctcagttccctcacttgtaaatgggggtaatagaagagcctgcatcttggtgggaggtgcaggttcaccccaaggctggctccctttgagggctgggagggaagggtctgtccaggcaggcctctctcccctacttggccgtccgttccctgtgtctcttcgcatcatcattctgctgtctgcatctgtctctgtgtccagatttccccttgttagaaggactccagtcagtgggttcaggcccaccctaccccagtgtgacctcatctgaactaattaattacatctgcaatttccagatgagggcacattttgtggcactgggggttaggacttcagcgtaagaatttgggggacacagtttagcccatgacataggtgttgcctcggacggcggagccctggcctggatgcctttgtccgtgaggttcccgagtgccgagtgccgggagggacagcccctctcctccagccccatctctctgatctcgccttcccatgggctcagcccgaaggctgtttcatgagcgtcatcatcggtcggc

SEQ ID NO: 84470 - DNA, 1088 bp, Homo sapiens
caaggagcactttcctggagggaggggggcctttgtcagggggcccggggacgctggagggctgaggacagcccagataagcacccgaggcctgctgcctcccaaaacggccctcggcctctgtacctactgccctggggggcagctgtgcgcacagctctggggaaatgagagtccccccagggactttcacatgttcacactcacacatattcacacacacgttcacactaacacatgttcacacatatactcacacatctgcgggtggggtacactcctgcatgccaggagggccatgggctgtgctgacttccaggcccccaaatcctccccttcccgggatccccgtgtacccgcctctcccctccctccctcctctctgcccagctggggacttttcaggccccacccccaccggcttcctagcaggagctgaaaggaacgttggtgaccactctgcaccccagacctcctgcctggggcatgggagacccaggatgccacctgagcacctgctggggtggggagggtttgtgggtggcttctaggtcgggcagggccctgtttctcagctgtgcacacaggtggagagggagagggctgtggacctgagagccctggacgctgggcagagcctggatgctgggtgggcagggcctgggctgggtgggagctttgacacggcgcgggtggagcctgggcacttttggaagaactccagaggagccatggcgggaacctggtgggttgagtttccctggcatctctggaaggtggggcggggggtccctggtatttgtttaccagctctccaagtgaataacatttctgaagcatcgtgcctgagcatgtgtgacccagtgtgtgtgtgtatgcgcatatgtgtgaatgtcagtgaatgtgtatgtgtgacgtgtgcaaatgtatggcggtgtatggaatgtgaacgtgagatattgtgtgtgtgtgaacgtgtgaatgtgactgtgtgaatgtggatgactgaacatgtgtgaacttgtgtgacattgtgaatgtatgtgtgaatatgtgtgagacgtgtgtgaatgtgagtgtgaatatgt

SEQ ID NO: 84471 - DNA, 1042 bp, Homo sapiens
agctctggaggccacaggagtgcctcccctccagggcctggcaaggctggctctctgcagggctggtcaggtcagctgccttgatttccctctcccaggggcctgatgtcatcattcaggggcagcctggggacttgagggaggatgcagttcccactgccttctcccgtcctcccctccccttcccttgcttctccttctccttcctgcttccacgtcctgaccccctggccctccccagcccggccccttagcctcccctccctcccggcccctcactccccccctaccagggctgccctgtgctagcgcctgcctgtgtgaatgtctaatctccaattttattcgctgggctccagcccatttgcataatccacacagtcaccctggttttaattgcccacaactctgcagaaagatcatgtggttaagtggtaaatcataattagataaataattggtttggccacagcaagctgcttttgttacacctgccatctgctggacccgttttttcttctggccagaacaatgcggttctgatgacagagcatgctgcttctctcttctgggggggccggagggggctgaatggaggggctcggaagcagtgcctggaaaattgcccggttgctggggtccgcgcctggcctgcgcttctttctctccaagcgggcacaccacacactcgccattcattacccggcttggttaatgcatcagagtggcaaatttgacttctttgcagaaaagggagggaggaaaggggcctggaggaggagggggaccagccagggctgcccaaggcctggcctgcctgccggttgtcggtggccccgatgggccagggcaggaggcctgctgtggagggcctgggcccgatccctggggggttggggggggggggcggaggggacaggcgggcaggggttggaaccgccagacctccctgccccaccgcggtcagcttctccatctgctctccaccgaagcctcctttattttccatgccccaggccccatctgtgagccctgagtctcc

SEQ ID NO: 84472 - DNA, 1050 bp, Homo sapiens
ccattctcccatctgcccacccatccatctacccatccacccattcctccgtccacccctgaacccatctgtccctcaacccatgcactcatccactgtctatccgtggtccctacatttggtctaaaggtaggatcttttctctggcagagacgtggctgcctcccccaccgctgcatcgcagctcgaaggacggatgcatctgctcttctcacatcagcatgatggtccgcctaacgtgaggggagggggcctggcccaccttagctgcagaacgcatcactgacttgggaaatgaagcctcaagatagttccccggggaggagcagtgttctcagacttctgtgacgcttctagactcaagctttcagagagactcccatgacagcagccgggcacctggctcactgtgttcatcatgtgtgtgctcgtgtgttctggaatcctcccaggaagattccgccttcaggtggcccaccttgttttctccataagcccacatacacctcacagaccaaatatcataaacgttggctcagaaaatttaagttgtttctgtattctaacattatgctgcccaatacagtagccactatctatttatgcttaattttaaaattttaaattaatgaaataaaatctagaattcagttcctttgtcacactggccacaattcaagtgcttagaggccatgtgtgccagtactggacagttcagatggacaacgttctcttcatcatggaaagttcagccaggcacggtagcgcacagctgtaatcccagcactttgggaggccaaggcgggcagatcgcttgaagccaggacttcgagatcagcctggccaatgtggcaaaaccctgtctctactaaaaatacaaaaattatctgggcgtggtggcacacacctgtaatcccagctacttgggaggctgaggcagaagaatggctttgtagttgtttttttgtttgtttgtttgtttgtttgtttttgagatgaactctccctctgtcacccaggctggagtacagtggcatgaccttggctcac

SEQ ID NO: 84473 - DNA, 1049 bp, Homo sapiens
ccactgccagcctgggcaacagagacttgccacctggaagacagatgaggctgtcaccccagtcatgggcaaggctctgagacttttcctctctaaaatgggagggcggcagctgtcctccctgtgacggggacctggcaaggtccctcctgtgtgagccccttgaagccgtgcctggctacccctctgggtctctgtggcctccgagggcggctgcgggtattctctatgcattgcagccagagagacacggggtccttcctcttccaggcccgctccatccacgtggcttctttgagctgagcctgcttttaaggtgccaccttgggttattcacgggaacactcacaggtggggtctgagcggtgtggggactttcccaaggtcacaaagcagtttgctggctgagccaggaatagaactcctgagccgggctgtgatcaccctgtgcccaaatggccaggcaggagggggctgggcctcctcgatgcttccatgtgggccaaggggaggggctgggaagatgtcacccaggcctgatggggaaggccaggctgagggctctctcgaggaccactgtctttcgtgggagaggagagtgtctgaactccgggtgagaggctagtgttgagaggcagtggctggctgtggctaagaaggctgtggtgtgtgtgtcttaagatcatttgggagccttgttaaaaaacacacacacacacacacaccccaaacacacacacacacacacacacaccccaaaaacccagcatttgttttcctggtggctctttgcaaaacactccagctatgaagaggggaggggctggcgtagcatcgcagatgtagggactctgaaggctgatgaaataaacccatccttgtcaactggggaaaggcactcagcaatccaggacaagacggcatggtgcggatcctgcaggaggttcccgcatccttttttggctgggtttattttggggacaggagggctgtttggcgctgatgagggtttgtgtcctcctaggggcttcttgatttcatttagctca

SEQ ID NO: 84474 - DNA, 1029 bp, Homo sapiens
cagaggcagggatgggaaaagccttcttgcaagagataagatgtaagccgggctttgaagaatggggaggatttctgggccagtgatagcagggcaggaaacagaaagaggagggtggaatctaagtggtgggggcttgcaccttcaccgatgcgtagggcagggctgggggctgagggcagatggggtagctgggcagccttccacccctcagctcttcgtgccccccggattcagtgcactctgtggacttagccccccgccccttgcccctgcaccggggctggtagccttggggagggtggactgtgcatacaggggagctgggtgaatcccagggtgctcagctctaggcagctaacggctccctcccccggcccccaaccaaaatggttttcaggcactggacagctgcccagaggtaagagcgtagacctgaaaccgcttgagacctgtcgtacccctgcaggtgtatctttcttaataatcagagtgaccatggcaggtggttaccgagaagtgctgccaggtgtaagagccacgtctggatgagactcgtgctggaatgtgtgtgcctgaggcaggccaattaaccttctcaggtctccccactcgggctgtgtaatggaggtcactgcctgccttgcagggccgggagggcttccagtgacatgcgctgagcagcgctggctcttgttaggtgcttggtgaatggcacaggtgatctttacctcctggcccacggacatccaggtccctgatacttattggcggatccaggcgctgaacaaggtgcccaggcaacataatgaaggtgacatgcagttcctacgtgctaggagcaactggccaggatggagaaggaccttgggttaggctgtgtgctgtcctgctgagccctagaagaagcaagaaccagaaagaacgtgtccgggatccatcctccgccagggctaggccgtgtgctcagacttagtgaggttgtgacagtcacgggtggcgcccgcacccctgagcacctgacgtggc

SEQ ID NO: 84475 - DNA, 1012 bp, Homo sapiens
ccaggaatggggaggcgctgcgctggggccagaagcgcaatgggtcgtgccagtttctggaggcgggcgacctcgcctctgaccgcaaccccagctacttaatgatccccctggcgaagcggcgcctccgtgggttctccagcccctgggccgcgggttctttaaagaacaccccccgcagcggcccgcaattgtggccttcccaaaagttacttaaaactggggggtggggtgccttatggaattttgaggccaagttcttagtattcagccttttctagttggggtaataaggtcaggcatggggggggtggggcttgggtacacagtctgttttgtgtcgcctccccccaccccacgcgccaccagcgcccagaaagttgttctccaaaaggcctccaggacacggagttacccgtccgcccattattgggcctgctctgtgtcaggcactgttctaggttcccgggacgcagctgcgagacagggctccgctcacgtggcgagggtgctgcactactttaagagttaagtggccggtcttagccaccaaggtccccgggacccccgagcagtccagccaggggctcccgagagtgtgggggtggcacctccgcggccccgctggtgtccccggctcacctggccggccgggccggggaggggcgtgtgcctgggcgggtggatccgggcgcccgtcggtgcgcgcgcgcgcgcctgtgtgtttgcggctgaaacccgacacctcccgctggctgaggtcagggagccgggagcgagccagtggcccgggagtgggcggcgttgcgtttgggtgtgtcctcggcggcgacagcagcaggtgtttcttggccggggccccggaagctccacctccccagcgggcccgagctgccgccgccgagcagccccgggtgagataagcagtttagacaaacactgggcgacggtggctccagcatgtatcagccgaggtggagctgcggggccctggcatgaaaggtgagcgcgc

SEQ ID NO: 84476 - DNA, 1021 bp, Homo sapiens
ggaagcagcccatggggagaatgtgacaagggaccccaggtaccgccaagggcacagggtggcggaggggctgggaatcggccggcatgggtgagcccccggctctgtctcagctgagctgtgtggccccagcggcctgtgtcactttgctgttcgcagctttgctttctggggtctgcttacgtaaagggaagtaagggtacaggtagccggcgccctgtaaaagttgccccctggtaccttgatcgctgttggtgctgggcaccatctcccagagtcacagctctggacaccgaccccagccttgactcagggccccgccctctcccttggtctgtcgtgcccctttaggaggccgcctccctgccgaggccaggctgccgcccgcatctgccagtcccgcccttcccgccgccctcctctccagcccttcatctgcccggcctgcttctccgcacacacagcagccgcttaggataatcgcgtcaaatgttgctgccatctgttgcctgacttcccgtccctcgcctccatccgggaacctccgggaccagtccgtggccgtgaacctcagtcgcaggaccgtcggctcctaggaggctgctgtccgcgggtccccagaatgcaacctcagcatccagcgccttctgtgcagagcccccctgctgtcctcaaaactgtagtgtggcgtccaacctgggaagcccctccaggtgacctggccccccaggtgacacccctgggattgacctgctcccttgcactgtccaatgctgttgtgtggacgtctcccgagagctctgcaccccgtgttcttctgcagaacacggcctcctttgtgttcccagcatggcagtgagcaagagaaggctggggagaaaccggggtggccagccccctccccgtcacccccattcacagcaggactgcagcttcaagggtgtcgtggggctcgggcagaatatggggttcagggtggctgctgggggccctaggcattgcttgggagatggctcattgc

SEQ ID NO: 84477 - DNA, 1052 bp, Homo sapiens
ctcccttgcctccacccccaagaaaaattgctttgtgccactgagcttggagcacgtggagggcagatatgataatgaatttatcatgaagccgcccaggctcctgcgatcacgtggtgcccgtgcagcctcagccgccagggtctgtagcagggtgacccgacctcgttagggccacggaagcttcgcccctttgggggagtggggatcgcgggggcgggcaccagtccccgagctgggggacgccctttatttgttcacaaacatttctttctgcggtaatgaaaaattaccaagaggggtgattagagaatccaggtccagattgtgtgtgcggggcctgaaagtgaaggcctgctgggcccagcctcacggggtgtaattaccccacggggggctgtcagggggaaggggcggattggtgcttgaaccgggacccagcagaaaattcacctcagctattagcttgtaattacagagcacagagggagcaggcctgaggtctggtgccggggaagagccgggatgaaaggaagcagtaattacgggatccgcgggaggccgggagggcggctggcacgctgattaataagcccctccagcctcgtggggagggggagcgaggaatgggacaccatatttaatggagtagagaggcctcccccctcgtttaaatcctgctgttggagcgtttggacagcaggcagaccggtttggggtctgttctgaagaactaagaacgagatgggttccggaaaatagcagctcgctgggccagccagccttgtccctctccactgggactttgcttccttttcttcttgccttttttttttttttttttttttttttttttttaaagcattgtgctgcttctgaccctattagaaacctagccagagaataggagaaagtattgattcaagaagcggtgctttgttacggggggcggggggtgggggcctcacccgggggcggtggtctttgcttccccagacctttcctgtctgtgaaatggtgggacctgagggttttgcggtgctgtgggctgc

SEQ ID NO: 84478 - DNA, 1041 bp, Homo sapiens
ggtggcactgtggtctggcctgggtccgtggagaagctctgcccatccttgtcagaggtcagaggggcctgtagtcatgtcatggaccaccccacgtcagggcagcccagcctgctcgccagccttggaagggcctgggcgcttgaccactctgtgctggtctggctgagccgagggaggtggcaggcggcgccctggaaccccaagctgtcggcacctagcagcctccggcatcaaggggctttggggctagcagcaggcatggtcttcatccccagccattttgtcacgttccccacgctcaggcaggtgtgtgtacctggctgagacacacctgtcgacagggctgggtcttccccttggttcatttgctgctcacagccccgtcttctctgcacaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggtaagtgcgtctcgagccgaggagcccctctgccctccctgtcccttgatggcagctgggcagaaagcctgggctggaacctgactggactccttggccatgcctgtcctcacagtttgtccacctgccaaatgggacaatgatcgttcaggctctgctctgaaatagcgcctgtctcggtagccgtggtctcctgcagtaaacctgcaggccgaggagctctcgggcgtgcttgggcattttgtaagccgctttgattgtatggaccttaagttcttcctgcaccagtgaaacccggctcacctcccgtcactgttcagattagcgccctggctcgttcctggttatgctttttaagggcctgccccaggtccgtctcttgttcctggtgcagcagagcccccaactctttccatgtgctgcaggctgcagatggacgaggagctaag

SEQ ID NO: 84479 - DNA, 1456 bp, Homo sapiens
gcctggctaatttttgtattttttagtagagatggggtttcaccatgttggccaggctggtctcaaactgctgaccttgtgatccaccctcctcggcctcccaaagtgctgggattacagggatgagccactgcgcccggccgagtctttaaagaaaagaaaggaaaagagaaaatgaaagacagaaacaatgatccttggggtggagtgtgtgtcccctccctgcagccctgttggcactggctctctaaggggctgcgccatctgtgtcatcttaggagcggcaggcagccagggaagcctgtggatgactgaagggtcttttctccctgactgaagggttggtttcactccctaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaaggtctgcctccccgcgggccccgagctgctcagggagagccgcacagtggggatggggagcctgcatgccagccacctgcccctctccgtccactcctgctttttgcctggggtagtcccaggccccaggtggcaagtgcactggcttctttgtagcagcatgacaccctcgtaggggaggcagaccctagtccccgtgcctgtcctgcctcgatgcaaattgtcccaaaaagccaaatcaaagcccgcctgtgaagatagttccgcagacaagcatgatgaataagtgatgagcggaggctaataagatagttttaaatattaatagtgcagcataacaggagagccggcctgggctcagcgggggctccacatacagggccgctgccacgagctgcagcaggtgggtcaggggttgaggacgcggcggctggcactgccccgggtcagggtaggaggtcaggcacttcattcttatt

SEQ ID NO: 84480 - DNA, 2466 bp, Homo sapiens
cttgaaagatgcttccagttcagtctggccacacagggccacattgggacagaccctctgggctcgaatccatatagcagaagaaacaatgcagccacaacacctgctcagggttttggcttccttggcctgcagcgcaggctggcttggtgcccagatgttgacgttcctggccctgccccttacgcacgctttcaagtcctcgtgggcccctggcctcctctctgggagaaagtcgaaggaaagcagagttacttcttggaccttgagcagcttcaaggtgttgatcagggtgtagccgtttactttctccttttaaccagtcagtagttttccctttctcttagcgggctagtgacgtgttgattgccagcccagttccctagatacaaagcatctttttccctgaatttttggaggaaaaaaaattaagggcgatgcagcccttgagtttcacagtcaagaagggccgggtgacatcagggatctgctgcgtggaacatcgtggggtcatctttccccttcaggaagtggcagtaatggtaggagtgggggagaaggcaccctgcctcagaggccaggcctgggtctttggggtgtttctttgtgttggggccaccttgtctgacttgaaataagaatacatcctcgcacgtcaccaccgaggtccgtgggcacagtgattcacagaggcgtcgtcaccgcacggacagctgtctttggagcacgtctaggacattgtgtagtggatgccgagagcaatctgggctcgctttgagatggttgcttcctttcaactgggcctgccccatcacacctgcttttggtttttcgggctttagtgctttgcctgcccctcaaggctcggctagaatcccgctgtccttctctccaaaaaatgatgcaactggctcgttaatctcaggctgcttttctcatagacaaagagagacttgttgaaatgctccgtgccatgaagcagaaggcactgtcagcagcagtggccgactccttgacaaactctccgagggacagtcctgccgtctccctgagtggtaagggaaggatagccccacctgccaccacccaggaccatcccatgggctgcccaggctcagaggcgaccactcgaggtcttcatcattgtgaatgtggcctcctgcaggctgtcttcttccattcttgtaccagcgtacgattcttgcacagttgtgacagtcattgggacggaacgtcagtttgaaggcgggctcagagttgaggggagggtctggcttctgtggagctctacgtgctggtcactatggtcgtagtaaccgttgtccttcagttacggcacagaggctcacatggaggccaatccaatggtaccatcccaggagggagggcgtgctccagccttagtgcccgcagcctggtcctgccactagcctagccgccctggctctcttcctgctctttgtcttcctcactctgccctctgggccctgccggcacctgccgccacacctttcctcctcttacagttctggctggcctctgccctgtcagatgtcagagggaatctttacagtgcgtcccagtcctcggcccctcacacactctcttgtccggttggactgaatacctccatgctgcctccgtggctgggggacttccttcttcctgtggatctgcttcttccttcttgggacatctttcaaggatggacttgccactaaacaccccactgtcttcagagaatagccatgtgcgcggcggttacttaaatgttccccgggtcttggttctttgcgctaggtctttgttaagtgtaagctctagagaccaggatctgcgtgctggacactcagcctgttaacttgcatttcttaatattttccttcactttgtctctaaaagaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaaggtaatgaggctgccagtccctgctcagctctcggctgtggttgaggctgaccaaagttgctgagcgccacagctgctcagccgttcagccgtgggcacaagtttttataaactccaatcaccagaagaaaataatttcgttattatgccaaaaccatgtttgtttgtttatctccaagctctaaaacctgaa

SEQ ID NO: 84481 - DNA, 1044 bp, Homo sapiens
tgtgttagaatccttcactgctgaaggtgtgggctccttttgatgctctctgaatactcttaagggtgcaacctatcagaatgttagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtaggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagcctt

SEQ ID NO: 84482 - DNA, 1294 bp, Homo sapiens
cccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttc

SEQ ID NO: 84483 - DNA, 1025 bp, Homo sapiens
gctcctgctgcagtgcgcctcctgcaccccagtactgtctaatcagagagcccagtgtgggcggacagaggcgcaggtccttagctcggctgtcaaagtctcttccctctctgagcctgtgtcctcacctataaaatgggatcataccaccttccctgctcccaggaccagtgggggcataggggagacacagggttactctacaaagtccgagccccagggaggttcctgaacgctgggaggggttcctcttaaactgaagcagttccggggtccgattcacccagaaggatccagcatcactgggctgggtcccatctcagcctctggcagcaccagaaagcaaggaatcccagaggccccagccctgcagttcccagggaaacggggcttggtgtggtgggggcagggtgcatccaggtgtccatcccctctttctcctagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaatagtgaatcctttttttttttttttgagatg

SEQ ID NO: 84484 - DNA, 1060 bp, Homo sapiens
tgttttgcactcatcagggccaagggtgggggcccggctgcacgtggccaatacaaacaagtcgcgccctcccctctctcagcgctgtcctctctccacaggcctgcagaggtgccgacatggggcttaagatgtcctgcctgaaaggtaaggcctgaagctctgcccccaccagctctcatggcagagggggtgctgggttggggggcaggagagaggggagttgaagccctctgccctgcagagggagcagggcaccatcccttaaagcagtcctgtacacagcaggtgctctaaaaatgcttgtcctgactctgagcacccctccaggccttctatttcactagcagtgggtgactgggaaggtggcagtgccttggggcctcagtttccccctcagggtgcctaatcccaggctgtggagagtgagggaggaggaggcctttgcgaaggagccaggcatatgctgggctgtttgctttcccaaggacacacccggggcctgttatcacccagacaggaggtccagcgtccaggtggtaggagagaaggccagcgggagaaagttctagaaggacacaaaaccactgaagggtgttgtgggtgttagcaaaggcagcccagacttctgtcctgtgtgtggatggccctggggcacctcagaccaatgttgcaggaaacctcccatcccaagtccattgctgcccctcttctttaccttggtgacagttgctttgttctccccagccaaaaacctgggagtcacgtgggcggcccctggtctgacttgcggccccgctgcctgagaccgcctctggctccaggtgtcccatggccagtggtgtgagtgccaagcttctagcctgccccggggccacctacctgaccccagcagccccttccaggcagaggccacctacccacctggagaggtggttgggagctgagccaagcctgggatcagcctgcatggtgtgagttgtggcctcaccaatgcctctgtgagacctagatcaagggcctcagtttccttatcagtaaaatggggatcatggcggac

SEQ ID NO: 84485 - DNA, 1311 bp, Homo sapiens
cgttttctccagaagcatgataccaagcatattccccggctcctgtaggccccagtgttccagcgcttccaggcagtagagggaacctcagtggtacccacaggtcttcccaccccaggcgctagagcacagacactcttcccaggcctgtgctttgatgtatctgtggccactcagaaagcttcagtcatctgcctccaactttctcagaattccacgtgaaaggcgtcccttccatgtattaaccatgtcttctatgctctgtatacctcttcatgcgtttgaaatgcacatgtttctcagtactctgcaccatctctgttcataccactgtgcatgtggctggccttctctcttgatgctgttacaagccgcccgttttcactgttagatgctgacttcttcatgtttgacccgtagtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatcttgtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatg

SEQ ID NO: 84486 - DNA, 1075 bp, Homo sapiens
tttgcagctggagtccatccacaaattttgtacttcagttaagctattaaatttatattattcactttttgacttagtgacttcctaacctgaaggcaatgaaaactctcagtgtttagagccatagtttatgaggttatcagccatagaagatgcagttttcacaaagcatctaaatccatgcagctgtgtaaatgaggccttgttctcatggctctgttccattcagagagcttcctattggaattgtttttgataaaggggaaagaccatagactgtctatcaaaggacaacattagattcctttgaaaggcttttcattattttccattaaaaaaatccttgcatttgtgcatgctttttgcatgctttttatgtttttttaagtacttacgcctattaacttatttatccttataaccctttgacgtaggtagtgaaggaattattcctaatagcagaaacccataaaatgttagtatggaaattagcttgaacccgcttctctaatccctttctgcccttttccccttgttgatttctagtgcggtggagtagctttctgttacattctgcgcagatgacttgctggcttgctcactggcctcatcaccatgatttcaggctagaattcttgctgtggcctccatgtgggcctgtcctctgctcctctgcacggcggctgccctggagctctcccatgcccctactccctcctgccctttgttcatctccagaacattcacgtgccaccttggggatggggagagggatgctgtggttccccctttgagttcttccccctgaacttcaccctctatctcggtcccattgacctcccaagctcttctttcatggttcccactccttctcattccatagaaagatcagcagctgacttgagaaggaactttccttctcagtgaaaataacagttgctctacttctgaactccaaggcctactttttgctgcagataggaaggctcagcaggttaccctcatcttgttggtaagtggcaagttgtggtccctgcctcgccttctttacggttattgtacagtcacaaggggc

SEQ ID NO: 84487 - DNA, 1054 bp, Homo sapiens
tggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctggtaagcgcggaaagggccccttccccttgcaggcagcctggcctcccctcagtcagcagagaggaagctggcccagcggtcgccctccagcaggctcctaggacccgctccctagggttgccgtggccaggaatggggtgatccacgatggcgcttgggtcttggcgctgaataaatagcgtcccgtagtagcagcgactttaaccgtcgtggatgcttttagaggcactttaaggcgacgagttatacgttagtttcctgaaatcagtagcctttgtagaaacaagtcatcgttcacttggt

SEQ ID NO: 84488 - DNA, 1011 bp, Homo sapiens
gccgtgcagcaccatcttgcagtaggcctgggtggtcagtttcaccccgggcatgctgacccgggagggccccggaggcccctgggcgcgcggctgaggcctggacccgctgcctggccgcgcggcgcctcagccgagaagcgggacgaggcggcggcgattgatggcgcggccgcgggctggcgggggacccttcaggcccggccccgtttgggcctcggctcctggaaaagcgactcgcgcctctgggaagccgcagccccagactccagtcgcgcttctcgcccggcgccgccggaaagcagcctctccaacgcctgccggaaagcagcccggcccggcattttacgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcaggtgagacaggaggtggccggtgcggcgccgccaggccgggccgggtcggggggccgggagccatcaagtctgcacgtccgcagcctggccgctcggcttcagcaggaagcaccgaatgggcctcggagccaggtgacattgaggccggcccgtggggactccgggctcggtggctccaggctcggggggccgccccgaagtgcccggtccatcttacccggtctcgcagcggctgcggaccggcctcgggcactgaccttggagcgcccgctggccgagggctcaggctgcggggaggcgggcccgcgctctgtgcctgcagcctccgcccttgctccttcaaaaggtccctgtgcaacccctcccgggttttgcggggctcccgggcggcgctcggctttccagcctggaaggcgcctattgtttgctcacgcaagggctaggcccaaggagagaagctagacgcgggcgttcagccctgacgtcatgcttgtttattc

SEQ ID NO: 84489 - DNA, 1097 bp, Homo sapiens
ggtgcggtctcggctcactgcagtctctacctcccgggttcaagcgattcttctacctcagcctcccaagtagcggggattacgggcgcccactaccatgcccggctaatttttgtattgttagtagagacgggatttcaccatgttggccaggctggtcttgaacccctgacctcaggtgatctgtccgcctcggcctcccaaagtgctggaattaccggcgtgagccaccgcgcccggcctctccttgtttttttaaaaagaccaatgttctgttaattacctgaagcgcgtatatattatggcagttgatttataatgaagctccttaaaagcatgccaattactaagaaaaacctcatcctaggtcattttgtgaattcagagacagtgataaagaatggatcatttgcgttggggagaagcaaacaaaaaaattccaaaatgctctggggcaaaaagaagactaattccttgctgtttgtccttattcatagagaaggtgtacatttttatctttcagaatgttggctaccagggtatttagcctagttggcaagcgagcaatttccacctctgtgtgtgtacgagctcatggtaagtgtgacttttcttacttttaaataggctgaactaatttcattttgctcctgctgtgtataaagccctgtgctggagttttaaagaccttaattcggctcttgagggtctttaggggagatataaatgttctcacagggcttggttctagattaagaagtgtttataagtcaaattgaatctcttctggatctttggttatactgatacttccccacttacccttcccttccgttccacttttttaagcttcgagatctacccctttcaaaagatcttctgcaccataactgactgaccttaatgacctccctccccaccttgcccccacaactcccaaccatttgcatcacctctgtttacattatagaggcaatggaaacgaaagagcctggacttcctagcctgagctgggttttcatctcatttctatcaaggactagctactgaagctcaggaatctctttgctcacctgaagtatatggacagagcttag

SEQ ID NO: 84490 - DNA, 2981 bp, Homo sapiens
acctccgcctcctgcgttcaagcgattctcctgcctcagccttccgagtagctgggactataggcacgtgccgccacgcccggctaattttttgtatttttagtagagacggggtttcaccatgttagccaggatggtctcgatctcctgacatcgtgatccgcctgcctgggcctcccaaagtgctgggattacaggtgtgagccaccgcgcccagccctgcaggtaactgttaatgtaggaagtgctgcctctgggcaccttggccccagggttcattagcagttgcccctggtgggtttttgttggctgtgatgagaagtgcttctgttccccctccaccacactcctgcaactgtttaaacagtggctgtgaccccctgagatgatccagggtttcaaggcgtgcacatgtctgtgtttcggttttcagaagtatcaccttggggtgactctcaacttacatggattttcaaagatttattcaatatgtttttcagaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagaggcagtcttgcacaggagggttgctctgctgggtttcggggtcactgtgccagggccccagtttatgtgctcaccagtcacttagctctgccagctgacaggatcttttgctaggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttctttccttgccctgtcacatgcctgcgtgggcacgtgtgtgcacgtacgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtcggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccttaactactttgtacagcacaccacgttttcagtagcaatttatgtgctcaccagtcacttagcgaaagatgacttcgtgaaggttcgagcaaggataaggggactcattcattgaatgactgtctggactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacagacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaccctttgtgatcagttctttaatgatacctaaatgaaagctaattaaaacaataggtttctcccaagggtctggagtaaatatattttgggtgcaaatgaaatggcaaaaatctagtatcttaaattgtataaggggacattatataaaaactgaaaatatagaattccttgatgtaggaaatttgaggtttttggcaagagatctttatataagtaaaatcccattatcgtaggcacaccggcaggagttaccacaaccctttttttttgttttgggagacggagtcttgctcttgtcacccaggctggagtgcagccgcacaatcttgggtcactgccacctccacttctcgggttcaagggattctcctgcctcagcctcccaaggagctgggattacaggtgcctaccacc

SEQ ID NO: 84491 - DNA, 1085 bp, Homo sapiens
actggccccactaaatgtcgcggcgagaaaagccaggtctgacttggccactcctgtctgggtaccaaggaaccaggccacccctttactccttagaagcatctgcctcattaaccacggcccccaaaagctccaccaggactgtactattagagatgaggaaaccaaggctcagaggtgacttgtcttgctcgggctggggtggccgcagaggaggaaccccagctccttttgagctcctttgagcgaaagctgcctgctggtgggtggctggaaggtctggagccatgcctttgtggccaccaaccccctcgagccccaaagagaaaagagaacagaaagagcacacctctgtggcccaggcgccttcccatcagaagcccacaccccaggcgccttccggccgggcgactggcgctgctggcctggacgggccctgggggtgagctccaggcggcgaagtcccccttgcctggggctgaggagctcggaggccgcgcccaggcgcttctgctgcccggggctgcaactagaaacccgctgaggctcgggtgcgtccaaggcgtcggccccgcgcggagaaccgcggcgtccgctgatgtgtaatccacacgcagaagccctgctccaagcagctcctgctccaagcagctcctgcccctgctccggggctttattacagggaggatttcatgtcaaggggcatcttgacttccctgttccagcgcaaaatccttaaaatagatgaagacattgtgaattaattctacgttattccaggacaaaaacccctaagataatcggagcgattatgaattaattctacctaggacgcctctgtgttagctgatcctaggggtccttcatgcacgcagggcgcataatttcgcaccagactcaggagccctttgcgttttaagcttgtgacttgcacatgctgggcgcgcttttgcggcgtcccgcagccgtgggagcttcactcgcgacccctgtgcgagcccaggacgcaatggaccccgaggaagacacagcccagccgagcgcagtctcggcgctgcagcagcggcagcgcgaaatctcggacg

SEQ ID NO: 84492 - DNA, 1054 bp, Homo sapiens
aggaggtcagagggggtctgtgctgggttcgggtcgaaccagcggctctctcgcccggaatcccgagaaagatgtcaggaaaaataaagataacgagaagacgaggcgggagggacacctgccgtgcacgtgggggagcccgtgggccccttgaggtcggggaaactgaggctcaggaacaggatcggaagccggtttgacctacacgcgggggtcgcttaactactgttaagcggtttcagcatgggctctggaattcctttgtatgttattaagtgggaatcttttgttgcagtaggtgtctccaaacaggacatacgtgaacaaatttggggctacatggaatcacaaaatttagctgactttccccgacctgttcatcacaggatacccaactttaaggtactgacatatttctggagtccagaaaaggaaaacaaaatattcttaaatgaataacactagtaataaaattctcttactgcgtcatggtggatgagaatgtggcgagcagtgagcagtggtgtgaaatcaaagccatttggccagggcgtccttagcatttagagacgtcatttactcttcacctggggcctcttgcgtctctgtgcagggtggtttggttgtctctaggtgaggttgtgtccagaattggtgggttcttggtctcactgacttcaagaatgaagcctcgcagtgagtgttacagtttttaaaggcagcgtgtctggagtttgttccttctgatgtttggatgtgttcagagtttcttccttctggtgggttcacggtctttgctggcttcaggagtgaagctgcagaccttagcagagagtgttgcagctcacaaaggcagggtggactcaaagaatgagcagcagcaagatttattgcaaagaacaaaccttccacaatgtggaaggggattggagagggttgttgctgctggttcaggcagcctgcttttaatctcttatctggccccacccacatcctgctgattggtccattttacagagagccgattggtccgttttgacaggatgctgattgg

SEQ ID NO: 84493 - DNA, 1138 bp, Homo sapiens
ttctccctggcttccgctgcacgcagccgacggtggcatcctcgagcgcctgccttatggttcttgctctgcagactgcataggttatgccaaatatctaagagaattgcagacattcatccacacaaggatcttgtacaggtgctcatagcagagtgatttataatagccaaaaacacaaaaaacccaaatgcttgcaagtgatcagtggatatgcaaaatgtcatctatccacacaacagaatattattcggccatggaaaggaatgaagctctggcacaagctacaaggatgaaccttgaaaacaggacacgaggtgagagaggccagatgtattaaatggatccatttatagaaaatgtccaaaacaagcaaatccacgaagacataaagtagattaggtgtttccagccctgggggaaagggagaagttggggaggggggtggtgatcactaagaggtgttgggtttcttttcagagtgatgaaaatgttctaaaattggctaaaatggttctgaacttggtggtggctgcaccactctgtggatacgctgaaaccccttgagttgtgccctttaagtaggtgaattgtgtggcgtgtgagtgacatctcaataaagttggtgagaaggtggggtgggggcgggagctccctgaaacaaaatcctttgttcaatgtcacttcccgagaagtctgttgtcggcagcctgccctgaacttatgagaccctgtgtggatcctttgtctgtgtgtgtggttgaggtgggtggaggctgtgttttgtgcgggaaccttgcctgggatctggtgttcagagacgtacccccctgggggatcctggggctgggaaggggctgagagtgcctcatctctcaaagatgttttcgtcttgaaaatggcgttggcggtgcatggattagcttgagcacgtgcttctaccgcatgcgtgctgagtttgcatctcattcactgggtgcctgtccaaagggcaggaggggactcagcgtggacgctgcacctccgcgctgagctttgtggttgctctgaggagcaaatctctgccatttcctgtctttgctcacaggcccccacataaaccaccagcttccttagttccctgacttggagcagcctc

SEQ ID NO: 84494 - DNA, 1022 bp, Homo sapiens
tggggaggcactgtctcctcctccatggcaatcctcttttggaattattctgtaattcaggctccctttttttttttttgaatcggggtctcactctgtcgccaggctggagtacggtggtacggtggcacgatctcagctcactgtaacctccgcctctggggttcaagggattctcctacctcagcctcgcgaatagctgggactacaggtatgcgccaccatgctcggctaattttgtatcttttgtagagacaggattttatcatgttggccaggctggtctcaaactcctgacctcaagtgatccacctgcctcagcctcccaaagtgctgggattacagttgtaagccagtgcacccagccaggctcccctaattttttagtgttgggggtcatgtttgtgctgagattctagccttggcttagaggttggaccccatcgctgccgattattccctgagaataagtccctctcgggtaagtccccttaccctttgggcctcagttttgccattagcaaaatgggcataataataaccttccctataaggttaaaggagttaatgtgtttaaagctgttatgatagcttggcacatatatcgtatgcaataaatctgggttattattactgctcccaactagtaaagatttagacacatttctagcacttcaaatgtctacattgtgtgtgctctctctggaataagctacatcctgaatataaaaaaggtccccatgcttaggtctgaggccatttatagcaattcctgtttccactgtggagttcagttttgctgatatggagggaaaatttcaagccctctgctgtataaatttagttaacattttattgcttgtgacttttttatcacatgacttttgtttctcattaagttagtgaatgagatttactaaaaagccaagtaaaatctaataagggcaggggccttttcctgcagaattaattctcttgtgaacccgcagatgtcaggagctcaggctgagtcacacaagtgt

SEQ ID NO: 84495 - DNA, 1066 bp, Homo sapiens
gtggggctctgggggcacctggcccaagtgggctgtggagtcagggaacttgggcagacactgatccccggcacccttgctcctcagagtgggcttgcacctgcagccccgggagcttgggaaagcagattctcgggccccagccagccccactgaaccagaattgcatttccacgagaccctcagggagtctgtgtgcttccaaggtggccttcccacagcaccgctcagccccggccaccctggcagccctgtggggtttaggaagtctggacagcagaccccacacagaggctcagatttaactggggacagcctgggaaaggggcccctccagcagctgcatggagacccttgtgcttgcagacagctcccaccctgtctgagcttcagcagctcctctccttggagtggcctgagggtgggctgtgtggtgagcccagcagtgaacaggggctcattgtcccatgccagggctcctggcacatgctgcccgcctgccctgaatggttattggggatcctggcagacagcgcctgaaggggcgaagcctattccccgagcctccagggatcagggccacatctggcataatggggcattccctggaccccagagttttggctcctggactcctcacggagttttggggctgacgcatcttcccagggctcggctcccgagctctgcctttcaggcagacagatgtgggctgcccccttgggctgctgcccagctctgggatgttctttgaacttctctgggcgcagttgagcaggtatgagccaccgtcctcaggggcactcataggtgttgctggccctgccactttctaagggattctgagacttcttcttctgtaagggacgttgctaagtcagtaggagggctggtgccagctcgctcagccagaggtggatctgggctggagcccacacagtggtactgctgctgctgctggcctgagccctgctgactgccacctgctccacagggcgaccccaacatccccgctgggcagcagacagtggagatcgacctgaggcatcggatccagctgcccgac

SEQ ID NO: 84496 - DNA, 1167 bp, Homo sapiens
cctgagagcagcattaaagacagattttcttttcttttttattttgagacagggtctcactctgtcacctgggctggagtgcagtggtgcaatcacagcccactgcagcctcgacctcccgggctaaagcgatccagcggcccccctcagacctggcttctgttttcaccaatgaaaagttaactgggaacatttatgtaggagagatgccctttttctcataacagaaactatagttattttcttttttgcttagtacttttgggttattctggaaaagtctctgcgaagagtgggtagtaagggtaggaaatgtgagactaacacatccgaacaaggaatttcctggaacctaaaagtggccctgagggtagaccagcaataatgccccatttttttcccattgatgtatggaccttgtatatactgtattttcagggttttttcccttggctcacctttattttgccccctcccctttaaatatctctttaatagtcactttgtagaaatgtgtcaaatatcttaacagctgttacctttccttgcttctgattttggtaattaaaaaaaaaaatctttctagttcatgaatattttggtaatgttgatcatgagtactgacagttttcagacatgtgtagcacagtaagtgagggaaatgaatccttagagagaacctctttatggagcctaagataagccccagttagcttgagtggtgttttctctttccaagtgagtgagtttaaggttaatactgaatatagctctgctgataaactctaccaggattgacagggttctcaaagttgaaatggattttaaggctcactgaaaacaacgccttccttttgtagctaaagaaactgggtggggcctggtggtgaagatcatggtccacctagtggcagagtctggactggtacctttaacctggcatgaattcttccagtctccagtaggtagccatcatttccagtatattaagtggaccaagactgtgtgagtcaggagacatagtgtgtccttggagatgtgttggaaatattgaatgaacttcaaaaattaaaattgtgtggggcatggtggctcacacctgtaatcccagcactttgggaggccaaggcaggatcgcttgagtttgggagttcaagaccagcctgg

SEQ ID NO: 84497 - DNA, 1004 bp, Homo sapiens
gttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaagcccagtttaatgggattccgtatttgagacttggatcccacactgtttgtactttccaaagccaagcgggtccttgtatttccaaggaggggcatccaggctggtcctctcgtgcagagggggcactcacgtggatgagcattgccctccgagggcctctgccttgtcaagggcaccctccaccttggccaaggccctgccaccaggtctggcctttacaaagccaagtcctcttgagaactcacgtgccacgggctatcaggatggatgcgaattgacctacatgttttgtgggactataacacccaacaaccta

SEQ ID NO: 84498 - DNA, 1048 bp, Homo sapiens
attgtcaagcttttccggatgtaactgtgagagcgatgttcttttgtgactttctacaccctaagtggatgtgggccccagaatagctctgacgggaggtgtaaatcatatcagaccagcaggcggcaccatggagcacctgccccaggttttcctgcagtagcagaattctgctggtgttggatgggtctggacacacctcctctaccttgtcctctcttccagctatgtcagctctatcctgaagagaacttggagaaactcattccttgcttagctggtccggacgcattttatgtggagcgaaaccacgtggatctggactcaggcctgaggtgaggcccttaccaggcacccggcgcgtccacagctggcaaggacaggctggtcctgtggtcaatgctgtggtcctccaaggagctctgggaggatgcgcggtcacctggacctgggtctctacttggcctctagggatttccattagttctggaggattcgggagccctcagtaagctgagagtggttctgagtgtgtgaggaagggaattccagggtgggtcccaccacgtcttgggctttggcagtcctgtgaaataatcctgggctgctgtttccatcctgtagtccaaggttgagactattcccagataaaattggcgtctcttaaacagtttctctggaccctcgatcgtgtcttggctcacgtggcacacgaagtaacatggccgaccagttccgtaaatgtgctgctgccggggccctggggaccagtgtccaagcacctttctggctggtgggtggcactgatctcatgtcacagggcatgactgctgtcgtcaaccttggtggccatgaatacagcattgagaggaagggcttgaagaagcagtggcagtcgggcaagaactcagttgaattaaagcaggaagaatatgaggctctggcacttctggcttttttcctctaatacacatttctcttgattaaaagttaaatttttttctttcaattcgtcagcaggaatgccattttaatgttgataagacca

SEQ ID NO: 84499 - DNA, 1028 bp, Homo sapiens
gccgtgtgcagagctgtgtaggtgtggcctcagccagcctggggagctgcagctggaggtggcagggaactctgtgctgtcagtacagagcctccgggctggtgcatttggtcagcgacaggtatgggggagcagggcctggtgggcaggggcggggccccgcctgagctgcagctgtgagggccctgccgtttgtgtttcagcatcctcagggtatggataatgaactgcttcatggggctgatttttttaagggggtactaaaaaaaataacgtttttaaagtttttggtgcaggagtgtggtggggtggtggtcttctttaggggtaggttctgtggaacagttctggaactctctgtggcttgcattgtgagtgcctgaggataagcactgtggaaacttcagatagacacaaataccgtgaataaacctgctgaaaatgtctgtccaaagatcagcaacagcttttgcttcgttgcttttcgtaagctgttgaaaatcattgcagttcagaggtgaaacatgggatagttcatcctctggttatcaggcaaagtataagtggtttcttttggtttctcctttagccctaaactctgggcctattgcagccaagagtcatctagcattccataagaacggactctctctggagcagctgttgtcactgatggttaaaggaatagctgtgacctaaaagcactgttttgtctccatctttaacacttgttctcctgggcagctgggaaccgcctggtctatgaacttgtctgtgaactaagtcttctggctgtctttgtatacattgctttttttgttgttgttgttacattacaggagatacaggagataatattctaacacatagtggatctttttttatttttatttttattttttggccagctgctacaggtctaaaacactgtcctgtttcatagtaaagtacagtacatgatacgggaattgaggcatacagtcatgtgctgcttaaggacacagatacgttctgagaaaagcgtcctc

SEQ ID NO: 84500 - DNA, 1053 bp, Homo sapiens
caaggcatgttttatagattgaattatttacatcttggctatgagcgtttatgtgttctaaattggtttttgagtagttacttggagctgacaatttttttgtttcatctttggaaaactggaagattctgtgacccttaatgagaggattattataaggagtaaccttgggctgtcatttccgtatttcaaaacaaccgtggtttctagttttccctacatccctagtgtcactgctaagctaatttcagccccattcatttaactttcgtttctgttgctgcttcaaagctaaggctgacgttgatgaaccctttattgcttggagcatgcaactcagatgaaatctagcatttaagtattttgctttcttagtttctaaatctaacgtttggtgtattcctgaaaaagcagccccgttaaagctgtctgcattcttttgtaagctgttgtattttattttgaactctttgagcttagagactttgtatttttcttttagagatacaaatgtcaatggctttttaaattctttatccaatttgaatttttatttcttggcctggcaaggtggcttacgcctgtagtcccggaagtttgggaggtcaaggtgggcagatcgcttgagcccaggagttcaacaccagcctgggcaacacagcaaaaccctgtctctacaaaaaatacaaaaattagccaggagtggtggcacacacttgtagtccctgctacttgggaggccgaggtgggatgattacctgatcccaggaggtagaggctgtaggtgaggtatgatcatgccactgcattccagcctgggtgacagagtgagactgtgtctcaaaaaattttttttaaatttattttaactgtattttccgaaatagtcattatttgcaattccttgtccaaatcctgtgtttttatttaaaaattcttattattctgaggacttctagaggtgtaaaagtggggggagtacaaagtagacatacctgtattttactttcagaaagaaaaatacttccagtagccacactgatggtaggctga

SEQ ID NO: 84501 - DNA, 1054 bp, Homo sapiens
attttgtttaccgtcattatttcgtatgcctgtttcattgcaagaccttagaattggacgtagttaaaggaaagtttttccgtgagaccctcatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctccagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagtttgtggtaacgtggaagattggaaaaaaagaaacaaacacataaaaatgaaaatgcaagaaataggatgtcctatgttctaccaggaagaataaggagtctgaacagggatgcaaaaccgagatatatggaataattcagggtttctcatgccacagtgggggtcctgaatgggagcaccacagggcagggacctgaggaggggcagggcaggtgtgtgtgtccctgaaggagcggcagaggcttctgggggtaggcagtgcctgagttgagtctggaagggcagtagggtgagagttgttatcccaagcctgaggctgcagatttgttcgaggccatgtctccctcagcctcagcttccccatctctatgatttagtcatgacatttttttccttctcaacatgtgccatctccctcctacctatgaatgtcacgggtattgttctggacccagggaaggctcgctggtgcaaatgctttccaaaaacaccgagagtcgctctctctgc

SEQ ID NO: 84502 - DNA, 1240 bp, Homo sapiens
tgcgacgcagccagggaagtgggacagagagggatggacagctgtcctgcaggaggcagcctgacctgagagctcccctttaaaaacgtttggtgaggaagggcccctctctggctcgccgtttgtagtaaatgagctgggcttgtgggcctgaccgtctgtcttgcttgggaaaggggaggaagcccctcagcctggcttccccagcccttctgggagccagcactgtgggtgattgggttttcccagggtgagcgtcggagcctgtggggctggtgccctgtgtgtggggtctggtgggcctgtccacctctcagtggaggtgtggagcggcccctcagtgaggacacgcagtggggggttttctgccccagcccaggagtgaacggcgaggctagtgggagacaggagcgtgctcctgcagcccagtgcctgcacccagggcagtcagggatggcgccttcctgggtcacacactccccacgcttgtgggtggtccccgcaaacccttgcctggccttgtgggcatagcaggaatgacccctgcctcgctgaagctgctgctctctgcttcctcggtctattaatagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccaggtgagccaggcagcttggtgcctccgtgcccgggagcgagagcccacggtcgtgtgtcgcgtccctcgaaagcaagccctgcaagctgcccagaggcggcctgtgccgacacttctcgcctgtgctcctgcctccacggtcagattgacggagaacaggaccctgttgtggaaaggggggcccaccctgggcacgtctgtcctttgtcccgggtgctgacgggagctgcggctctggcggcacagga

SEQ ID NO: 84503 - DNA, 1047 bp, Homo sapiens
tgtgctgtccaggtttgtagcctataagcattgggctctcccgtcagtgcaggcgtgtggcaggctgtgccttccagaagtgtgtgcgtgcactcggacagcacaatgacaaggtcgcctaatgatgtgttgtttcccagaacccgtctctgtcattaagcagtgcgtgactgtatgttgtataattttgtaaggtgtagactgtaaagtcactcagagaagcgtttgcatgcagagtgcttaactcagagaagcgtttgcatgcagagtgtttaattctgactgtaccctaagcatgtagagttttctgtaaatgtcaccacagcggcccagtcgaggggcctggtggtgacactgcctggcagcttgccctgcttggagctccatcctgcacgcagctgctgagcctcgaggcagccgccaccacgacattcccctgtattttgtgctgtccataggcctctggctgaggaggacatgtggattttttaagacttcgtatttaggaatgacagcagttttgagaagcctgttggggtttcaaatataaatgggctttttaaagtagctttatttttctaaagagggacgtggaatctttttatagaaaattttccccttttaggtagaaaacggtgatatttggctactgccacaaaaagttaattgagtccgttgtgtcagccagaggatgagactctggtggggttcccatgcaggcagtgaaaggaggccccgccccagcgcagttagggcagcggggggcgccccatctatggggctgcagcaggccccaggcctgtgttccctcgctggttggggacggcagtggcagcgctcggttctcctctgtcattttttgaagcggacttggatgcagacacactggtttagttttttttttttcttttttttttttttgagacggagtctcgctgtgttgcccaggctggagtgcagtggtgcgatctctgctcactgcaagctccgcctcccgggttcacgccattctcctgcctcagcctcctgagtagctgggactacagg

SEQ ID NO: 84504 - DNA, 1167 bp, Homo sapiens
tggagaatccgggttctccaacctgggcacctggcgggcctggacacctggcccaccatccacatgacggcccctcccttccatcccaccctccttctgggcctggcctcaattcctcacagcctaacctgagtgcaagacacctggcctcgtctccagcggaaatgcaaaccctcaccccgaaggtgctgttacactcatccaaccttctccctccagccagaaacgcctgcattcctgtttctcgcgcttgtgcagccacaccaaacaggccctgcactgacctgttcactgcttggggtccagtgcctacaagccccagcgctttgccttatagccacagggtgagtatgttctgcaagtgggaactcaactgcgccatgaaagccagccttgtaaaacacaccggcaccccaggtggacagatcgctcacaaaactagtctcaaccagcttcattccagattaaatcctctctgggtcaaagagggtgaggaaaggttccagaatttgcctctttctcattgacctctgcaaaggctggctggggaatgggtgtgtggccctagcctcacccccagccaagggagggttcttacccgtaaaatgagaccccaaagtcaaggccttggtatctggctgtgacctacctctttggtcaccgcccctccaagctctctgagtgtcgtctgtgctaacccgagcccaccccctcctcggtaggaggccccagctaatcccgctgccgttcccatgaacggcaaagagaatccgcttaatccccttgacaactcctgacagctgggagagaggcgtgggcaggtctgggtgaggacacggtgggcttggacccagactcccccggagaggttgcacgctctggggctcttcgtctccagggaggtttcgccacgttctcctgcacaactcaccgcgccgatttcactccttaatgaccgtgtttcaaacgctgccagggcgacgcttcatctttaggcagccaggggccagaaggagcctggatcctccactggccccctccctctccttcagcggccgtgacactttccccagcgtccactgccctcttgggacggtgtgctctggtctcagaattcaccacgcagaaacgaggcccccactcctgacatcttctgttgacgctgct

SEQ ID NO: 84505 - DNA, 1298 bp, Homo sapiens
gcgacaggtcttccgaggacccgttagcagattggcccctccggccctgcctgctgtgaacagtccaggcatgtgtccaggtggtggcccgggtgtggacctgcaggaaggcctgtcatccccccgttgcactttgctgagacaccagggcctggttcgtgtgccccaggggccgcactctgcctccccagggttctgaagcaggcgaggggtgggccgagtgggatgtggcacttccgcatttcagttgaagacagcgcctcgggcacccggcacccacatgcgcaagtacacaagggaaggttccttaaaatcccagcgctgggcagcggcgctgggtttggtgacagcagggctgggggagccccagctcacgcccccgtgtcccacgggtgcctacccagcccccaggctaacacagctgtcttctctcctgacagtctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcaga

SEQ ID NO: 84506 - DNA, 1048 bp, Homo sapiens
gcttttgctcagcgctgtccacagcggcgtctccaagagggtggtctcctggcttattagtgggtggccactgtctcctggaagcatcaggcccctgtgcgtcctggcggctcagggtttccaggcctgtgatgtgggaatggagccgtgaccttccctgcccgtgggaggcctcgggagacgaagctgtctccttccatccctcatcataagccgcctgagcccctggcaacatgcccagcactgtatgcagagtcgagggcgggacagcccggtgtgtgaggcagatggagtgcagatcgcatcttggtgacctggaagtcagcagccgtgggtgtggagggcccaggagggctgaggaacctcggggcatgggggagggaggctggacaggagagggctcacccaggccctgtcctctgccccaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatctgtgagtatctcgctggcccacagcccgtggtaccctctgccctgggcagcgaagggagttgagaggcgtcggccgtctccacccacatggggcgaagcgtgttgggtggcaggagggttcaggtcactgcagtgtccgccagtgacacgcagcccacatggttcagggataagacacacagcgcagcaccagctaatctctcaggacgagggattccggaaaaccaggctactgctgccaagtaacaaaatcctgctggctgccaccagcggacacagcagacttacccagaaaggcagaaagaggcagaggcaggcggatcacttgaggtcaggagttcaagaccagcctggccaacatggtgaaactctgtctctactaaaaatacacagatcagctgggtgtagtggcacacacctgtaatcccagctactcaggaggc

SEQ ID NO: 84507 - DNA, 1049 bp, Homo sapiens
cagctgcacggtcctcgggagcacggctgtgccgggggttacagaaactgttttcttggtgaccactgggttaggtcaggttgtggccctcgcacacagagccacagtccagcagagcccagctgtgtatgtacactgtgttcttcacctgtccttaacccaaatgtggtctccatttcctcctctcctccctccttccctcctctcctccctccttccctcctccccgcctcttccctcctcctctcctccctccttccctcctttcctccttcaagaccttgcatgttgctcagatgaggtttctcctttaaaacaaaattccctggtgctcagctgggcccagccaggctggacagtccccggtggccaccacggccgtccacagccctgctcgtgggccccagggctcagccagccgcctctctcttccagtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgagcccggggcctcccgctcacccaggcacccttcacagaggcagggtccgtgggtcctaaggaccctgagttgggagccagcatcccagctcagcctctggacctgcccctgcctgcatgcacctgggtcgactaattccggtgatgacttgaccaccagctacgagggtgccaagtgtgactgcaggagccggggttcctcaaaggacagcagatggcacagagcttgtgctccgttgggtggagggaagcagataaggacactgcagtcataggtgggcggtggtgagccccggcaggggcggggcagagccgggcctggcgcagcattcaaagggccgtcggggctgtgctggcaggaggaatgcagggaacccggcccgaggagcgcctgggcccagctggactctcctggactctccccgtccccagcggctcattcagaggggtagctgttatcc

SEQ ID NO: 84508 - DNA, 2940 bp, Homo sapiens
ctctggggccagcaggatgtggggcgggtggcttctggccgtgtgtccttgagcacggtttctccagagaacgggtggcaagtgagggccccactcagggcgggacggtacagaggagctgcctgggctctcggctctggtccccggctgtgcagctcgtgggcagagccttagaattcagaccaggtggcctgacttaactctcctgagcccttgaggtcaccccgaagaatccccatttctcaggtggggaagctgaggccgcggccaaggcaccagccagggctgtgcagtgtcccgctccaggcacagcctcctgccgccagcctgtgttctcttgctgcttcccaccttccccgagaagcccagcacagaggctggagctactgcttgcgaggagcccacctggctcctgggcacagggtttggccttcagcccgggctgcgttgggtgacatgtcgtccctgttctttccagaaacctgcccctggccatcatcatctccctgcccatcgtgacgctggtgtacgtgctgaccaacctggcctacttcaccaccctgtccaccgagcagatgctgtcgtccgaggccgtggccgtggtgagccgctacccgccagcttccaccaggggcctgagaggctgtggccagcccgtcccttccagaccggagtggtgccccacatctctaagcctcccctacgcagagggggccccgcgtctctaagcctcccctacccggaggggtggagtggtggtctcccctcacagcgaccgcagaggaagtgtctggggatcatcctcaagctcagctgctgggggagtcaaaggggagaagggtttaaaatctgataccaagccacacccagaaccagctataagccagaatgcctggggagtccagggcagaggtcattttaaatctgagtacagaaagattggagtctgccacagagtggggttcgttagaaggcacggctgctgctggcttggcaggcgggaggccaggcccgggcggtgtcaccgggcagctcagccaggctggcctcgcagttcccgaggcttctcccactgccctcccagggctgggggaacagggagtgggtgctctggccagcttcctactgaacaagctctgactcccagcccgctgccggcagggcaccgtgctgagcctgtggaggaccccacgggggaaggcaagatccccacctgcaggccgtagcttgctccagggagtcccagaggagggggcaaatcaggaccagcaagggctccccaacaagcaggctgggcaggggtcactggaaagccctgtcctgggaagtccccccagaggccagaatccagcctgagaggtcctctgcagagggctcttgtgagcacagagggcgagggctggcccggtgcagagggctcccagtgagcacagggagggcgagggccggcccggtggggcccagctcactggttgtgcctgcctaggacttcgggaactatcacctgggcgtcatgtcctggatcatccccgtcttcgtgggcctgtcctgcttcggctccgtcaatgggtccctgttcacatcctccaggtgagcacagcccgacccaccacaggtgagggaggcccaggcctcatggccaggttcaacatgttccatgtctgtaaaaggtttgtctctgtgatactggggatgcataattgctcaaataggccaggcatggtggctcatacctgtaatcccagcactttaggaggccgaggtgagcagatcgcttgagctcaggagttcgagaccagcctgagcaatatggcaaaaccccgtttctacaaaaatatacaaaaattagccaggcgtggtggcacgtgcccgtagtcccagctacttggggggctgaggtcgaaggattgcttgagaccagaagattgagactgcagtgagccgagatggtgccactgcactccagcctgggtgacaaagtgagaccatctcaaaaaaaaaaaaaaaaaaaaggcagcagcaagcccaaataatacagaaataaaggaagcatgaactttggccctcgcctccccactcctgcctggaggtgacacagctgtggtgtcctagatgccctgtggccgccgcttgaccccccgggctggagtgagcagtggctcccaagttgctgtccttgccgagttggttgggggaactgagaggcccacagccagcggctggaggggcctggttcccactgtggccagagaggcccagacaagccaggcacaggccctgccactccccagcctgcgtgtcccctgtccacgtgctgagttgtggggcggtggctgactctgccactcttgtctgtccacaggctcttcttcgtggggtcccgggaaggccacctgccctccatcctctccatgatccacccacagctcctcacccccgtgccgtccctcgtgttcacggtaagcctgctgcacggccctgtgccctacatccctgggggttgtccgggggctcccagagggaggctgccacagcttgcagctctgtctggggtgtggactgggtgacagctcaaatgtggcctcctgccgagctccgctgaatgccagagagcgctggaggggctttagattttattccaaaaataatatatggtggctgccacaaacgattcagaccatcggaaatgcgggaggcagaagctgacccggggtgctgctctgccagccgcctggctcactgcacctccgtgggcgcccactctgttcgtttctcagcggggtgcatcacacacagtttccttccgcttctcctgcatctttccgtgccagcccgcgtgactgcctttgttccctctggctgtgtcacacatcactccaaaatgtagtgttctaaaaggaaaagcacttattatctcacagtttccgtaagtcaggaatt

SEQ ID NO: 84509 - DNA, 1028 bp, Homo sapiens
tcctcgcaccccaagaagcagggccctagtggctctgggccttccttgttgccgtagccaggatgcaaaccgaggtctcctggctttatactgccttgacactcatgtcgtgaggtctcagggaaccttcttgaaggcaactggggctggttgacccctccatcctgacctcctgtagacaagcgtctgaggagccctcctgggcagtggtcagaactgcctgtgccctctcaggtgggcacagggcctctggcagggccacatccccctggttgtggttggaaccctgcaccctccatgtggctcagcaggtacataccatttgtcacagtgaaaagccttcactccagcatttttgtttgctatgtattttgctccaggaacattctagaactggtagcatgacctctgttcagcgctctctaacccagcattcctttctttggccctgccaggtgatgtgtccaatctagatcccaacttctcatttgaaggcaccaaactggatgtggggaacattgtgctggcattatacagcggcctctttgcctatggaggatggtaggttctggaatgtctgggtcccttggtctggggacatacagtccctgacgtgtccaggaatcccaaatctcccagccatcaaggggcagttaaagggagtggactgcccctccctttaactgccccttggcagttaaagagtggcaggtgaccctccagagtcacccacatcccgacgaagcgtggggaggccgcccgctgcagccctactctggctctagctccacgtcgcagtcttggcgaaggtggcaggtggaggcggctgagccctgcggcccctttcctccaggtccccagcctgactcctgcgctcaggcgggcctcacagggacctgagaatcaccccagtagggcgaacaggcagggaatgtgcgggagggcctggaaggggtagcagggaccccccggaacacgcaggaggctgagctccctcccactccaggtccgctttccagcccagcgag

SEQ ID NO: 84510 - DNA, 1015 bp, Homo sapiens
agcagtgaccagagagcagagggggcctgtgtgtgttttgccccagggtcttcaggctgcctggctgcctctatctgccccctgggtgtccagcaccacccccccaaccgctggggtatccagcacctgtaacctgtagccccgcttctcagtccaggcctgttccagggcccccctggggtatcaagcacctgtagcctgtagccccacttctcagtccaggcctgtgtaaaacctggccccgggttgggttttgggatccctgcacccctccacccccaaccccccacagctgggatcctggctcagctggcaaaggttctgcgtgtttaaggagctgggtgggccccagagctcaagccgtgggctcattgcaggcggcagccagtgattagtgctgaaatctgactttcccagccgcacatgaaagtgccgccggcacctaggcaggtcacgctgcatcacgggattcggggcaaggccgtagggggagctcacagaagcacatgacctgagccacacaggagagcctaacgggcacttgtgacccttttttcttgggtcacagacctctttcataatccagcagaatgtgcagaatcttgcccagaaatgtgtatcagccgccttcacacagaagggtgggttgcgcagacccccgggggcccaggccaggttgagagccacccccaggagaggggtgtccaaggtagggcacactcttggaccacctcttggcacctcttggccacctcttggccaccactttgcactccagcctttgaagccagtgataatccccaatttacagctggggaaactgaggcaggagcgagccaggagccaggggccacagtgcccacctctacactgaggccaccatttgtcatcaggcataggggagcacaaagccacgcctggggagtctggtgggtgccaggggtctggggaggtgtcagtcagcaagactgggtggcccagtcggcccaggtaaggacacaggtgggtcagaggc

SEQ ID NO: 84511 - DNA, 1186 bp, Homo sapiens
aggaggactggggccttcgaggaccacgcgggcctgggaatagcccgccaggctgggccggacgacgcacgtgctccgagctgggccgagggggcggggctgagggacggggccgggccacggggcggggaggagccgcggacggtgggcggggccggcgggccggggcctaaaaggcggcgcgggcggggttcctgacgcagctgcgggcggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgcgtgagtacggggcgcgggccgggggttgggaggtcgtagtctctgggtccctgcatccttgcatcactacgcccctggctcccacatctctacatctttacgttcctggaccatcccggcagttctaggctaaggtcattggtcccagaaaccacgtgcgtttctttcattcattcttttacacttctccccacaggctgggaatatcttcagtgacgggacagcagggtccctgccctgcccttcggtgggcattccattcccccacttaagcggtttaggcaagtgccaccctcccgttggccccgctgagcaatactcccagcctcttgcgtggcacccacgtggagtaactgagcaatcggt

SEQ ID NO: 84512 - DNA, 2207 bp, Homo sapiens
caataggaacgtcaatgaaagacttacaatgaaaagcaatggtcccctgccccacctctcagccccgttcttcaaagaggtttacatcttgagtggtttctttaggtcattctccacagctctgagtaagctgatcctttttatttttttcttgagataggatcccctgatgttgcccaggccgtactcgaactcctgagctcaagtgatcctcagcctccttagtagccgctaatacaggtgtgagtgactgcacctagctctaagctgatattttgtattacacagccttgtctttctattacgatggggtgatggagcccttctgtcatatcccaactcttctatcccctggactgtctgtgttaggcctatgcaaatactgttctcttcacggacaaattgagtgtttcccttcctgtacagcgtggatttttctgttagtcatggcttttctcttggcactttctgttcccatcgactccttacattgttttaaattctcaaggatagtgtcaggtcccctttctccttcagcccctgtccttctcatctggatgggttagcttgcacacgagccagcctgatattttcctttcttctgtagctgggtatgttcaggaatgttttcatcttggctctgttcgtttccacaggaacctctggcaagtgctcttcctccttgtggagacccctctccctccctgaacgctcttggatcttctctttggtgttaatgatgttttacccttgtgtgtgctgaggtgtgtggattcctacgccggggactctgactctggtgctttgtccttcagctctgggaagttcccttgttctgtctgagaagttcttcctctccagctctgctcttctgtcttaggagttcctgtttgtgatggacgttctaggtggagccctggagttgcgtctttatccttccttctgtgtctcgtttattctcattctgggagagggctttaatatgtgttcacaatcaaatttttaatgtccaagcatgtatttgtcttgtttctttttcatagtagcttattgttacacaagtgcctcatctccatgactctaaggaaactaataaggattcttcccagctctcctttgttctgatttcttgtttccactaatgtcacttaaaaaaagtgttggcttcttcctctttatggcaagtcctccatactgatgtttactgttgtctgaggcaggaggaagctggcggagagccccgggtctgtggggtgcttttgaaagagtccagtttcccctcgggtgattgggagcctgtcaccgtgggacctggagcaccaacttgcagatattttctctgggctgttccgcttctttaggaaggcccctttgctggccgtgggggagttagctctcctgtgcgggaccgacttggcaggtgcgggtttggcctgcccgcagggctctgcgaggcttggagccccacgcctgtgcccccggtgctttccctctgccctgatcgggtcctctgcatctgtcaggagtgtgttctttcttgtgggttgataacaccctattaaagatgatgttaatggagtgagaggaggtcacccgtacggccagtcactccccttgagcaggaatttgcaagcctgttctattcactccaccttcctgcttccttgtggccttggtaattgcccacagtcaacggggtgaggtgccaagccgccgttccacagccgcctctgaattgcagcgtgggctggtggctctggccctgtggccttggagggctgccagcgtacctgggcaaggcccggcagacccgtgtggtagcaaagaccctgactttggctcctcgctgggtcagtgtgccaagcgggccgtctgccctgctggggtccaggagggcctgcagtgaagcagtggtgagcgtactgggagcatgatctttctgcatggtggctgactgtcactgggaggttgtgtgtagtgcggtgggctctgtctgccagagccttgccagccgagcgtccaggggccagctgtgtccatcagcatcacttgggtatttgtgagaaacgcacactttcaggccctacccaggttctcgtgcagaatcagactgcagcttggtcagcttttaattttcagatagtttttgactttacagaaaagatgcaaaaaatatttcactgagcttccctgttgtcttcatctgc

SEQ ID NO: 84513 - DNA, 1706 bp, Homo sapiens
ggaagtagagaaacactctccgccaccctccatcctgacccccgtgcagaggatgaagtgctgtcccagaagccccctctcaggggtgccgtaagtctcagagagaggagcaccccggggcctccgtggcagaatcctgtgagtgtctttggttaaaatgtgcaggaagtgttaactcctaagctgccagcagatggtgtgccgagatactgtgaagtcacatgaacttgattcctgttggaaagaaccactctgcaatccttcgcgtctacacttcgtcaagaaccgtccaatttgattaaacattctggatcgtcagcgttcacggtggagcagactccacgactcgctgctcccatgggaggtgtctctctggggaaggggtcagtggtggtggaggatggcgcggtgctccattcggaacccacaggtcgccagcttacagcgtgggagctgtggaaggacacatggagcagaggcggctgaggaggtgaaaggctgagaggaggctgcagtgaaacacctgaggaaggctgggcagaatggatcgggggtgtgtattggctgcagtcacctcccctctgctcgtctgtgtccacattctgtcgtggttgagaccggatcctgtgtggaccgggtgggctggtgtggagtcctgtcaggagacctggggcggttttgaggcaagctcacggaggcctgccgcagggccctgcgctgacaaacctttcgctagtgaccagttaccttctgtgtctgagagaaggccgttgtggcctgtagtgattttccttttcccttgagatgaaaagtcatcaaatatctggaagcaaagcttaatctttctgaaagtagaaacgcgtttggatggagccgggagggagaactgggtgcgcgcttggcatttccttgccggtgtgaatgcgcttcccgtaaatatggcagaacgccttcacctttcaccagatgacgcggggggaattgggccacggtccctgctgtcatcatggcatgctgcaagctctgtgggcgctggtggccaggatgcggacaacccctgccgctacgtgtcctcaagtgagctcagctcttgtgtcggtgggagctggcggtgggtccctgagcagagtgctgccgctgccagtctgcgttttctgccgaaatgcgtccctgagattgagaaagttcacaccctaagtgtttttagaaggctgggtgccctgtttcccagccaacagttgtgactgtcagtgggcaaacacagtttgcaataattggcctgttgtcttacaatttctggctctcctctttgtggtgtaggtcatgttaggtggtggtccttggtcgtttgtgccacgttccctcatgttcttgaactctgagtccctagaaactgacattggtcttattttgagtgcattatttttcaaactttgggtctgaacccacatcaattgagtgggccatggccagtgttaagaatactggataaaatggagcatgccttggataaaaggagcatggttcggagtggctaacgggtaggtatcgactcaggaaacttgcagtgatgagtgtatgaacttaccatcgtaggccccagtcgagagcgtggaaaccactcttctgtgatgtgtgtctactagcgggtggttatgcacagcatttgactgaatttgggtaactctggatgtagtgtataaagt

SEQ ID NO: 84514 - DNA, 1025 bp, Homo sapiens
gaccaaatcccaagtcagggccacagggggtcccgtcaccttttcccattaggcagcgggctgtgaggcgaatgtgcgtggcctgtggcttttatgctgtgtcgatgttaggtgtaatctgtttttattgttgagaagatttgactagttttatgtgtaaatttactgattaataataacatattaaagtacatttttaaaattaaatgggcttaaccaagaattgcaactgcacgtagaagtgaaaccatgactaaatcatcacatttgaaacaggacgtgtgactcgtgtgtaaaatgtggacgtgttactcacatgtttctggctcatagctcacgggctatttccagtgtggggattgttctgtctgaatagatagagttgagatcaggaaatagctgtttggtgtttcttggggttgtcttcttacagttcaggagacccttcctaaagccggtcttttttcacttccagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatggtaagaacagaccagggtgccggggccttcaggtcacttggggagaagcgcgtcacctcctcgcccaggcccgcagcttagtggctcagtttgctggagatgcgcggtgtctgcctcagcagtctcagcagtttctaactaaagctgacttttagttagaccgaaaccgaacacatggcatcctgccaggatgacctgaagtcatcctcacgtttcctttccacataaagccgacccatgcaccttttctttggaactaacccaccagatcttagaaaatgtacatgtgcttctttcctttttcctactctacctggctagtctttacatatgtttttcttcgtatgtgg

SEQ ID NO: 84515 - DNA, 1052 bp, Homo sapiens
tgttaacgttaggtgtcaccaataacaagtagaggaatttaaaaaataatatttttgaatgaaatggagttgattatgcctttattttaggagaaaacctggtggtcctgtgatttacttgagcatggcgtggtgctgtgctggcactcaatgtggggacagttacagtgatactaggctagaatttcctatgtgcagatcacagaaaggcaggcttcccaggttggtttttggagagtgaaatccaagaatggagttttattgtcaggtgataatcacgttgtgtttctagtgctagttctttctctccccagccttccacaacaaagcggaccttagatatcccttgtgaccagaaagtgctaaggcttaaaaacgcatgattgaaaactgtgggtgagtctgtactttgagatgaagctgtgttagctgccgcctgtctgaacacactcgtgcttcctccagggtggcgccaggcttgctggtttctgggccatggtctgttcttttgtagaatcttttccttcaaagcagaaccctgagccctttggttgtagctcacacatgttcctgcaggacctggaggcagcatgtgtgtccttccatcccaagtccaacgtgatgtttgcccctttctttccagggcgctaccgttttggaatgataccaacacttacgtggttacgaacgttagatctgtcccataggaatgagttgggatggagtgactgaaaatgtcaagccagttctcatgcaagtgtgccaccctagaagctttattaactgggtgcgataacagctggtgcggttgcagtctattctgtcacaagttcagcatcctcagcccagctgtcctgtgctatccagttgtgcagacagatcaccaacaattaggaaaagttacgttctgctaaaaaccccatctccagtttattcttccttagcatttggggctccttccccctcaggacgggtccctgggagtggactatgttgaatgactcttaggcctccccctcagtgcgggtccctgggagtggactgtgttgaat

SEQ ID NO: 84516 - DNA, 1048 bp, Homo sapiens
gctgggcgatgctgaatgctgagtccagccacaccaggggcagctgccgccggggacttctgtgtctcgtgctggccggggttgtggagggggctggctctgtctcctcacagcagtctgtgaaagcgttcatcctcccacctagctcagtggtcctcacgtctgtctgtgcagagcgtgtcaggcaaacagacgccctctcccacggttgctaagtggtgcaggcatgttgagtttatgacttttttcttatacctttttctcttgagacattttgaatggaactttggtcagaggtgggagtggacagaagacaccgtccccgctctgtgtgaggggaaggctgtgcagtggcctctggctggcatccaagccctgctgtccccaggagtgcccctggggctgcgtgaacccctgaggatgctgttgctttttctttcccatctgtgtcttcacaaagttctatttgctttttctctcagtctcctttgtggattcctcctcctccagcttcgtcccctttctgtattgtcttagctcagttctccagggccgcagctgtggtcgcaagggtctgatacgtggggtgaagggagaggagttggtgatgggcggtgaggaggtgccagggtcagctgtgcctcaggggctttgcactgaggtcagccaggcagatggccagtgttgagatcaggttcagcgtggacagcgctctagagaatccaggccagaaagtgcagagtgcagcgccctcctctgggtgcggccagtgttttcaacacccttttttttgactttgcatatagagaaattgtgctcctttctcctgctggtgcgtagcagtccacggtagaggatgttgaaagggtcactaaaaaagggaagtagtaagtctctaaatcatccttttttttgagcacttgtggaggtggcctcgccctgctttgctagcagtgttctgtccttccacatcagcagcccttgggatgatggcagctccgatgggatctcagtgggttttttaagccccgtcagggttttttgcccg

SEQ ID NO: 84517 - DNA, 1026 bp, Homo sapiens
aaagtccctgattttagagcgaggtcaccctatcaggagcccaccgggttttcaaagttgtcctccaggagtgtgcactttttgctgttcagggtaccccccctcttcctctcccctccccttttaatctttctgctccccttttcccatcccaaatattcattaagcatccactagtacctgatgggaatggaggttcttttgaagcatccgttatgtgatatcgtagacatctagccagtagatggccagagttggcgtgtttgggacaaatgtagccttacctttatggggtgtccctagtccccaggatcctggcataccccaacacattatattttcttgtggggcacataattatgaggagcccaacagataaaatgtctcatgcgttccacatagaattcttattctctaccttgaataggagagatgagttattgacagttatggttcatcacgtcctggcgctggaagcattttgagccgtgatgtgtgtaacgacacagcccggtgctgcctttaggtttgaattctgtgtgggtttgctctgtgttatccattgttggaaccatgtatttcattttatgcagagttgcttttgaaattcataaacagcttgagtaagcctttgcaaaagccagatgaaaattaatttttggcgtggatggcatatctaatgtgaatctgttctctgaagacttacctggagatggtgaggctgaccttgaactgaattgacatggagttggttgtgttgtggaacgtaacaccatgctctaaggctctgaacaaccgtgcagcccagtgactcgcaaaggatggccttctgatttgttcactatcctgctggagatggaaatctggcattcgtcacctctgtgactgcaggggactaacgtgtggaatcccagggacaggaacactctgagccatcgcctgaaaagtgaccgtggagctacatttcccaggacattcatggaagttagggcttcggtcttggacaacacacagataacatttgtc

SEQ ID NO: 84518 - DNA, 1090 bp, Homo sapiens
gcagctggcctggtggcaccctcaggggcagccagtgcgtggccagcggctccaccagtggccgggagccgaggccagaggcttgcgcggtgcgcacggagcagtggagccgcaggacctgtgcctggccccgtgcgcccttcacacggacagcctcgggcctgctccaggctcctccgtgagggacagagggcctgttgggcctcccggaagtcttctggatgggggcaaggaggccgaggcctttgcgtggggctgccggccgttgtattctcacgatttgccgggtgactccgggtgaagaagtggggtggattctgaattatgctttatttttgctttgagttcatggccttagttggatttatccacaagataatggaaacagttctctttgagttgcctctcaggcatcgctggggggattgttctccttggagaattttcactaggaatgacaatgtgacttgatactgcctttcacccaagacatctcaaaatattttagtaagtatttgaatgaaaactattctcttaaagctccccacagtagctgcattggcagcgactcttggaacttgagctgtgactggggctggggtcaggatgcgagggcagccgtgggcagggccagctctcctattcagtggagtctttgttggcgggaaccctttgttctggaagtcctgggagttgcagaccagatcacctggagttctcccggggcctggttctttctgaaccggacttcaggaagtggttttctcgggctgttttggtagttatcagatactcggcctcagctgctgcccaggggcttgaggatgggaggtggctgcctgtagtgggccacacaagttgtgtccctaaagcagcgctttattgagtgacctgtgttgaagaagctcttctattctaggcctttctactacaatgaggaattctgccttgggacttgagagaggtagcagtcctggggtgtgggttaagggcattcactgaaataccatgtagcagcgtaacctgtggctattgaaatgcggctgtaggaatattgcgcatgacttgaattctgctcttgaatattcat

SEQ ID NO: 84519 - DNA, 1058 bp, Homo sapiens
cccggcgggcgggcggcccgggcgggcctgcggtcgggatgaggacggcgcctccgctgcagagcgctggggcggcgcgggccgggagctcgttggcggcggccggcgtggcgggcggagcgggcctcggagcggaggtgagtgcggatgcgccgcctgggcgcgcgcggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggccgcggagcgaggggctcggggagcgggacctccgggcggggctgcggggagcggggcccgggccgccccattcatcgcggatcggagccgggggtgccccagccgtgccgccgcctcctccgggccgcccgcccgggcgtgctggccccgcggcgctccgagcgcggcataggcttgcgagtcggcggtgtcagcgccccggacgggggtgggagctttggagcccaccctgggggagaccacgccgcacccccgcccagccccgcgcacccccagaggcttttgcagagccgggaagttggctggacgtctagacccgtggggacgcggcgccccgcgtggcggcggccggaagggaaggccaatggggctcgggggactcccgcggccacccagtccttgtccctgcaccctgggccgagggcagagggacaggtccccggcgggggcgggggggcagctcagctgccaagtccgctcctgcagcggaggcggttaactgcttcatccccagccgtgagccatgctgggcatagggagtgtgccacgtgttatcacgtttaatccttacgtcctgagatccgtgtt

SEQ ID NO: 84520 - DNA, 1143 bp, Homo sapiens
gcccgggcgagacccgcccggctcctcggggttcgcgggggctccgtccccgccggcttcctgcctcgccgccttccggggtttctgtggctcatcctctctgggaccctgggtcagctccacttccttcctcttctcgcctcggccccgccggcctctgaagccggggccccgcggcggaggctgctcgtcctcctcggactccgaggcgaagtcgtactcgcggagcctgcggtcctcagctccgggccggggcctccccgccgccagggagccgcacctgcccgcccgccgccccagccgccggtggcgcctgttcttctgctgcacgatcttcagaatgagctccttgccccaggcgccgccccgagccttcctcttcctggggtccttcctggggggcagccggcggcgccgggagctgcgggtctcctcggggagggcggcggctctcgggacccggggcgcggggtctgcgcggctcccgggggcctgcgttctagggcgccggggacggggtgggggccgctccccgagaccgtcgttcctccggggcctcaggccggaggctctgccgccgccgcccgaccccgacccctctgctgcgccgcccgagtccagatccttccggaacagcttcaactgcttccccctcctctgctgcctgccctggctgggcgcatccgcctcggtgggggccagacccagggaacgcgttttgggcctgcctcgggctgggcagcccctgtccccagggcggggggtttgggggtccggcgtggctgctgggagcgggggcggagctttgctctctggagtcacccccgccttgctcttaagggggtgtccggagctgggacctctggggccggaaggctcctcgtccgcgaagacgtcgatgaagctgctgtcgatctccgggttgtccgactggtactccatgccgttgagcgcctctgtgatgaggctgtccagcttggcgtcatcctccatgtccaggtccgaggcagggagcgggaagggggtggcggccaggctgggcaggaagcctgtcctcagggggtcgtctttgccctcggcctgggcgtccccagctaacaggaaggtcttcgcgtggctgagcaagcccgcgtgtgcgtcggc

SEQ ID NO: 84521 - DNA, 1050 bp, Homo sapiens
gactttctaattcggtgaccaatttctggatctccagttcatcctcggacaggtgactcataagagcaacgctacatccactccccttcccaggcaaagatggggcggcgccgggaaccactgtccgttcagggggacacgtcttactgagcacctttccccccgagagatcaggaaaatggctaggcagcatcggggatacttcctcaagcagcaaaaaagaggggtacggtggatctgacggcaccgtcttctggggagggtcggcacatgcgaacggcagaccggagtccctgttcgcagacaggctgccatagaggggtgggtcgaatctgtccaccggcaggtctgggaagagggatgaggactccaaggtcggtggcgatgcagccctgcctggctccgtctcagcggtgccaggtgggctccttggcagctgtggctcgagggaaccggcatcctcgccgtcctggcaaaggcaggagctgctggccggcggggcatccctggctgagggcttggggtgcagttcttccaggaaacagccagccaggtctttgggtccgaggaacaactcactgtgggggctgctgtagggctgaggcccctttttggcaactggaacccccaaggggtctctgttaaaaccagcagggtcacagccaaaactggagatctttgaagacagaacactgggtttggggcaggcggtacttgaggggttagccacgggtgccagaaattctccaggctggcgggcaggggggtccttgctgttgtgggagactggggcctgtgtgcccccaggaccacccagcaggctgcccacacctggcgttggcgagcttccgtggggcgccgtgttggcgaggcttcccgacggcttgggggtgccggtgtcatgtctgctgggcggcggctgctctggtatcaggagaccggggcttgctcccatttctcccgcacaggcggctggaggagaacgcaaagcctctgtgaattctgtgctgtccggggctgactcttcggcagtttcaggctccttggcct

SEQ ID NO: 84522 - DNA, 1061 bp, Homo sapiens
gccagaggaggagaggtggctcggccaggagactcccacagcttctcttttctggaatcctctggaattcttaaagtgctgtctttgggggtgtccccactgtgagtgcaggttacagcactgacggagccaggaggccaggaggaagggtcttccagggggctgccctccccctggagaaggcaaccagccagggcttccttgggatcgcaggggcttgttgtcaaagacgggggagccaccggggaatcctcagccccagtatctgtcgtggcttggacgccatctgcctcttccagaggtgcccaggcaggagaacaggccagcagctgctgggggccgggagggtccctgcaggacggagatgctggcagctgcccccccagcccaccttgggccctggaaggcgaggtaagtgggtcttcacggggcaggggcccaaggctgcagggcatgtgggcggctgaagtgggtgagggggcgcaggcggccaggtccccgacagagggtgctgggctatcccctgtggccagcagtggcttgttcaggccggggctggacgccctctctggagtccggccctcagatccacttcggctgtgggctgctgtcaaggccagcgccagggactccctattaggggacggggggcttggggtgggctcggcctcctcctgaaggctcatggctgccctgcttcccttgcatttctctagcaggactgcaccctcggtggggccggtcagcgctgttttgggactggcattgactgaggcgtggttgtccgtgccccctgggctcaccccgttctctggctgaagctggttggctgtgccttggccctgggttttctcggcttggccaagcaagccccaatgtccatctgcctccagccccagctgatgtccggccactgcagggagagttgtcacctgcacaccccctggggagccctgggcggggccacaggccaccttccctccttccacagtgcccccttccagacctgaggggttcactcgtggagggctctgggcagcaggtgtcagctcctgcaagcc

SEQ ID NO: 84523 - DNA, 1122 bp, Homo sapiens
tggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgccagcctccatttgctctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatgttactctgaagtttctggtgctatttttgtgttgtaatgtgaatacaggcttccttgatttttttttttaatgggggtattgggtgggacagacggggtcagggaggccccaccatggcttgtcgagggcacgggcacctgcatggcggcgctctccctgcctcccctgccgggctgcaagcctgaggtctgtgctgccagacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaacctccagctgcgtgacgtctgtcctcccgccggcccccatccctggtctgcacctccctgagcctcagaacttggctc

SEQ ID NO: 84524 - DNA, 1086 bp, Homo sapiens
gccgccgcccgcccggggctagaggcggccgccgggagggcgcgcggcgccggagacatgtccaggcggaaacagagcaacccccggcagatcaagcgtgagtcaaactttgcccgcggtcccctccgcgcgcccgacccccgccggagcccagccgccagcgccgcccccgcccgtccccgctctgccctgggcgccggcgaccttcaccccgcgccgcgccccccgcgctgtgccaagcgcgccgtaatctaatctccgccggcggcctgggcccccgcgtctcggcttgggcaccggggggttcagcccaggagggggccgcccggaggccgggaggagggtgtttgggggcgcggcccgggcagctcggcccctcgcggcctgcccctcccccgcatctgcgagatggtgcggcgatagggcggccccgatctgggctcagataaagtttaaaatattacattctgcaagtcccgtcctgataagatcgttctgtcgggacgggctgaaattgtgatcttatctcgcgcggttgactctcccaggctttgtatctagaagcgaagagagagacctgggaggcagaggggacacccggggccgcggagatgcctggccaagtggcaggcaccggcccgcgcccacccccaccggtgccgtcgcagagccgcaggacaggggagggggtagcgcgcagctgccgcagcctaggcacttggctccagccccccagacacccccaccccgtgccctagcgctgaagtcctgaacccaggccccgccagcctggtgacacctcctggaccctgcaagtgtcccagccaaggcggcatgggcaacaaatggtgccctcggatgcccgcgggcaccccctggcatcccaatgggctgctctgagtcagagaagggcctcccaggacgcagccccgggccggggtcgcccctgcacgccactaagtttctcgctggtccggctccctgcccggtcagaggctgctgccccgccgccacattgccagtgcccccgcgatgagaactaagctgtcggggccactgtctggcctgggcctctgggctgtgcca

SEQ ID NO: 84525 - DNA, 1051 bp, Homo sapiens
agcagcccctcaaaatttaagggtgcactgagcacacctgggcccgaggggccgaggcatgtgagccgtgcctaaggttgagacccacaggggcagggcccccaggtgcccccaggctgcctgtttatgactgatagttcccgactccaggcctgggccctggatatgctcccagaggggacgggacaccctgcaagtcccaaggcaggaggacggggtgtttgcacctcagtcctgctgctgtccccaacaccacctaccgtctttccacttcgtgggcctggaacagctcaggaaggcttgggactaccccagccttcttgggaccttgaggcagtcagcctcagtttcccccattgctcataggcccacacccagctccaccaaaaccaaacattttcccagaaagcagagagaccccctacccccgccatggcaatggtcggtgggcacccaggccctctggggccctggctcaagccgatcattcccatacccttccagctctacaggctgcggcctggtccgccctgcactgtctcctggtccgggcctctggcgggcacaggtttcagctcctgcgataactgggaaagttgaactggccccattactgcgccaagatggtgagtgagatacagccttgataatggaggagataccagcttctcggtggccaatagcccagcctctccacccattaacattccccaccagcgatccgctgcctatctcgtccatttccactcctcccgaagataagaatggaaattctgacttcatagctcactgattaaagtgtctggatttcttgataatacatagataaattatgtttttgaaaaagaaggtagggaggagggtgaggaggatgggggcctggggtgggtgggagcccttggccgtttctcccagcctcttttggcccctgggccagaccatgaaccacagagcatccggcctacaccgcagcggcctctgcacagaccccgtgtccggaggtgcagagttagctcacagcagggcccgggctggggagacacaggcaggg

SEQ ID NO: 84526 - DNA, 1383 bp, Homo sapiens
ttcagagctgtgctgaggtgcccaggcaggcggtcaggcctgaagggcaggagagggccccaccccactccagagcggctgcagcctatggggacggagtcccatccacataccccgcggggcctgggccacagggtgtgtcctagagggtggtttggtgactctgctccgtgatttgcagctggagttctgaccccagaagtcccatgaacgtgttctccctgtggccccttcggggactgtgaattccattcatttatgaacgcaggaaatactggcagtcaggttgtttctgtcgttcctaataaatcccacagcccaaggaaccgcagtagcgtctggggtggaatcccagggctgcctggccaaggccgtcatgggagctggtgggtgagggagggagggggcccagcagaggcggggtgggggtcgcaaggtcccccgtggaggagggacagcgtggggaggggcaggtgctcgagccagatgcatgtacagatgcagcaagtatttattatttttttttttttttgagatggagtctcactctgtcgcccaggctggagtgcaatggcgcgatctcggctcactgcaagctccgcctcccaggttcacgccattctcctgcctcagcctcccgagtagctgggactacaggtgcctgccaccatgcccggctaatttttctattttgaggagagacggggtttcaccgtgttagccaggatggtctcgatctcctgacctcgtgatccgcccgcctcggcctcccaaagtgctgggattacaggcgtgagccaccacgcccggcagcaagcatttattgagtgcctgctgtgtgccaggcatatagccgggagcagatggccgatgcagagcgcgcaagcggccgtaatgacaccagcagggccccgtctgtggagagaagatgcatggtgaggcgctcgccgtgctggggagcgggaaaggcttcgctgaggcagagggaccacattccttcccaggggccaagatggaaaggggtcagcgaggtcccagcagcaaggggagagtgcacgatgggtccatgtgcccgccggtgcaagtaggcagccgcttgtttaacgctgccccttcccacaacagggcagccggggccacagagagaggggtgggcctgggcagccgcagccaggaggatgacccggccccatggggaagctgagttacacctgcatgggctgtggggctgcccaaggcaatgctggggcctcatggccaccggtcctcacgggctccccctgctgtcccccaggaagggggaccgggcatccagcacagcagatgatgtgacttgcccacctgggacccacagatggtgggggttccaggcgccatggtaga

SEQ ID NO: 84527 - DNA, 1033 bp, Homo sapiens
ccccagcagaagcccccatcggagccggcagagccccacagctggcgtgcagttcctgagccctgctctgcggccctgggaatcacgggggtgtcctttaaaaggggggcacccacccgatgccagcctgcacaaagcacctttctcggggcagccactcaccacagtggacactcagcatgtgctgccccggacatgccctgtggacggcaccccatgcccactttgtcctgccaggtcaacccaaaagcaacagccagggctggagctaatatgcatcctgtgctgggaacctgccaggcaggcaaaaagcttcacacagatcatggcctcccaacataccgggaggaaactgagtcaaaggagataggactgacccccctgagactgccccaaaggctaatggtgggcttcgggtgggtccagagtgagcaggggctcggccgcccctctgtccccccaacagccatgtggggagagggcagagccccgtctgcagaggagaacctgagccaggggttggggtggctgctggggacggcttcacactgggactgcagggttgcacccaccccagccagggcacccaccccactggccagcttagctctgctcacccgttctgtggctgagccgtgtggtagcaggcaggtgacgtggaagccacctgctctgctggccagcccgcctgaaccttgcctgagtagtcactgaacgtcccagcccaaaggctgtatcttgctagattcctgagtgccctgcggatgggccaagaggcaggggtggcccagaggggtccctgcatacgggtctggtcgtgccctgcccaaggtcgcagcagggaggccgagcctggctgggaccccactgcccacctctgcggcccacagggtcccacgcgtgctggcaaagtccaggaaagctcatgggctggcacctagtggggaggtaccccagacccacaggggacatccctgcactgtcaccagcccgaccccttgtaccatggcagggttgggctgactgccatcct

SEQ ID NO: 84528 - DNA, 1526 bp, Homo sapiens
ccagtgaacacgcaggcagggctctgagcctgcattgctaaagggcagccaagggattctcggaggccctcagaggctggccttcgagaagtgtgttcagtaacagaaaaggctccagacttggacactgccgaaggctggcccaggttcctgcttcaggatgactccagaaaaatggtgagatctgggcctgcagttttgcttcctcgttccatgatacagtttatctttaatttcaaaagtaaatactcctctaagaattcacacagctgtcctttgcgatccgtatcgttactcactttctgttaactcgtgtgggctgcccttgagcggggaagggctaggccaggctgcgtctccttctgccacatctcattttgccagattgccaaaaacgggaggcacttaacacccagcttagctgagcagtctagccttgtggagtggagttatggcctgtctttctctgcagagtggagtgtgggatttggggcagggccgtgtgggaccaagcaggatggaagtcctgctgcttcaggccaggaaagtagggacaaggtttgttttccattttgctaaaggctgtcaatctgtattctctcttttgcagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgtgagtatgatggagcagagcgtcgcggggcatcctgcccagcagcctgacatagactggtgctggaaaggagggactctgtgtgggactgacttagtgatttgttactagggatggtgcaggagaatgagaggcttgttttgggttcagtcccatagtgattggagagaaagagccagaaatcgagaatgagcagaggcagctccagaagctgccagcagggtttccgtggccctcggccggccagctggtgggattgtttgggttgtagtgaaaggtccagcgcccagtgtttttag

SEQ ID NO: 84529 - DNA, 1096 bp, Homo sapiens
gggaaggccaccccaaggaaggggactcaagcttccatctgaaagtaagttgaataatcaggaagaggagagggaagaacgcggtcaggcctggaactggaaaagggcgcttcacactgtgaagcgagactggaggagttgaggagggaatgagagaggtcagttagaaagtggttttaccaggctgggtgtgatgggcagtggtgcagattgcaggagatggggagggggatcaagaggggccacatgggaccggtgagattggttacgctagggctggctggaagaggccgggatcaggctgacgagtacttccatcttggatggtcctgtgtcagggatgtcaggtgggcagctggtgcccacgtgggctggggtggtgtaaggaggggtctcagctgcacgtccgtgggaacaggccctgggacagtgggtggcttggggagagcaccaagcaagggtcaggtttggctgtgcacccgagtccctgtgggtgaggcccagcttagagctcctgggttgttctaagacttgacagtcagggtgaggagctggttgaggatgagcctcaaggcgggccactcccaactgctggcatcactgccctgaggcacccaactcctcccctccccaagaattgtaaattagaggatgtttgtgtttaagggacataaaatattttgttctccatattttatttaaatgttaaaagttttaaaaccccgaagtgttactatttcctgcccagagttgatagttaagagaaatgtcacgaaagcccactctgtaaattgccctgtgtgctgcacagtgcttctccctggtgctgtggcgggatgcttagagctgccgggcacgctctgatcatccctgctatgtagatctgggacctaagatttggaaaattgacgtgaattcaattcctgtgacaatatccaggttccacacgcagcttcctgccccttctggtttggagaaagcagtgctgattgatagatgcctcccccacgctaagacggtgttctctgtttcaggatgatgacctggaagaaggtgaagtgaaggaccccagtgacaggaaggtgaggcctcgtcc

SEQ ID NO: 84530 - DNA, 1303 bp, Homo sapiens
atgagcctgggccagggctggaagcaaagctctggggcttttctggtttaaggggaaaattaatactcagacagttgatacgcgtgaactctccacaaagtgactttgtggtcactctgaccgaggtgcctggcagcctctggggaactgccgtgcctgggcaggtgcagctgtctggctcagcctctccaggctcatcccgcccacctccccgttcagttcccactactgtgtggctcgccatcaggcctgggtaaacatggcctctgccccctcccaccccccaccccagcagctgcccttgtgcaattaggctcttgtggaccctttctgatctcacttttgtttccatagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttgggtgcgtgatgcctcttctttcattgttagcacatcagccaactgagctgtgtctgaatctcaagcttaagacaagtcactgtgccttagcacaggctcagtgccccctttcggctgcttctgtcgtcccgagtggaagcaggcctcggctttccgaggacggagtgaggcttggtggaaggagagcggccacacacggccggcttgtgttgtagttgatgtttttactgtctggtttctctgtacacttgaaagttttactttctcaccttctcccttctcgtttttcaatagggtgggccggtagttgatgaaattttgcctccaccccctccagagcccccaacagagagtgcctgggaacgaggactccggcatgcaaaggaggtaaacacaattcagcagaaatcccgacaagaaagatgctattacaggagtggttcttgacaaaactgggatttcctcggtccagagagagccccagaaatctctgaagttaggcgtctgtttctgtggtgtctttctttattttttatttatttatttttttggagacagagtttcactcttgttgcccaggctggagtgcaatggcccaaactcgactcactgcagcctccgcctcccaggttcatgtgattctcctgctcggcctcccaagtagctgggattacaggcatgcgccaccaggcccggaaggatggagagttatatctaactgtctcaggcagcagcccagtaggccagggagttcagtccagggcatacccactgtcttcatggggctggatcagcactggg

SEQ ID NO: 84531 - DNA, 2092 bp, Homo sapiens
caccgcagccggcctaatttttgtattcttagtagacatggagtttcaccatgttggccaggctggtctcgaactcctgacctcatgatccgcccacctcagcctcccaaagtgctgggattacaggcatgagccatcgcgcccagcctaatttttgtatttttaatagagacaggtttcaccatattggccaggctgatctggaactcccgacctcaagtaatccacccgcctcgtcctcgcaaagtgctgggattgcaggcgtgtgccaccatacctgggcttatttcataaatatttattatgaacctactagtatatcagcactagagatagtattagacacggcagacaccatccctgtccctcctagagctgacagcgtagttggaaagatggaaattaagtaagtaatgacactcacagaaagtaactgccattctggttcaggagaaatctgggtgttcccctgagtaacagacactgagccaagggccatggacatcacccaagtccatggggtgatgggttttgtgagtggccttttttccccttaggaccctttgtttctcaggtgatccttaaataagccaggtatgagatccatagtctctcccgctgctgtcacacctggcattgctgtgaagcggaaggtggcctgagagttgctaatgcctctgtaatttcagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtaaggagggctcgtgggacggctggggtgtcagcaccttggagccgtcagctgacaccatgtacctcactgggtcaggtggggaacaccccagccccactgtttgctgtggcgtcgttacctgcagaccagtcagtgggactaacccggcgtttataccttcagcaaagagcatcaatgccaagtaggactgacgcagtgaccccaaatggggcacagaccccggcgactgagcctgactgctcccagggagtcacaggccacactggagggaggggcacctggatgcgggaggacgcacagacctggggcccagtgagtccatctgttcctccagactggacctgaaactgttgcccctccacctacggtcctggtctcagcacacaggagcccggctcccgagtgagggatgatggaaagcagggggccggggtagaccccatcatgctcggcaggaacaggaggtgtgggtgggaggccaggcttcactgaaagtggatgcagatgaacagatagacacacacacggacccacgtgagctgggtctgcccactcaggcagcgccacccggtaacagcaggcacaccccacgcccaggtcttgatttctaaatgccgttctgcaccaaggagggatggcactgaagagtgtctgggggaggctgtatgcgtctgtgcgcgcgtctgcagctgtgcgcgcgtgcgcagctgtgcgcttgtgtgtagctgtgcgtctgtgggtgtgtagctgtgcatgtgtgcgtcagggcgtgtggggcagggagggcccttctcacttctcgccacgctccgtcccgcccgccccaggtcgtcttcgcggtcatcgtcctactctggctccggctcctcccggtcgcgatcccggtcttcatcctacagctcctactccagccgctcttccagacacagctcgttctcaggaagccggtccaggtatgtccccagggcccatgaagggccctcagcaggtgcagtgagcaagggcacctgcggatgtggctttagttgtggcgccagtagccccttggggtattgaaggtccctgctggcagctgaactaggatggccagggggtcgtgtcctgtgtcccccaccaaacaccagccttgcgggccctcgtccttgtgtagatgcgtgctgtcactgagggccacagcctgagatcctcgagttgaggcactccagtcc

SEQ ID NO: 84532 - DNA, 1050 bp, Homo sapiens
cggggtgaggggcatggacagcgaattgcagccccaccccccacccccccccacacacacacacacgctcctgccctggttgaggctggagggtgccctctgctccgcatgcccttgggcaaaagatccctgggcacagaggtgggaagaataacaggaggttgtgcggggccagcccaggaccctcccagtctgctccacaaagcccgggagccagtggctaggaccaggcctgcttgtggcagtgggagcctggccatccagggagccccttgcctgtcctggtggccgctgaggacacagtggaagcgcccctacggggaggtcaccccttccacctgcagacgtggcttctgggggctcaaggtcttccccacccccttgtaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcaga

SEQ ID NO: 84533 - DNA, 1050 bp, Homo sapiens
gggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcctgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacgggagccccacagtgcctgacccacttctccccgcagtcctcatcaccgggggcatcgtggccacagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacc

SEQ ID NO: 84534 - DNA, 1036 bp, Homo sapiens
caggggaacccacgtgggttgtggccagggtaaggaccagggggctgagctgaaaccttcccaatgcagccttcccctgccagccgataccggggacggcgctgggggctccaaggtcacaagggccgcgggcacagtcaaggacatctaagggccgagcaccctccagctgccaggagggccagagccgggctgatgggcactgccacacccacatcagagcagcgtaagggcctgcagcttgtcatgggcctcattggcccccatgtccatcctgtcctggtgcctggcccgtgccccgtggccctccctggcacatccgcttcagggtggagaggccccagccagcgccccgttctttcagtggcttccggaggactgagcagctagaggtgattttgcatttgcgtttcccgacgttgccacatctcaggtgaataagttctatgaagcgctcacactagtacgtggcccctcggtggtttgtcctcgaggtcgaaggtccagatgtccaggggctgccctggactccagagtggtgcggctgagcaggctgtggtcttgggtgcttgggcacctcccgtctctccctgctcagagttcttctctcctgggcagccagaaaggatcagaaccggtcacatgcagagcggcctcccgtatcccacagcagctccgttctctaatctgggtcttcagatgcggctgtgtctcccggcaccttgctggaatgtggtgcatccctcggagtccagcagcccttaggcagagctgggtgccgagcttgagtccaggagggcctcagacacctgcgatcttgcagcctgttgccctggacagtgggtgtgctgtgggtggaggatggcgccctgcctccacggaagcatccccagcttgcccctcagtcacacgaagcgtctgtccccagcctggggcatttctgagtggcctccacttggcctcttcctttttctggagcaagtatttgaactcctgcaggcgccagagatctccttacctgtttcccgctaccctt

SEQ ID NO: 84535 - DNA, 1032 bp, Homo sapiens
ggcgacagcggcctggaggcgcagtacacctgccccatctgcctggaggtctatcaccggcccgtggccatcggcagctgcggccacacgtgagcgcgcccgcccaggggccgcggggagggggccgtgccccgccgcgggaggggtcgcgaggccggcggccgccccggtgcagctccggactgggcgcgcggggactcggggcgccggggcctcggggcgcgtggggtccgggtttccctgtgccgcgccgcctctgccctctgggcgcgttcatcccccgcccagcctccttcgcgccagccgcaggcgcccggtccgactgctgcttcggttcaccgggcgacctgcggccctgcccaagctcggggtccccggcggctgcggcgggcgctccggtactcagagggcagcaggtgccaccgctccgccagtggtggtggatttgggcttgtgcggctggaatgggcagttgtaaataaataacttgtagtttttgctatcaactcttgttcggacccgctgtctgcctgttttgactacagaggaaaggagttccctaaagtttagaggggcttgtttggagtctgatgttcttagttttgtttgaaggagaacttgagtcacaccgatcactgagtagccaggcaggctggtccacagaggagcagacactgaccaccttgctggggtttccagctgcaccagggctcacagccggctcctccagggtgtttcaggaacagaaactggaggacgtggctctcctggcggggagctgtgctcaagtattctggagctgccagccccgttgggaggaagcctagatcagtgtctgctccctcctaagtgctgaataatacagctcttgagcaaaatcagcagtggcaggggagagagagagcaggagggcttccccgcagacatccaagctgctgaggtggtggagtggaggggggtgcacccagactggtaggaggctctagaacattttgcaagcaaagtcagctgacttcaggggctcctggtaca

SEQ ID NO: 84536 - DNA, 1911 bp, Homo sapiens
gggttgtcaaccagcccatcgatgtcaccgtcaccctgaagctgggcggctatgaggtgagcatgtgtgggtccgcctgtccattcccatcccctgggggttctggccaaggtggtgcaccacccccagccgctcctccacgctcatcttcgtggccccgtgtccccgtgcctgccccagccgctgttcaccatgagcgcccagcagccgtccatcatccccttcacggcccaggcctatgaggagctgtcccggcagtttgacccccagccggtaagtggcctctgccctgtgaaagctggtgtggggaggcggctgcagtcactgagggtgtcacttgtacccagctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagaggttcgtcctggacttggggcagtgcctgggtgggtggacccactacagtgggtcacgctgtgttcccacccccagggacctggcgaagggaggcactgtggagtatgccaacgagaagcacatgctggccctggcccccaacagcactgcacggcggcagctggccagcctgctcgagggcacctcggaccagtctgtgtgagtgaagggcccgggtggtgggcaggagggctgtgccaggttggctgggccaggcctgacctgccagcacctccctgcagggtcatccctaatctcttccccaagtacatccgtgcccccaacgggcccgaagccaaccctgtgaagcagctgcagcccagtgagtatgggcgtgggggttgggggaggctagagaggggtgacctgcggcctcaacgatcttctccctccatcccagatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacgggtgagtgagtggctgggggggcaccccgcagctcggggggctccgggcggccccaggactcaccagcttcccccgcagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaatcagaggccagtcccccgtccttgccttccggctccagtgtggtgtaccaggtggccactgcctgctgtcccggcaagcacgtcctcacgctcagctctggcccgcctcgtcgtcactgtcctcaatcagacagtcccggatctcctgcaagccccaggccctagagagaaagct

SEQ ID NO: 84537 - DNA, 1005 bp, Homo sapiens
gcccagcaggccggctccttccctctcgggcgccagcagcagctcctactccttctcacgagtccacttgatcatggtctccggtgagcggtagaggaagatgagcttggcgtacaactcctcctccagctccagctcccgagtctcccgcaccaggaagatgtcctggcagagcttgaggatgcggtccacgcacggcagctcctcgaacataatggagtgcgagatctcgctgaagaatccgcgcacgaacttgccgatgaccagcacgatggacacgtacagccccatgatgctgcgggggaagctggtgagtcctggggccgcccggagccccccgagctgcggggtgcccccccagccactcactcacccgtagccagccaggaagccgaggctcggtgggctgaccttgtcactgaaaatgaccatgggcagcaggttgcagtcggtccggcactcctgcagctcgatgacccaccattcgaggaagccggtggcccccgcaccctgctccctccgcagctggatacgcacgccgaggtagtcggcctcctcatctgggatggagggagaagatcgttgaggccgcaggtcacccctctctagcctcccccaacccccacgcccatactcactgggctgcagctgcttcacagggttggcttcgggcccgttgggggcacggatgtacttggggaagagattagggatgaccctgcagggaggtgctggcaggtcaggcctggcccagccaacctggcacagccctcctgcccaccacccgggcccttcactcacacagactggtccgaggtgccctcgagcaggctggccagctgccgccgtgcagtgctgttgggggccagggccagcatgtgcttctcgttggcatactccacagtgcctcccttcgccaggtccctgggggtgggaacacagcgtgacccactgtagtgggtccacccacccaggcactgccccaagtccaggacgaacctctgg

SEQ ID NO: 84538 - DNA, 2139 bp, Homo sapiens
cgtgcaccacgctcgtccctgctctgcctgactacgcccctgcctgcttaacagcctagtcccgcgcccactgcacgaaaccccgtgtggggacaagagctggacgcagccctgagccccctgctgtgccctgcagggcggcgaagtgcacaggggcgtgctggatcagctgtacacaagccaggccgaggccacgctgccaggccccaccgaggcccccaatgccccaagcaccgtgtccaggtaggtgcgggggtgacccgagccccagctgctgcccctggtgtgtgggcatcgcctagccatccccgaccctcgccattcccttgtaccccaaaggaccgtgggcactttccaccctgaccctccctgtagcctggggtcaggccatagagcaggattctctgtgactcggcttccctccccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggtgggggcgggacgcgcacaacaccagcctcaccatggccctcggggagcagccgaacaggggcaggagactgactgtgaccggcaacagatcgggccgtcatgccttcgggcagtcccagactcccccaaacacgcgggtctccctgtaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgaggtgggccgaggccgcgggggagggggcgcccggcccaccgcgccgtgaccctccccgcgtgctgagccccctcccccacagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctggtgagtgtgagccttggctggcaatgcggggctgggcaggccctctgggcacctgtgctctccaccagggaggcaaggccccctcaccacaccctcccgcccctcagtgctatggcctctgggaccatgaggaggactcaccatccaaggagcatgacaagagcggcgaggaggagcagggagccgaggaggggccaggggtgcctgcggccaccaccgaagaccacattcaggtggaagccagggtcggacccacggacgggaccccagaaccccaagtggagctcaggccccgtgatacgaggcgcatcagtctacgttttagaagaaggaagaaggagggcccagcacggaaaggagcggcagccatcggtataagcgccctgcctcacaacctcctgcctacccagttttctgagtggggctactgcagggagggtctttctcagatgagacggccaagcccagtgcgaggcccacctggatcccaggaaggtgccacttctgagccacagctcccggctctgcctacagagccgtccctgactgctgcccccggggatgctccccacgtgtagggtgactgttggcctgggctggcccctcacagttgccccagacagaggacacagccccagctgtctccttgccagtgacactgggagctttcctgtgctccgtctgcttgtctgtcaaacagggagaatgccagcctcttagggtggtcaggagccatgagccaggcccagtccccagggggcccaggcagaagtcagcttttccctacagaagctgaggacagggaggaagaagagggggaggaagagaaagaggcccccacggggagagag

SEQ ID NO: 84539 - DNA, 1040 bp, Homo sapiens
agtcgcccccaggacaccctgggccccaaggaccccggcctggagccaggtgagtgcagctggagtcgggcacccagggccccgtgtccagcatgtctgtgcctgctggcgtgtgctgcgtctgtgcccatgtgacgtcccacagggctcccagcccgcctgtcctgtccgcatgatcaccctctgtctggcaggccccatggccgccctgtgactgtccgtccacgcacatgggctctgagccccatggccccacacggcccccgtcactgtgggtgtccgtgtctgtctccacctatcctgtctccaagacgggagcactcacagccccgacccctcctggtggcttgactgctgcctcatgctcaccctgcccctccacagggcccgacagtccagggggctcctccccgccacggaggcagtggtggcggccctggctggaccacgccacaggtacccccaattaggccgcctgtggccaccctctcaggccctctgtgcccccatctgtcctctgcctggcctgctatcttcccctcccttcccccgactcccaggccctgagcgtcaggacgtgctcaggcctcctgggtcggggggtgcctcactggctgcagacccctgggctgactatgtcctctcctggctatgccccagcccttccaacagtgggagtctcggagcttgccccgatgacacatggtggtcgagcagcgatctcacctgggacccagcagcactgcgttattctgtttttgtttctttttgagatggagtctcgctctgtcactgcaggctggagtgcagtggcatgatctcagctcactgcaatctctacctcccgggttcaagtgatcctcctgcctcagcctcccaagtaactgagactacaagcatgtgccccactccaggccttttttttttttttttggagacggtgtcttgccctgtcgcccaggctacagtgcaatggcgtgattgcggctcactacaacccccacctcccaggttcaaaggattctcctgcctcagcctcc

SEQ ID NO: 84540 - DNA, 1102 bp, Homo sapiens
tgactctgcgtgtgagcgcaagtgaacccatgcactcatccatggatgtgagagtgtgtgctcgtgtgcctctgagtgggtgtgagcgagagggtgttcggtgcctgtggggaggctgcggtggatgggctggtgccagccgcctgagagctcttgccccctgctataggagggtgctgggtcccccggctgtgggaggggtgctgggccccccggctgactgtgacaccctgcgcttgtcacagttgctctacaccctgaccttctggctcctgctgcgccagtttgtgaaagagaagctgctgaagtgggcagagtctccagctgcgctgacggaggtcaccgtggcagacacaggtgagtggtgggccagaggcgggggttgccctcctgcctgcccgccctgatgccatcgcctgcccctggcttggcccacagagcccacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtggctggggggccgggatgggggctggggcacggaccctccccgcggtcctcaccacccccacctcacccggcaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagtgagtccaggctggggcggtggggcaggggcgccgaaaccccgtgcacttccccggggctgcagcggctctgccgggggccgggccggtgctgatgctgcccctccacaggctgggggacctgggcctggagcagttcagcgtgtccgagctcttctccagcatcctggtgcccggcttcttcctcctggcctgcatcctgcagctgcactacttccacaggcccttcatgcagctcaccgacatggagcacgtgtccc

SEQ ID NO: 84541 - DNA, 1025 bp, Homo sapiens
ggacggtgtcagcccaattgccggagccctcgtgttctgcccatagcccaccgggggcctgtctctcctgctgtgtgcttgcccagggcccagattttagggcatagtcagggtggggaggcctgcagatcaacctgccgaagctgaccgctgtccccacctgcagtgcggcccaagcgggctgagcccagggaggcgtctccgctccacagcctgggccacctcatcatggaccagagctatgtgtgcgcgctcattgccatgatggtaggcggctgtgggggttggggtgggcggccccctctgccgcgcaggtgtggggcatcgcctgggtggggtgcgctgggcagctgtgcagccccctctgccgcgcaggtgtggggcatcgcctgggtggggtgcgctgggcagctgtgcagccccctctgccgcgcaggtgtggggcatcgcctgggtggggtgcgctgggcagctgtgcagccctctctgccgcgcaggtatggagcatcacctaccacagctggctgaccttcgtactgctgctctgggcctgcctcatctggacggtgcgcagccgccaccaactggccatgctgtgctcgccctgcatcctgctgtatgggatgacgctgtgctgcctacgctacgtgtgggccatggacctgcgccctgagctgcccaccaccctgggccccgtcagcctgcgccagctggggctggagcacacccgctacccctgtctggaccttggtgccatggtgagtgtgcaccaccacatccgggggtgcctgggtgcgcagacccatcagggttgtcgtcctgttcaatgtccacttgcccgggggagtggcagcgccaagaaggcagatgtgtctgtctgtccccttctgcccacccagagccagcccagagtagcttctcagtgagcgtttgttgactgaataaacagacaaccttgtgttggcacgggcaccacccctgtgccctgacactgtgtgagcgtgggctctgttggcacgggcacc

SEQ ID NO: 84542 - DNA, 1233 bp, Homo sapiens
gtgcgatacacctgaccttgcccctgtccgtgaccttggcaggatgatgatgagagggatgtggatgccagcccgacggcagggctgcaggaagcagcaacgctggcccctacacggaggtcacggctggccgctcgtttccgagtcacggcccactggctgctggtggcggctgggcgggtcctggccgtaacactgcttgcactggcaggtacgcaccgaggcagggggcactggcagtcacactgggaggggtcttgggagttccctgatgactgtggagacagcgggacacatggcactggccaggtaccaccctgtgtgcccctgccccgcaggcatcgcccacccctcggccctctccagtgtctacctgctgctcttcctggccctctgcacctggtgggcctgccactttcccatcagcactcggggcttcagcagactctgcgtcgcggtggggtgcttcggcgccggccatctcatctgcctctactgctaccagatgcccttggcacaggctctgctcccgcctgccggcatctgggctaggtaacggcttgccacacagcccctttttcctgccaccctggtcccgcccacctggctcgtctagcccctgtggccccactgcctctggggtggtaggctgtgacgggtcttctctggacagggtgctgggtctcaaggacttcgtgggtcccaccaactgctccagcccccacgcgctggtcctcaacaccggcctggactggcctgtgtatgccagccccggcgtcctcctgctgctgtgctacgccacggcctctctgcgcaagctccgcgcgtaccgcccctccggccaggtgagcacctgccacccatggtgggtgggctgaggccaggccatggggctggtctcaggacctcctgcctctgggtggggtgtggagctggtttgggctcaagacgctggtctctgcagaggaaggaggcggcaaaggggtatgaggctcgggagctggagctagcagagctggaccagtggccccaggaacgggagtctgaccaggtgagcagccaggcaggtggagacgccagcgtggggggcgcccggccagcccgtgcatggctcagcgctgcttgcccacagcacgtggtgcccacagcacccgacaccgaggctgataactgcatcgtgcacgagctgaccggccagagctccgtcctgcggcggcctggtgagtaccgcac

SEQ ID NO: 84543 - DNA, 1044 bp, Homo sapiens
cctcccacccccaaccagcaagcctcccttggggatttcaggccccaggaagtggggggacccaggagggacagagggggacctggagactcatccacactcccacccacacctggagacccatccacgctcccacccacacctggagacccatccacactctcacccgcacctggagacccatccacactcccacccgcacctggagacccatccacactcccacccgcacctgcagacccatccacactctcacccgcacctggagacccatccacactcccacccgcacctggagacccatccacactcccacccgcacctggagacccatccacactcccacccgcacctggagacccatccacactcacacccacacctgtcctcttggtctgaccgcggctgctccctgctctccgcaggctggacctgaaggacatccccaacgccatccggctggtggcccctgacctgggcatcttggtggtctcctctgtctgcctcggcatctgcgggcgccttgcaaggaacacccggcagagcccacatccacgggagctggtgagggcagctgcgtcacccgtgtgtcagggaggtcattcgagagctgtggtctcagccattttgagggttattttaatctttttaaaacagatgtagacgttttggttgtaagttggtgttaaagagaggaggaagttccaaatcccaccccggggcccagcctgcagttccatccgttcagacctgtttctactcgggctctgcctctagtcagaaacctccacgccccgacatggcatctgtgcccttaggaactcttcacaggggaattatttggggccacgcggtggtggaaacctgcagtgctgggcagtgggtctggctggagagccactgcagaagggctgagaaggggcggccccagcaggccccatgcacttacaggcaaacaggctgtcggcccagagccccagcaggggcctggaccccaggagcgacgggcctgaagcagggcctctgtcctcggagtgggaggca

SEQ ID NO: 84544 - DNA, 1025 bp, Homo sapiens
tgcaatggcacgatctgggctcactgcaacctccgcctcgcgggttcaagcgattctcccgcctcggcctcccgagtagctgggattacaggcgcccaccatcatgcctggctaatttttgtgtttttgtagagacaggggttttaccatgttggccaggctggtcttgaactcctgacctcaggtgatctgcccacctcggccgagactacaggcatgagctaccgtgcttggctttttttttttttttcgagtgggggtcttgcttggttgcccaggctggagagcagtggcatgatcatggctcactgcagcctccacctcctgggctcaagcgatcctcctgccttagcctaccaaagtgctgagattacaggtgtgagtcactgtgcccagcgcaggcactgatcttggatcatgggtagaattcaggggtgcagagaggcattttgggaggggcccagtgcggccgagtgctgggagtcgctggggcccgaggcccaaacccctccaggatgcatggctggggtgggtgggcacccccactcccggtccctatcctgggcctcccctttgctctgtggagccggttctgtctgttcccaggcccctggcgtttcgccgtttgttccgtaaatatttcatgcccagggcgcaattggaaacactttcctttaatcagcagtgggggaaggcaggcgcccagccaggccaggggaggagctggggtgggaagatttggagaggacccgggaggacttccctgcctgagcctcgtcagaggcccttcagagacggagatgctgcccagttttccgggagggagagaggaaagtgtgaggcttgcccgagccgagtgcccggggctttatgatttgtgcagctgctgggcttggcgtggccctggtggaagctctgacgccatctgagccttggtccccttgtaggcgtcagcctgatccttggggggctggaggttgagctcagactgaacagggaggagaggggtaggggctggggctggg

SEQ ID NO: 84545 - DNA, 1021 bp, Homo sapiens
ccccagtctcctgcagaagtacacagacatgatgtacgaccatcctggacacctgccctgagattcccctccctctcctgccctgtcccagtggcctggggggaaggggaagcaaggttctgaagggagtgtgaccagacacctgcccgtgacaccccctctccaggctgcctccgagtggctggtgactcccctcctgcctgcgagggaggtggccaggttgcattcctctctgagtgccggggaagtccctagagagcaggccagcctgtgactgggccctggggcagtctagacaggccagactggacaggccagggggctgggtgccgctgggtaaatcacagggtgagggctctgagtcagcaccccatcttctgtcctgggtccagcaccgctgaggacacagtgggcagccgggtctgccagggccaggtagctgtgttgagaaggcagtgctcctgagaggcggctaccgggaggttttcaatggccaggcttcttaggaagcccttgttgcctctctggggtgagttgctggggccatggttggagtggtcgccagtgtctgcccctggtgccgagggcggagtcctcgttttgggaggtcacggcatgatgctgggagtcaaaggcaggccgtggcaggggcattccttttttctttcttttttttttttttttgagacggagtttcactcttgtcgcccaggctggagtgcagtggtgcgatcccagctcactgggatcccaggctcccaggttcaagcgattctcctgcctcagcctcccgagtagctgggattacaggtacgtgccaccatgcccggctaatttttgtatttttagtagcgacggggtttcgtcatgttggccaggctggtctcgaactcctgacctcatgatccacccgccttagcttcccaaagtgttggcattacaggtgtgagccaccgcgcccggcctggcaggggaatgtcgacgcgtgatctctgcctggagagcacgttcatgtttccca

SEQ ID NO: 84546 - DNA, 1027 bp, Homo sapiens
agacggggtttcaccactttggccaggctggccttgaactcctgaccttaagcgatctgcccgcctcagcctccaaaagtgctggggttacaggcatgagccaccgcgcccggctgacagttagacttttgcttctttgtttatataagctttttcttctggttccaaaagcaagtttgcccttccttgtggtagagaatcctagctcacagagcagtttagaagccagcacagtatcccacacacacatctggcatggacagacccttccttgctgggtgtgggtcctgtgttcttctgaaaggcaagctgttcccagccaacccctgcccctctctgccttagcctgcctggaggcctgagtctcctgggtgactgtgaggtgggacccccccttcccctacccccacccacatcctctgtatctgccttctgtcctgctcttgacctttgagctcctctgctggcttcagggtgcggctgttgagcctattttttggattaggactctggggtgagggaagttaattcacacacccaagatcacactggtgggaagggacaggcccggggtgaaggcttctcctctccttggcggttgagtcccacacctgctggccgaggcacctgaaggggacttggggtccagggtcactgggaggacgggggcaggcagaggggtggccgacctggtggcggctcgtgggcagcagccgaccctatcttgctctgaacgtgtggggccctcacccccttctctgggtctgggtttcctcccctgtaagtgacaccgtaaaagcttcacagccgcttccaagtctcaggtctctcgggctttggatctcacacccaggctgggtgggggtaggggcgggacagccgtcccccccggaaggctcagaattcctcgcacaatcgtggggccaggagacccgcaacacaggctttcccagctgcgctgagtgccgcggtggccgggggtccgtcgggcctccatggagctgaggggaaggggccactcaccgcc

SEQ ID NO: 84547 - DNA, 1074 bp, Homo sapiens
cgaagcacacccgggtggcttggtgctgcacggcctggcacccctacccttccccgaccctggcctagccgggacccagggtccgcgccctccgcccgggggctccccacgtgtgattgatctgggaagcagtcggatggaattaacccacggacaagtgggacggtttgcattgggagtccgccatggacacggcaggtggggccttttgattgtaaaagccctttcggagcccttgcctcgctccaggtgggagctcgcccagcgctagctttggggatctagagccgcctgcctgaggctcccagacagactgcgttttgatcggtcgcacagaaaggtggtgaaacttggggaagattttctagacaggaatcaatgaaaaccattgaggctggagaggagaggttttgagcaactctcttcagtgcggtcagccctgtgtggactgggcagcctgggacctgctcccagtgcagggtcagatgggccgtaaacagggcccggctgtgttccttcctgtgccttgaaaacaagcaggacagcctggcacagaggcagagtctagagctgacaggccttagagagggaaacaggaaagcttctgaaacgtcccgttcacactgatcgttccatttcctcttgtgtctgagtgggagcgggtgtcctccctgcagggaatgccccccctctcagatggcagctgctccttgggcagagttggcaatgtttttctttaaatgaccagatggtaaatattttcatgtcacaaaatcttcttcttctggtatttttccagccattaaatgtaaaagccctcctgagttcatgggctgtacctaaacaggtgttgagcccgattctgtggcacatgtggtttgctgccccctgggcattggtcagggggcctgggttctgccttctcgattgctatccgcgtgggggatctgggggagggatcactgttcttcttgcttttggcctccttggggaggatggggaggtagcccaggggtgctcacccaggccccgtgtcagtcttctatgaaacttttaaagaatagtgatgactga

SEQ ID NO: 84548 - DNA, 2507 bp, Homo sapiens
cgcgctaaagtcccacgcacgacggcgcccgccggcgagtccacgcccgcacgtcggcgcatgcgcgcggccaagccggtgcccgcgcccaccagcgcgcatgcgcgccccgtcccttccctccccccgtgctctgccccgatggttcggtccgcgccgggggcggggccagggcgcccgcgggaaatttggcgggaaccgcgcccgcctcttcctcccttccttctttccttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtgaggggcgtggggagactgaggccggggagttgggggcggggagactgaggcccggggggcagggctcggggaaactgaggcggagggacgggggcggggaaacaggcgggggggacggggcgcagggaactctgggacaggccgggggatcctgggggcgccctgccaccactggggacttggctggctcctgagatgagcaggaggcactggggggcttgcaccgggatccgatgatggggctggaagtccagcttctctgcgaggccagggcaggggtccgacctggaaacggccccggaagacgagagcaaggctgtgtccccggccttagcacagaccaccatctacgggaagtcctaagccccccagccatgcccgtcccagttaactcagagcggcttctgatccttcggggtcctctgcagagccaggagcaccaggtcttgtcatgagttcacccttggggtccctcccaccaggtttccagccccagtacccccgaggccccagacatcccagcctgcccttctccgggccagaagataaagaaatccaccccggcagcaggtcagccgccccacctgacatccgcgcaggaccaggtgaggggcggggcctggggcagatgcgggagggctgagtggtgccggcctgcctgcctgcctgacggcaccgtgtcccctgatccccctgaaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatggtgagtgctgggtgggcggccacgaggccccggcaaaggccgggttggtggcaggcgtggcccagcgagcctgtcagaggcccaggtctgctccttccagggagggtggtggtgaggtcaccagggcgcggacccagacccctgagaaaaaggtcccgggcactgctggcgctgtgccctcagtccctcctgcggggggcagctcctgcctcggggactctggcaggtttcaaatgctcctgatgcattggtgtgttgtctgcctctgcccctgagagctgacgaaactgcgctggggagagggcagagcttccctgggggagctgcgtggacacagcagagctggggtgtggagccgggctttcccgtcaccactgctacccctaacggtgccagtgctggtgggtgtgcaagggccgcgaaagccatcgtgtgtggcatggcaggccccatcggagggtctccctggccgaggggcctgctgtggcgttggaggggtaggggcctactgcttctcatgaggctcctccctccctgacagtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggtgagtggccgggggtgggctgtggctgtcctggagttgggggtgggcccgggcctgcctcctgagccgcccccatcctcccataggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcagggtgagtgctgggtgcgggacctcggtttccccatctgtgagccgcacagtttccagggtgggtgtgaggtgctgggcatctggcccaggactggtcacgggtgggtggctgggtggcctggtggggacttaggcctggactcgtcccacagaggctgacggagcagccccccagctcacggcctcgcgcctcctgcagcgacggcagatctt

SEQ ID NO: 84549 - DNA, 1019 bp, Homo sapiens
ctccacacctgcagcctctggaggcagcttccccctcacagctctggccctttccctgaccacctgcagtccttggtcagaaggggccccacatgcaccctccactgcctcccaggcctctggtgaccaggccctgagcacataggggtcctgacgctacagggcacctcctgcctcagggctttcatgggctggcggcctccatgctcggtgcctcctcacagggcctcaactgtaggcctggctctctccggtcactgttcacaccacccagacctgggcctctgatcagaaccacctctgccctaagtcctggtgatggggccctgagggcgaccaggcaggcacagaggttgggtggtcaggctggtttcaagtgctgcccgtgcagggctggggcccagcaccagcctcagtgtcctcctctcctcccccaggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttt

SEQ ID NO: 84550 - DNA, 1082 bp, Homo sapiens
gagaggttgagacataggctgggctcacacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggccgacaccttcctctccccatgccttcccctccccaacccaggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaagagccgtctcctgtcctcctgttccccagggcagggagccccaggacaacaccagacttcagctgtactgtgggcatgtgctgcttggcgtgatgcccagcagaacctgtcctggttctcacctcaggagctagaaccctccaggcactgcaggaagaggccatgtgggcccatcttctaggggagcaagcgagggctcttctgcagatctagtggctgtaagcatgactttattagagtttaggaggtcagaaat

SEQ ID NO: 84551 - DNA, 1212 bp, Homo sapiens
ttggaccgcttcctcacgcccttctccaccccgcgcgccagcctcccgcgcgcagcgtggggatctcggccaataaaggagaaagggcgcggcccgtacgcgcgccaggtgcgtgggcgagaccagctcacgcccctcctccagccgccaaggccccggcccacagctgcctggctgcagtcagaagcgtagcccgagacaaggaagggcgccttgactcgcacttttgtccggttcgaacgttctgctcagtggtgcgtggaatgcgagcgcgtcttaaaatcgatggcgcctaggagtccatgaaatacggtacaggcttccggcgacggatgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacgagccaggccttccctggtgaagatcacggaatgcccacccagggaagggaggcctggaggcctccgggagagc

SEQ ID NO: 84552 - DNA, 1008 bp, Homo sapiens
catctctccatctatctgtcttctctgtctctcttgtcagactctccatctctgtcttctctctgtctctctccatcgctcttcatctgtctctccgtcttctctttctctatctctcctgtctctccatctgtctctatctctccatctgtctttgtctccgtctgtctgtctgctctctctcctgtccgtctctctctctctctgtcatggcgtctgaaggacaagggtgaggacagtgagctgacccgcttgctcctgcttcatctgcccacatgtcccacggcgcctgcctctcctatgcagtctctctgccttcgtgggcagccctgtgaggcctcctgcctggggcacgttctgctgcttttcctctcagccccgctcctcccctcccagctccctggataaacccctccctcccaggacaagctggtcttttgggccacccaggggcgtgtttgctctgcactctcccatgaacctgcaggcgtgggaacgtttcttttccctcgtggctgttgaggtgtggttcactaactggaaacgcacacgtgtggctcagtgagtcttcacacgcatcacaggcccgcacctccagcagagtcgtgggtggggtattttttctttttgtgagagggaggggtggcgtggagggtgcactgcaggaactgaaggctccactgccatccagtttccagtgggatgtgtgtgtctgtggctgccgcgcgctcctcccagtccccaggaagtgcacagggaagcggcacctttgttcctggagagaattccgggttgtccaaggcacatgtctgaaccgcttcgctctctttgccgttcccttgccccttttctgtgaggccaccggagcccatggttttgctgctgctactgctgggataccctggggctgggcaggccccaagctgagcagggtgagcacaacgttttaccaaatctaaggaaccaagggcaagaacgaggtcagtgaaggagaggatcaggtgattt

SEQ ID NO: 84553 - DNA, 1347 bp, Homo sapiens
cccgcagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgctctttgtacagtgcgtccctccaggagaggggctgtgtgtgggactgacacagtgtcgcccctctcgacgaccttcttactcccaggacagacgtggtggctcacgcctgtaatcccagcactgtgggaggccgaggcgggagtctgagaccagcctgcccaacatggcaaaatcccctctctactaaaaataccaaaaattagctgggtgtggtggcgcgcgcctgtagtcccagctactccggaggctgaggcaggagaatcgtttgaacccaggaggtggaggctgctgtgagctgagat

SEQ ID NO: 84554 - DNA, 1027 bp, Homo sapiens
tacaaaattagctgggcgtggtggctgcctgtaatcccagctactcaggaaggctgaagcaggagaatcgcttgaaccctggaggtggaggctgcggtgagccaggatcgcgccattgcactccagcctgggcaacaagcgaaactctgtctcttaaaaaaaaaaaaaaaagtctctcccaggagttggcagtgggctgagctctgactgtcccctgggggcagggctggggaccggctcacaggtggggcctgcgggcacccggtgcccaggagacaaaggcccagctgcctccacgcgcattttagggaggctgtttagggagatgggcagggtgcgcctgccatgccttgaacatgattcagtgtgtgcgcggtggaatgaggctccccctgtggttgtcccttgagaacggtcactgcagcatcgcccaggctggcatgccttcccgtagcggtctctggggctcctgatgaaactcccgtgtttggtttccacagggtgacgagaacaagtcagtgcgcgaccgtttcaacgcccgccagttcatctcctggctccaggacgtggatgacaagtatgaccgcatgaaggtcggtgttgcgcgtcccctcagttctgcctgggggaggctgctgcccagttctgtgatgggtggtgacaaccccctttgcgctgcctggggggaggccgctgcccagttctgtgatgggcggtgacaatttcagattctcttaatctggccgatgctttcggggaggtgaggtcctgtccctgcgtgtggcctcctcagtcttcccttctgtcccggtgtgcagggagcggctcctgtcgccagctcaacaggaccctaggcttgatggtcagaactcctgggactgccctgtgagccccctctaaggtcccagcattcaccctccactgctctggaagtgctggccagggcggtgggcaggggcgggggaggtgccgggaagggcagcacacccttatcccggtcgcgagggctgctcaccgggacaccctg

SEQ ID NO: 84555 - DNA, 1023 bp, Homo sapiens
tgtctgttgctgggactggaggaggcctccagggcaggctcctaggagtggggaggctgagtcgggacccccgtgaactccagactatatccttcgtgcagttccacagccccagctgaccccccacactcaccttttgcctgtagatcgcaccccctccctccctggcggagcccctgaaggagctgttcaggcagcaggaggccgtccggggaaagctgcgtctacagcacagcatcgagcgggtaagtgggctggcacaggcaggggggcgccacggccagggcttttcacggcgcaggccccaggggctgtcgtgttgacagtggggcctggagcgtggctgtgtcccagctcactctactcctctcctccttcaggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccaggtagggcccgtctgcatgccaggcccatgagtccaagtgcctgcaccctgcccgcctcccctccccttgatagattctgcactttgaccaggagcttcccgggtgctcagcaccttgcaggggctacagagtcctttgcatgcctctagccttgggcgagcctcagaaaggagccaagaaggctgcagcagacagcagacagctccccgcacgggcaaggccctcaggccactgggctgggcctcagcagctcagtccctccgtaacacttgtccatgcagttggagcacctgcccctacctacctctcacgggtgtcagcgctggcattattttctgtttaaactgctgggctccacctgctgctctcaggcaccccagggctgccacatcgagggctttcacagcacaggccccaggggctgtcatacggggacagcagggacactgggtggctaagggaacacgggcacccaggtgtgccgctcatctgggccagg

SEQ ID NO: 84556 - DNA, 1087 bp, Homo sapiens
ggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtggtgagtgcggggcccgggagagccactgccttctctctctgggatgcgtctggggcccctagtcacggcttcctccagcccgtcttgtcccactcatggcccttgacctctctcgaccttctgccacctgaggagacacagccccacttctgctgtggaggcaaaagccggaagctgcccagctgttctgcagacccgaggtccttcctccagctggtccgtgccaggcctcggtctcctgacctccccctcaccctgggtgcaccccggtcccactcgtgtggggctcccccttcacgccgctcactctcccctctccactccccgtccaccaggacggcctcacgagagccaccccctgtgtctcctgcccctgccccgcccccttctcccttggacccgcgtgggttccctgagcctccatacctgcacgatgagtcccttcccccacctcctcccttgggcttctgggacagcagagctgcagct

SEQ ID NO: 84557 - DNA, 8622 bp, Homo sapiens
tgattgccgcagattagccctgcaggttgtcagtccgtagggttaataagctagatatggatcgtgctaacgaggtgccacagtaaagagaatttaggggttctctgggccagcacctgcttccctaaactgcagccctcactacagggcagctccccacctggcttgtccccgcactgtagcacatcctcagggcgctgcctccagagacaggagggaagttctgaggattaaataacgtacgtcctgagtgtctgtttccaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggttggcatccccccgttcttcacacatccggcctgtcctggcatctgggtggttctgtagctttgtttccccgtagctagccggttccatgatgtggggcacaggaaagcgagttttcgccttgcccaccctcaaggccgagctgtgccctctgtctgcccccagctttccccttctgggtcagcctggacggcctctcacaggtttcccagcaagtgccatctatgaaaggctcgtatccgctagccgtgtaggtctggttggatttgagcaggtgaaggattacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcatcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaacttggtctttgtttcctctattctgtccccccaaccctttccataacactcttctccctaacctcttgcctgagccctccacgaccactccggcaccactctgctgaggagctcactgttggcgggaggggagagccttcgtgagaagattcctgggaagtcgtctacttgcggcaacggagaaatggtggaaaaaaatccaaaggaggcagagcccttctgaaggagagcacaggaggggtgcgggagcccccgcggctgcagcccttcccacagaggagccacagcctcgcccaccacacccagagcctcgccaggcagtccctgggcgctcggctcccacaccctcagaccgtgaggggctgctctcgggtcgaaccccagggttctcggaaggggctgccgtgttatgcggaacggtagaggagttgtgcttctccagcagtccctgacgcgggtgttactgtcttgtaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacgggtaagtcacggccacctgagctgcctgttcttttatgcagggatggtaggagctgccctgtggtgtttgcacagtgttgcccctctgatcagctcctcctcggatgctgggggcttacaggagcttctggactgcgggagaccccgcccaggtgtgtcactgccgagaagcctgcagtcttcattctaagatgccagccctgtctgtcagctgagctctgtctggtttcctcctgcctgtggctggtttccatgagtcgagcaaagtgtctctgcagaggcagggtgggaaccttcccgcagacacatctgcagagcctccctcctctgccattctggggagagctgttttgagcctgcctgtgacctctcgcttcctacctccaacagagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgc

SEQ ID NO: 84558 - DNA, 2142 bp, Homo sapiens
gaggcttcttgggagtgctgaatggaagggaagggaggtgcctcagaggagagcttcagaggcccacgtcttcctggtggcccttcttccccgagtcaggccttggcagagccttgcctctgcgctgcacctctgcagtttcaccccatgacctagaaaaccccagaacccgcagggcagctggaggaggattcagaggtgtctggcccctgatttccatccacaggagggcactggtcaggcagaggaggaggcatcttctgtgcccccgactcttggtgcttggggtcttctcttccccgcccctgcctcctgcctcttttaaaagacacagcacgtgagttgcgttagacgccagccgagtgttctgtaacgggtcagatgagtgcagggtgtgcttgttacgaggaggctgaggtggaaacagccgagctctcacaccgtgtcttgttagtgctctgtgttgatgccttcagatgcctccagcccagtccctgttgtggtgctgcaaggctggtacgctcctcgaagcaccatggcatgagatggaggttcctagaagcaagaagaaaggtacagtactgaccagttggccttgatttactgatgtgttttaaactgtgtctgccattttatatctgcactgtttggaggagggacggggaaggtggaattgaattacagacacgtgtattgaacagagacctgtcctgtgtgagccaggtcaccggtgctaagctgtcccaccgcattcatgtgtggtacgaggtctggggaggcccaggagaggtgcctggagtgagtggatgctcggtggaggcccaggcttagcagacttgaggggctggtaacgaggtgtttaaatggtctcacagtcactgctgagaggtgaggtgggcggcaccaatgctcccagcaccgctgtgctttccccatacacagaccttcctttctgctctgtcagctgtcaggtggacgcagggggctccgtaacattaggtaaggacctagctttggaggacaccatggcatgaaatctctcctccctctctccctcgcccgcctcacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccaggtgagcccggcctgtgggtggtccctggcgcagggaaggggctctgcctggtcgcagcctcatggctgtgctgaggacaagccctgtgcaaagggacctcgtgatggtggcctgggctcttgaagattggacaaagcaggaccaccccacagtaatgcccatctgtcccctccttggcctgcagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggtgggcaccctgtgcctggcaagggccagagagccccactggagccctgagcctcccccagtggagtcctgagcctccccccattggagccctgagcctccccccattggagccctgagcctccccccattggagccctgagcctcccccgctggagccctgagcctcaccccattggagccctgagcctccccccattggagccctgagcctcccccaattggagccctgagcctcccccgctggagccctgagcctccccccattggagccctgagcctcccccgctggagccctgagcctccccccattggagccctgagcctcccccggctggagccctgagcctacccccattggagccctgagcctaccccccgctggagccctgagcctcccccattggagccgtgagcctcccatcgggttggatgggctgtggcctcgtggggtgcgcgtctgctctgcagggctcggggtgttcacagccacactcactccagtggggttccc

SEQ ID NO: 84559 - DNA, 1050 bp, Homo sapiens
tgcgtgtctgcggagtgggaggtaagtggcgcatgtctgcggagtgggaggtggcgcgtgtctgcggagtgggaggtggcgcgtgtctgcggagtgggaggtaggtggcgcgtgtctgcggagtgggaggtggcgcgtgtctgcggagtgggaggtggcgcgtgtctgcggagtgggaggtagcgcgtgtctgcggagtgagaggtagcgcgtgtgtgtctcctctgctttctccacacacaccagcgatttcctgagcgtccctccggtgcgcaggatgagaaatgggccagagtcagggctgagccacagcccgaccccgggcttctgggtgaaggttctgcggtcggtgaccagcctcacacagccacgccctggggtgcagggagggtgttcattgcccaaataagagatgcgcttctcctggcatatgaaacaaaatcttgagagcttgagaatgtaatttggacatcacgactgaaagcatccctttcttttctaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggtaccagcccgcggcccctcctgcagtcagccctccacaggcagcccggagcagcccaggcagggcgtccctggcccccgcacctccggctttgcactgggacgcactctagcaccctgcacgccgtccaggcaagaggcagcaggggcggagcacaggcccccacatgccacctcctttgcacccgaggctcaggcccatggggccgattggagagcttcactcttgggtcccacacacgtggagatgcacccggtgcatgtccagccctgggcgaggtatggggctgctcacctgtgggtcttctgacagctggacacgggagggagacagtggttcccctcagggccacaaaggcacaggaagaaactccattgcttgtagtaaaaaccaaagggagccctaaaag

SEQ ID NO: 84560 - DNA, 1097 bp, Homo sapiens
gtggtgagtggggcgtgaggctggggctgtggacatgacctgccagacctgagggctggggtactgcgctgcgtgttgtgaccttgcctgtaatgcggggaagggactgccttgtggtgcctgaccgttttgggtgtagcctgtaccaggtgggacccaggatccaggtgctgctgactgccacccagaacacagccacaccctaggccatgcgtccctttctgccactacaaagtgcttgacccttctctgttctccttcctgctcaaagctgccattcctgttgctggtgacccctttatgggaggcgtatcctgagaagtcccttcctgggcctggcccgggccccagccctgatcagagcagctgcctgccttgactagttactgagtctgttgagtgcggtgtgagagtggatgagttttgagctgcctctgaattcagtgaattgtgtgtcttctcttttgaagcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggtaatgctgccccctcccagccctgcatgctcaccgcacccagatggggatgaggtgggaatggggtgctgcccgcctgtggcctgttctccgccctccggccctttcctcgtgcctctgtctgcagccaggagtggagagggtggtgaggagtgatctttcccaaagtggccttgctttttttgtatttgttatttggggaccgaagtcaagcgttaaataatagctttatgtacagaagttggcctgagcctcaatgtggctgcacgtttctacccccagaagtccaggatttctgtcctggctcctgttaggcctgtcaggcattcagatatcctgactgcaagcaatgctgggccacgttacttccaactgtggtttattctaaatgtgaataggaaaatgggatgccaatcaaaaccactgcattttattaatgtgcggttaacgctgattcctggtgtgcagacttcctgccttg

SEQ ID NO: 84561 - DNA, 1053 bp, Homo sapiens
gtacctgtgttgtgctttgaggcccagacgccaagatctagaagggccctgagagaagggaccaagtgcccatggtggtgtgaggtggagggtgggaagcagagctgtgggcggtggaggtgcagcactcccgccgtgggccgtggccgctgtgggcagtggaggtgcagcactcccgccgtgggctgtggccgctgtgggtggaggtgcagcactcctgccatgggccgtggctgctgttcgtggaggaggtgcagcactcccgccgtgggccgtggccgctgtgggtggaggtgcagcactcctgccgtgggccgtggccgctgtgggtggaggtgcagcactcccgccgtgggccgtggctgctgtgggctggtccatccgtgccagactctgccatctcttggccactttttgtttgtgcacgtttgtgcagagagagttaacccaaggaccttattttgcttttgtaggtatatcattatgcagatgaataggtgtgtgaggggattaaagccacgtttgcatacgtggcattgctcccagtgttaacggtgggatttatgggctggatggggtgggagaggaggcagtgggtggtcctttaatctggaattttttttatgccattatcctctatttacagctttcagaaatcagctggtgtcactgcacatatgtttagagccgttgctaaggtgacgagcccagcagcccacacaggccttctggaaccttctggaaggctgggaagctgcttggtggggtctgttcacgttggggccttatccctccaacctgtgagaatctgcagattgccctgttacaacttaaattgtctgcttccttttggtttgattgcctgattaataatttaaaacgaaaaatcctgtggtgtatttaatgcagagagaaatggacccacagcattgtttccaaaccgggtctgcttgccatgatggcagcagaagtccagtcttctccgcggatctcacccatctcattcaccttagaaacagagctgtgggtttcaggcttttcgcagtggaaacc

SEQ ID NO: 84562 - DNA, 1556 bp, Homo sapiens
tgcatgagggtgccctcatttctggccctctttcttcctgggcccctcagcctggagtgtcctcccggacgcttgcattgtgggcttatccctcagacgctgaggcagcgttcagacaaggaggagcctttatttgtgggtcattttggcagatgggattattttatcctcaagagggtaaaatctgtgtcactcgcttcagacagatggatattttctaggagtgtgtggacagcagtggcccgtgttggccctgacggggtctggagttgctggtcctgcctggaggcctggccaggcattcatagcaaggaggtgtctttggatggttgcagctcctgtctctttgtttgccatgtggaaataataccatctgttagctgaggctcgttagaggctccaaataaaataacgtatgaaagtaaagcaccgtgcagatgtaatttgaaatggatcgttaagccctagtgatgacttaggggctgggaatctgtcctgagccagggttgcccgtgtgtgctcctcccagagcacagactccagggtttgttcccagcctatagatgaggagattgaggcccgggaagtcctgcaccaaaagcttccgctgggagcaggaggggcggggccgggcttgaggagtggctggccgcctgcaccgatatttatgtctgtgatgtgcccctgggttcagtcggtcagagctggccgtgagtgtgggtgggtggatttcccacacccaaaacagcccgtgatccgtagtttccaacgtgccttcgttttccctactctgttggtccatgggagtgaggagcggagccttaccgcctgcgaagcataaactgtgtcagacatgggcgacgcggggaccgctggagggaggcgcgccctgacgcaggctgcactggtgactgctcagttggagacccttccttgaaaacatgagctgtgactcatctgtaataaacctgttagtcgtggtctgtgaaggtaattggtggtttatggatgtgactgaccaagttccggccagttgctgccttgtgttttctgactggggtgaggttctgaacgaggtgaattctggcaactccaagaggaggcactgtgtttcgcgtgcaccctcacatgcctccagcccacctcgagctctgtctcatttgctcgctcactcactcacacatacattatgtgttaggaatacctgtgtaccctggcttttaagagattacacataaaaacacaaatctgagctgatttttactttgaaataatttgccacaaattcagtttaagcaattaaagtgttggagcttataactaaatgtcaatttttctgtttttgggaacacaggtattgctttttaaaaaatgcgctcaggcccagtgcggtggctcacacctgtaatcccagcacttcgggaggccgagctgggtggatcactcttgaggtcaggagttcgagaccagcctggccaacatggtgaaaccccgtctccactaaaaatacaaaaacatgagccaggcgtggtggcacacacctgtaatcccagcta

SEQ ID NO: 84563 - DNA, 1831 bp, Homo sapiens
caggggacactcgggtttgctgttgggaaccatgctgtgtgaactgtgaacgtcgaagtacaactgtcttttgggggccctgctttcagttcttttgtatatctacccagaaggggaactgctggatcatatgcttagtccttttgtaatttgttgaggaatcgtcacactgtttttttttggcagttgcaccattatatgttcccaccagcaatgcacgaggattcctgtttctccacaagctcacctgccccctggttccctgtgaggtgctggagactggcagcaagtgtcctgtccccgggacacgtggtgagcacagtccctgactgcccttccttcatggtgtgacttttatcagcagatttgacagatgagaggtgaatcctgggtgtgttgaagctgactcaccccgcccccaaccccactcatcttcgaaggtgtgttgtagctctggccgagcctacctctgagcagtgcccctagatggctccaccttccttacactgtccctcctacagactcatcctcatccccaccactgccctttggctattctgtggtagatttttagaataaaagatgtcaagcctggctgttgaaccattagcattgggacatgccctgctgacaaggcagccaccaacccctccaagatggtcacaggtcacttgggagctggcccttcccagcagcaggatgcctgggactccgggagattacagccacagggcctgggagaagcctcaggcttttgttgtttattatgtgcattatccttttggggtccccaaaattgtaccattacgttctttttttttcttttttctttttttttttttttgagacggagtcttgctgtgtcgcccaggctagagtgcagtggtgcgatcttggctcactgcaagctcggcctcccgggttcataccattctcctgcctcagcctcccaagtagctgggactacaggcacccaccaccacgcctggctaattttttttttttttttgtatttttagtagagatggggttttactgtgttagccaggatggtctcgatctcctgacctcgtgatccgcccgcctcggcctcccaaagagctgggattataggcgtgagccaccgcgcctggccctgttacattctttatagagctgacattggaacaagcagtgtctgcttgaaagcactgttctgaatgtgtccagctgctccatctggcttccggagctggtgtcatcatctaggcagggttggctgatggatcacatccttctcacctcagcggatggcttgccaccgagaactgtgcgtgtctctggaattctccactttactcccttgacaaagatgtctcctttggacgtcctgaaagtctgtaatcagtttttaaaaacccacaatagttcattgtttgtaacctataaatgttataaacaaagatgatcagaaacgtgagaattaaaaaatacttgtgttttgttagtgaaaagcactagttcatagtaactaaggttttccagattctttcttgtatttgttttgagacaagtctcactccagtgcccaggctggagtgcaggggcgctatctgggctcactgtcgcctcagcccccagggcggggctcatgtgatcctcccacctcagcctcccaactcatttctggtggtcttgggcgagtcacttagcgttcctgagccctggtctcccgagctgtgctggggggagcaccctgttcctgtggtgtttatctcatcggtcactctgcctttccattgggctgcgcacaggagagccacagacccttgccgtgaaccgccgtggcagg

SEQ ID NO: 84564 - DNA, 1050 bp, Homo sapiens
ccttccattgagtgtgtgtgtgtgtgtgttttaaatcagcgtgtcacttggtcggctgggcaggaatgcagtggcatggcacaatgatagctcaccacaccctccaactcccgggctcaagctgtcctcctgctcaggctcctgagttgctgggactgcaggcatgtatgccatcatacctgggtaattttttttttcttttttgtagagacagggttttgccacgatggccaggctggtctcgaactttttgcctcagtcagtcctccttgccgcagcctcctgaagtgctgtgctccaggcatgagtcaccgcatagggctagcactccacttcctgactggaacctgcaggcccgtgttcttccagtctaccacagagagtgtgtttgtttcacaggggcctgggccacatacacgggaagcagcgtgtggtgcttggtggacataaagtgagtgaggcttggcacacagagtgcgtttgaatttgacagaatgcaaagaaagttttggtggtttctcctagattctggactcagaattgtgaactatgtaaggttttttttcccccttgagagatttcaaaactttgcaagactgaatcttttttttttttaattttattattattatacttttagggtacatgtgcacaacgtgcaggtttgttacatatgtatacatgtgccatgttggtgtgctgcacccattaactcgtcatttagcattaggtatatctcctaatgcagactgaatcttactccttggctggcatttaagcataaataacaaattcgcatgcaccgtcaaatacagggtgaatttagagactgcttcagaaggcagagtataggaaaaaattttaaatgaaaacttacctatttctgatcagaattcttttatctggaaacatcgtatattttttttaacagggataggcgtgttcccagctgtttgaaatgcttgtgccctggtgccgtaaagaaatagcacttgaacgtaaatttaatttcctcagcaaggccattttttataccttctgcagaaaggg

SEQ ID NO: 84565 - DNA, 1088 bp, Homo sapiens
tcaacacagtgcatgccacgggctctgggaggcggctgccacggcgatgggtcctgaggtcacaaacagcggctgccagcctggggaaacactggagtgtgtcccatgtaggagtggaagctttcgtcctgtgaagcttttattttccaggggtgtgtgtgtgtgtgtgtgtgtgtgtgtgtgtgtgtgtgtgtactgcatcacgatgtacaacatgaatatattccttgttagcccagtgacttctgcacaccagactgaggtgtaaataagtgaccagatgtggcaaattctccccttagcactgtggggaataagttgatggtgtgtgtggctggaggtggagataattaagttgttatgatgatgtaggtaaagaaatactgagacactcttgaactagaagtcagagcggttgcagtagggaggagtgacagtgatgggggggagctggaaatggacaggatttataagtgggcttttgatagggaggaggaggcagctggtttctgccttggagggttagacagtggtgccctgcagcaaggcaggggatacaggaaggagtggggtgagggctctgtatgtgcacagcctgtgtgaggagagccgagtaaggtgggaacattgtctctgattgacagtgtctctagttggacattgttgcagtgggttcagtgggttcaactctgattggcagagctgggattcagcagcacgtcgttaaagccagaggcaggtgagagtgcccctgcagtggctgaagacaacattgagggaggaggtggaggaaggagatgtagcaagtgaaacaaaatggaaacaaagttcacaagagaaaccgggaatggtggggtggaagcctgggaagagagtggtttgtaggttcagtgctactgcgagaccatgctagatgagtgccagttatgttccatgtttctcacaagaaacacagaggtggcatctgttaagggctgtcgtgggggttgaatgaggcgatgcgtggagagcacagagtgggtgtgcctgggtgtgtgatcatcatggtgtggccagtggtggtgatgggaggggcagccactcaccag

SEQ ID NO: 84566 - DNA, 1040 bp, Homo sapiens
tttagctagacagcgctgattgatgcatttgtacagagtgctgattggtgcatttacagacctttagctagacagaagagttttccaagtccccacccgacccagaagcccagctggcttcacctctcatgaagagctggtggctgtgggtgtatcagttggtcttgggctcccagcagttgagtgttcacacctgggcctgcgccctgcttcacctagccatccgcatggacacttcagtttgtcgtgggttttcttgtgccttggtgcagtctcaccagttagagcataacttcctcagggcaaggctgccccagacagccagtgtcctcgccgcgtctccatccagtgctttcctgtctttgttattagatgctcatcaaacatgaggccactacaaactagaagaccttggctagagtcctgagaccttgtgtgtgtggtgtggctgtgtgagtctctgcccatcccacacgccactctttaataagagcagattttggacctcaggagacatctgttgtggaatttataggcatggattgtcgggccagctttccttctgctgattagctgctgaccagccgcatgcttctgcagccttactgtgacaggtggggctcaggtggcctgggcaggggtgaggcacaggactgcgcggtgctgctcctcctggctgcagcgacttcgctggattctctcatttttatggctttctttctcagactaggtctttccgacttgcgtggagaagaagagtatgagaattctcaagttagagaagaattgctttatggtcattatttcgacaactgtatgactgggagtttgggtgaggaagggctagatcagtgatttttttttaaattagatttacttggaaaacattaaaaaaattgcagttcacccccagacacacagaatccatagtgtcttgaggaggtgagtgtgtgtagggtgcaccatgggtgagtggcatcttggaggcactggggtgctgctgccgtatggcccttctcttggtcctgtttgcatttggg

SEQ ID NO: 84567 - DNA, 2500 bp, Homo sapiens
caggggctatggtaatcgtctctgttgttcgaatttttagtacatgtgctggccaaagcaagcatgccatgcttgccttgactgtgaacaagttcgatttgaaatacttcacatttgaggccgggtgaggtggctcacacctgtaatcccagcactttggaggccagggcgggcagatcacttgaggtcagggtgaaaccctgtctctactgaaaatataaaaattagctgggcgtggtgatgcatgcctgtaatccgagctacacgggggctgaggcaggagaattgcttgggcctgggaggcagaggtcgcagtgagccaagattgcaccattgcactccagtctggatgacagagcgagattctgtttcaaaaaaataagaagaaaaaaatgaaatacttcacatttgaaaaacttcctggctagaggaaaaatccttgcttatgtctaatgaaagaggcagaggctgggtgctgtggtgaggtgttgagtgacagtgtcagggcccgtgggaggtggtggccggcttgtgctgtaaggggcaggagcgccggaggctcaccaggccgtgatggggttggagtgagaatagggcacacaccttcctgccaccggggagcagggtaaacagcagaaccttgctgtgcgtgtctgggttccagcaacattcctggtgggtggtggggaggaaaggactaaccgtgtcagcacctggcctttgtgggacacaggcctcctccctggagcttcagctttatctggaaatgagtctttgatgcgtaaaaccgttcctgaatgatactgtccagctggtggaaacaggtttgttttgacctaaaatctaggggtattgagagagagagaaacagagacaaacagcgtgtgggggaagctgtgcataaaggggcgtttgtgggattgtcttttactcaggatccagcttgagccaaaatggaggaagagtcttggtctctacaaaacaggtggttttctgagacagattcaaaagcattttctagagaagctctactgcatccctccatcacattcaaaacattgtttctaattatgttttgagagtgtagagttagattgtagaatactgaaattaaatccttagtgaggaaagcgtagacatgacctggcatgttctccaaagcactggcaccagtgggcgtgcgttgtcagctggggtgtcctccctctgctgagcctcctccccctgcggccttcgccttggccctcggtgcactgcatcggtgtgccaactgctcactgtgcacagacctttttcatactgatgaattcatgtttattactttttaaaaagtttatttcttggatcttagtcacagctaaccctgattttgctttcagtacaaggatttttaatttctagaccggatttgagttgtttgaacggaggtctggtggctttgggaaaggtctttgcatggatgatgggggaaggtgcctttttggtgagtgccatagtcggctgccaccttgccatccagagagattcctgcttgtggacactgttcagttatgcagggtatgtttaattttttaagagtcaggtttgcgttttttttttttttttttttttttttgtaggcggagtctcgctctgttgcccaggctggagtgcagtggcacgatcttggctcactgcatagtccgcctcctgggttcatgccattctcctgcctcagcctcccgagtagctgggactgcaggtgcccaccaccacacccagctaattttttgtatttttagtagaggtggggttttaccatgttagccaggatggtctccatctgctgacctcgtgatccgcccgccttggcctcccaaagtgctgggattacaggcgtgagccaccgcgcccggccaggtttgcgtattttttaataattctttttctgaagtttttttcctgactgcttttgttgctgggtgatggaatatattctgacattggatgtgcaagatcttaaaaaagtctgtgtaatagagtctgtgtaagagagcctgtgttgagaagttctgtagtctcttcagaatgaaaattcatttaaatattttaggacttcactccagagggttttagcgcatgcatagcgaggaaacttttttttttttgagacggagtctcactttgtggcccaggctggagtgcagtggctcgatcctggctcactgcgatctctgcctctcaggttcacgccattttcctgcctcagcctcccgagtagctgggactacaggcgcccaccaccacgcccggctaatttttgtatttttagtagagacagggtttcacggtgttagccaggatggtctcgatctcctgacctcatgatctgcccgcctcggcctcccaaagtgctgggattacaggcgtgagccactgtgtctggccgcaaggaaacttattttttataaaccacgatgcgctctctctttccgttttgactgtgacacacaccagccac

SEQ ID NO: 84568 - DNA, 1018 bp, Homo sapiens
cgggcagaggttgcagtctcggcactttgggaggccaaggcaggcggctgggaggtggaggttgtagcgagccgagatcatgccactgcactccagcctgggcaccattgagcactgagtgaacgagactccgtctgcaatcccggcacctcgggaggccgaggctggcggatcacttgcggttaggggctggagaccggcctggccaacacagcgaaaccccgtctccaccaaaaccagtcaggcgtggcggcgtgagcctgcaatcgcaggcactcggcaggctgagtcaggagaatcaggcaggggggttgcagtgagccgagatggcagcagtacagtccagcttcgactcagcatgagagggagaccgtggaaagagagggagagggagaccatggggagagggagagggagagagggagagggagagggggagagggagagggggagggagagggagcgtgacgctttttttaaatgaagctcgtgacagacggaagtataccagtgattaagaagatgctgggatgggctttttcaatagatgctctgcaggtttccaaaatgagtgccagaggaggggagagggcagtgtcagagtcttctgaacattctgagagctgagctgctgtgagacaggcttaaatgagaaccctagttttcaaaacttaatgttttaatgggaatgaccatagttattagtgttaaaagatacatttcttcttatttatttagaagatgaagttcagagaatttaggtagcctaaataagatggcatagttagtaattctatgagcttttccttgtttagtaaatcggtattaaaatggaattattaagtggggtgtggtggctcacgcctgtagtctcagcactttcggaggccgagggaagcagataacgtgagcacaggcgtttgagaccagcctgggcaaatgaagataccctgtttctacaaaaaatacaaaagttagccaggcgtggtggcaggtgcctgtggtcccagctcctcag

SEQ ID NO: 84569 - DNA, 1007 bp, Homo sapiens
acacacagaagcgactttttcctttgtctcatggtggaatgctggaggagcaagtgttcccacctgctgagcagctgaaagcaggctttccgcggatgtgtgcgggcgggcggtgtggcacagaaaggcctcgatggactgtctgctcttcacggcaagagtgtgctgcccctgttctctgtcgtggcctctgctgtaaagatgagagaagtccaacgccagtctaattcatgattcttttttagttaagctttttaggattttgtggaaacttgtaggattttctgttgatatgtgggagtctgacattttgctatttttagggtttagattgtgacttttttatattggttagcatcttgaagctcttttaatatgcagacttgtctttttaactccatctcagtttttctgtcaagggccagttagaccttgtggccgcatgttctctgacagctcttcagctctgctgttgtatcatggaaggaaccggggccacacttaaaacgagcctggctgttttccagttacaactattactaacactgaaattagaatttcatataattttcacttaccacaaaatgttattttctttttcaaccaggtataaatataaacctcattcttagcctgtggactgtctaaaaaagacattgggccagattcggcccctgacccccaggtggtttccccatcatagtaatcatagtagatgaacttggaactgtgtagctttattggtttttcatccttgaagcttgcttttcctctgcagtggtcctgactttctgtagagtttgatctctgcggcttcttccttctgtagagtttggtctctgttttctctaaacttaagttatttgtctgatttcatttactttctgttaatttaggtgcttaattctggtcaactattgacatgtcattcttctgttttccagtgctgttacagatttattcttttctttttttctttttcttttcttttcttttttttttttttt

SEQ ID NO: 84570 - DNA, 1992 bp, Homo sapiens
ctgtcgcccaggctggagtgcagtggcatcatctcagctcactgcaacctctgcctcctgagttcaagcaactctccttcctcatcctcccaagtagctgggattacaggtgtccgccaccacgcccggataatttttgtatttttagtagagaggaggtttcatcatgtgggccaagctggtcctgacctcaggtgatctgcccacctctacctcccagagtgctgggattataggcgtgaggcaccacacctggtcatgaaatcatatcttaagtgtctccatggtggcctaatttgttacctgaagctttttctcagagcagcctctagcaaagagaatcacttcctgtggactccttcagggctgcagggtaacttgatgagttcttgccgtctcgtgaattcctgagtggtgagagcaccactccacacaggacttcggggcagcaggcttttaggttttgcacacagttcctcgaaagctgtgatttggaaatcgctagaatttccagatagtaactagtttggagggtcaatagtgctttagttttatttatttatttttttttacttttaaaacagaggtggggtctcactctgctgtcaggctgatctccagcttctgagctcaaatgatcctcctgccttggcctcccagagtgctgggattacaggagtgagccactgcgcccagcctcagtcatgcttttaaattgaggatgtaggaaggaaggctttggctcccatgctttcatgagatttccttttttttctgagacagagtctcgctctgtcgcccaggctggagtgcagtggcatgatctcagctcactgcaagctccgcctcccaggttcacaccactctcctgcctcagcctcccgagtaactgggactacaaatgtccgccaccgtgcccagctaatttttttttgtattttttagtagagacggggtttcaccgtgttagccaggatagtcttgatctcctgaccttgtgatccacccgcctggtactaccaaagtgctgggattacaggcatgagccaccgcgcccggccacgcccggctaattttttgtatttttagtagagactgggtttcgccatgttagccaggatggtctcgatctcctgaccttgtgatctacctgcctttgcctcccaaagtgctgggattagaggcgtgagccatcgcacctggctgctttcatgagatttcttagagactaatactttagtatttaccctcctttctcagtctatggtgttaaccagtattccctacctacgtttagtctgtacacaaaacacccatggctgcctctcctcagactgacctgcgttgacctggacctggataagctcctcactgtcatctgaggggtgtgtttccccttgtgtgcctgtcctaatagtgcatcccatttcagcgctttttctacagggcaggatttgtagaaagggtttgaatcttagtgataagctatgaccatgagtaagttacttcatttttcctcgcttttggttttcttgtaagaattgggattataggccggtgacattataggcatggtgactcacgcctgtaatcccagcgctttgggaggccggggcaggcagatcacaagttcaggacacggagaccatcctggctaacacggtgaaaccccgtctctactaaaaatacaaaaaaattagccgggcgtggtggcgggcgcctgtagtcccagctactcgagaggctgaggtaggagagtggcgtgaacccgggaagtggaggttgcaatgagccgagatcgcaccactgcgctccagcctgagcgacagagtgagctccgtcaaaaacaaaagaaaaggaaaaagtacaactgactttgtttttctgaaacggagcctcactctgtctccgggcgcgatcttggctccctgcaactgccgctcccgggttcacgccattctcctgcctcagcctcccgagtagctgggacta

SEQ ID NO: 84571 - DNA, 2981 bp, Homo sapiens
taaatgctgtgggctttgttctccagtggagtggtcattgccttttttcctacctgtgagttagtccatctctccaacccactgacgacccaagagctccccagcctttctctgcccgtcacagtcaagagggtctgttggaaaattactgactgaacaacagatgccagagattgccctgaattgtggaagtcccggctgccacccccttacttgaggtcctcatctcactgcaccagcaggggtgaggagagggcaggggtggccctgcacaaagctggggaagaaaggaggcagctcccggccaggcagggcccagctttccttctagatcatcagcacaaatttgcgtttgaagatttaacttacattttatttttttatttggatgatacatgtgtaagttttgggatgttatgcagtgttctgaggattgacgttggtggcatatgtaaccttgaaggcagcattttgttaattataaaaaacttggaatatagtgattgagtatgaaataattgaagctgtgagttcagttatgaagaacttggtctcggagtctctctgagcttgggaggctgccttggtctcagtggggttggcatcatgtgtgttggtggtaggttggaaagagcatttggagttctgaagagtgacctgtgctgcctttctggcaaccagtcattatttgtgcatggaaggaagtagcatggatgaaagcttttctttcaaatgggatgatgtgtgggggtatatttctggtcttaaatttttttttttttttttacataaggtagagacagggtctcaccatgttgcccaggctggtctcaaggtcctgggctcagtcattccttccaccttggcctcccatagtgctgggattacaggcatgagtcaccatgccaggccagtgtatttattttctactgctgtgtaacaaattgacacacaacacatttattatctcacagtttctgtgggttggaagtctgggcacagcttagtgggatcctctgctcagggtttcatccggttgcaatctaggtgttgggtgggactgtgatcttatcagaggctcgagtgggggatggtgtgcttttgagctctttcaggttgtggcagaagttatctcttgctgattgtgggacgcaagtctttgttttcttgttgactgtcccttgaggtctcctcttgactcttagaggccccctgtacttgcttggcgcatggccccttgcagcttggcagctcacttcaaaacagcaaagagtcttctgcttcagtagactaagtcttacgtaacataatgtagtcatgggagtgacagcgcagcaactttgccacctaatgcaacccagtcaagggaaagccattccattgttttcaccacattctgtgggttagaagcacgtcacaggtcccacccgccttgcactccgggcaaggtggctacaaggaggcatggacactgggtggggagattgccaggctcacctagggtctgtctgctggcctggggtgttcttcagaaccctcattccctggatactgacatgtcagtctctgggaattggttgcatctctctctcctccatgacgtatcagtctgtgggagagcggtgcgtctcttctctctcctccatttgcatgcattcccggacccacttgtagaacggaagtagaatcaagactcgtggccacagtttgggtggatgggacacttgggcttgccctggtactatcaggctgtttgccctatgccttgcatttcccactgtcctgcctgcctctcaggcttatggtgaggatgaggtgagatgagatgatggatgtggtcagtgaagcagctggtcagggcctggtggaattctactctagtccagtctgcctctttctccacctctattctctaggcagagattggttattttcagtagtaagtatggactcatcagagttcttgaggtctttgcttcctgcctcaaattcccttctctcctttccctgactgatgcctactcatccttcaggcctccatgttcccaatgatccttttttttttttgaggcagggtcttgctttcttgcctcggctggagggcagtggtgtgatcctgacttattgcagccttgacctcctgggctcaagccaagctgtcctgggtagctgggaccacaggtgtgtaccaccacacctggctaatgtttgtactttttgtagagtcggggtctcactgtgttgcccaggctggtctcccaacttctgggctcaagtgatcctcctgcctcagcctcccacagtgctgggatcacagacatgagccactatgtctggcccccagtgagcctcttgatctcatggttgagctcttttttcacttgtgacttctgccattggttagattctcacctttggtcttgcggtgctctctgctcccctctgtggtaataatttattgttgtgttgtaattatcttttacttcctttccactaagtgatattcattggatcctcaaataaaaggcttggcacacttagggcagatacctaataaaacagtaacacctctgtggtcagtatttaaacggtgtgcacagccattagaatggaataagctgggcgcagtggaatgggaggttgatgttgcagtgacacatgaatgtgccactgccctccagcctgggggacagagcaagagctcatctcaaataaatcaataaatgggtcagaggagtgtgatgtgctggtgactcgggtcctgctctgccgccggagcttttccagccttgctgctcctttgctttggatcttttcattcctaggtttattgttgagtctgagacggttttttttctcccttccccttccccttagtaaatgtgcagatctcctgatattgcacctgacttagagatcttggtaccgtccctacagatccacacaaacacaaaagcacaggtgatactcaggttggaaca

SEQ ID NO: 84572 - DNA, 1351 bp, Homo sapiens
gctaattctctcgtgttttaaatagtagacaaagaaagacaagaccaaaggagaacctttttctctgtttcttactccgtctgcttttattaatagatgctcacggtgtggtcttccactcacttcccctttcatctctgagcttaacgagctcctcgtattatagattgttaccatatcatgtgttccagtctgtgcccgtgtataaacgtgtgttgtgtgttacgcgatactgtgagatgagtctgcccagagggactctgaagtcaggactgtgtcttttccacacctctccaccccagctctcatcatgcctctgagagaaccagattcagagtgtggtgaggggaggatgaagtggtttggggtgggccttgggcccccatctctttgctggaagtgtagtatacctctaggatatgtgtccaaactgttggctgtgagaccaaggaggagaagtcttttttggcaggctagtgcctgcggcttgaggtctcagtgtctgtaactgccaggctgcagagccccacctggctgagtcaggagtgtgttgtaacctgcccacctgcccaggctggttagaagcaagcgtaggcgttgggtctgcctgtcctggtccaggcacctctcctggtttggccaggttttggtttgtatttattcctgatgttgatgtgtaaatgatatcgttacaaagcaggtagtttgctttgctattctacgaataacccaagaacctgaggataataggacacgttaacagtctgctagttgagagttctgtttctgtgacttcaggggacatatgaccatcccgattgtggtgggttattaaggctgtgacaagtcacaggtggctttagggatgtcaaagataggcaaagataggttcatttgaatttgatttcatcttttgagaatgggttggtatacctgaaattggctttgtagttttggtattttgatgtgagaaggcattggctgaattttttttgttctcataatttgcatattttctgtgttttctccattgtttggctcagttgttttctttttctttttttttttttttgagacacagtctcgctctatcactcaggctggagtgcagtggcgtgatcttggctccctgcaacctccacctcccggtttcaagcacttcatctgcctcagcctcccaagtagctgggactacaggtgcccaccaccacgcctggttaatttttaaatttttttagtagagacagggtttcaccatgttggccaggctggtcttgaactcctcacctcaattgatccacccaccttggcttcccaaaatgctgggattccaggtgtgagcccccgcacc

SEQ ID NO: 84573 - DNA, 1238 bp, Homo sapiens
cgtgaccatatctcactgcatccttgagcttctgggctcaagtgagcctcctgcgtcaacgtcatgagtggctagaactacagacgtgcgctaatttttaaaaattctttgtagaaatggggtttcgctatgtttcttaggctgatgttgaactcctggcctcaagtagtcctcctgcctcagcctcccaaagtgctgggatgacaggcacaagacatcacatgcagccttaagaagatccctacaagagaacctggagaaacttgaaatagggaaggggactcgaaagcacactgtgtaggtgaattgtgaagacttcatggtgttaactggtattcattaaaaagacttggaaaaagagaagatgaattgattcccagtggagggaatggggcaaacattagttaggagagtggctttgtgaaacgatagagcaaaggagacagaaaagaaagcaggaatggggaacggggtggtggggcagaagctgggtgctgtttattttgtgcctactgtgtgtcactctccattctctgccctggggacatttgacagatgtggacgtcactggtgtgatttgcccacattctggagggagaagtgggcatctcagttgaggaaaggaaatggctatctggggaattcttgaggggcacagcccaggacggagccttgtgttagatgggtacctgctggctctgctcagctcggcagatgtgttgcctaaatgactttaatggccaaggcagactggtatttgccctcagatattttgtcaggacagtgtaaaatgtgggccaagatagtggttttgggtccaaacagaagggggttagagattttggaggttgaagcctgctgctagaaggagtatagaaagaagaacggggattctgtttgcccaaatacatggttaggctcatcttggacttgtttttgttttatatcttctgttacttctatgcacatattaatagatacctaattaatatttggttggaaatcttaaaagttaggattttttttttctttttttttgagatggagtctcactctgtcgcccaggctggagtgcagtggtgtgatctcggctcactgcaacctccgcctcctgggttcacgcgattctcctgcctcagcctcccgagtagctgggactacaggcacccaccaccaggctcggctaatttttttgtatttttaatagagtcagggtttcgccatgttagccagaatgg

SEQ ID NO: 84574 - DNA, 1006 bp, Homo sapiens
ggctcttttcagacttaggatgctaatggcttagaataaattttggaatgcagtatttccaagtaaagggaagattgcgtaggctgcttggttcctgaggttttactagagttaggattagcttactgctgcattcatatctgacacaatcaaagaagactttggtttaattctggatgatgatgtaaacttgaaatcattatggctgtactgtttaaacttatctaaaatagagaaggtaagacgcagtgaaggaccttatttttctcttaagaaatcaagctttgttagtatccaccatgtttctagatgtggttttacatcttgcaaaacaggaaataaaagtaaaaaaccaaaaaaaccccagagcaccactcttgaaaggattaagtttttaaaaatgattttgactaagatgtctggctgattaaaggatgtgcagagcactgaataacctttgccttttctgatggtgacaaagaagaaatccagctttcaggcagccgaagagcgtctcgagagcttgtagtgttagtattccacagccccacagttgattcggatttcaaggaatttttagactttgtggattttttcttcactataattgtatgtttggctcctaatttatttaaattacatacatagatatttttgttactttgagaatagtctatctgaaatttgaagttctttagagcttaatatattaaatatgctaacactcaaaacattttctttctttttttttttttttgagatggagtttccctcttgttgcccaggcatgatcttggctcaccgcaacctccgcctcccgggttcaggcgattctcctacctcatcttcccgagtagctgggattacaggcacgcgccaccactcctggctaattttgtatttttcgtagagacggggtttctccgtgttggtcaggctggtctcaaactcccgacctcaggtgatctgcctgccttggcctcccaaagggctgggattacaggcg

SEQ ID NO: 84575 - DNA, 1010 bp, Homo sapiens
agaaagtgctttctgtgaaagcacttttagcaggactgctgttttcaggccagagtagaagggccagaagcagtttttattcagatttcctcatcgtttccatcaaggtctcagtgactgtaaaggatgggttgaaatcagtctggactaagtgtggtttgctgctgctgcttatgaggattaagtgtctcgtttgtccggaggcccctctggtcacatgtagctgagcaggtggagtgatatgaaagttttagcattttaatgaagaaaaaatgatctctttggagggaaagacaacgaaatggaggtgtgccctattgatttttttctgtatgtttaggttttcaaagtttctttgtaaatgaaactgttatgtaattggcaaaagtttgctttttaaagactaattgtgggtatatttgggagattgcgacttgttttagatttttgggtttacagtaaggggctagggtatttggtggaggggaactggttgattgtggttgaaaacattcagatactattctagctctaagaaacctcacagttttgttttgttttgagacagagtctctgtcacctaggctggagtgcagtggcacgatcttgggtcatagcaacctctgcctcccggattcaagtgattcttctgcctcagcctcccgagtagctgggactacaggcccataccaccactcccagttagtgtttttttttttttttttttaaagtagagatggggtttccccatgttggtcaggctggtctggaacccctgacctcaggtgatccagccgtcttggcctcccaaagtgctgggattacaggtgtgaactaccgcgcctagccagaaaccccacagtgctaaagctggctctgtgaataaagggttaagagggttttcagtgtgaaaataaaagtaagccgtcctgtctgtatggctgagatttttcaggggcctagaggaccgaatcctgttgagtgaaaatccagtcttctgggcttcccca

SEQ ID NO: 84576 - DNA, 3285 bp, Homo sapiens
ggtggccgggggcccgcggcggctctgaggggccgattgggggctccggggcgggcctgggggccgtgggggcccggggcggccgtgagaggcggacagggggctccggggcgggcctcgggggctcggagcggccgtgaggggcggacggggggcttcggggcgggcctgcaggtcttggggacctgaggctgccgggaggggctgccagggggcgctggccgggcgccgggttctgcggagctggggcgccgacctctgacccgcgagaggggcgccttcgccgtgctggtcgtagttgttattctcagcgtccctattattatcgctgttttgaaatgagagcaggcggctctcgggctccgagccggagggggagggcgaactggggacctgggggcgtcggggttgcaggaggcgcgcgtaggccgaggaggggcaggaatgcgggcagccgtgtggggggtgttagggggagggtaggcgggcgggtgtggggggtggctgggaggaaagcggtggcggtggcggctgcaacagcagcccttggcctcaaggaacaatgtgagacgttgcctgaaatgttaatttccgttcctcatttcatcatcccctggcagggcggtagctgtgtgtgtggtgtatgtgtgtgcgcgcgcgcgcgcgcgcgcgtgtgtgtgtgtgtgtagggttggccctgccacattgattcagtcccctctcaaagagggattgtactgttaactcttgtgtttgtgttatttgggaaggttggtcggggggagtcttgatttttctcgaggcttgctcttttcctggtgccccattaagattttctgcttctgttgtgtttttggaaggttagtgttatatatcagcttccaagaagttttggaagaggcttgggaagatgaagctggtctaacagctccctatgctttgaaactgttttccttctatgtaacatgcttaggattcatcgtttttgtagattatgagtagttttgtatccttttgcaagaacagggttttatggtagagaaattagatttcaggctttcttacatgaggagagagttttatgcagtcattagagcaatatccttaacacttgaaatgagaaataaaagtgtgcacagttgttgaactgcaaaacttagagaatcttttgatcctttttgggatgttgagacttagccaaacatataagatgatattacctgtggaaaaagtgccatcgaaacagttactgtttttgttgtgtgcagacctagtctatggcataacgttcaaaatcggagaccctgaggctgtttctttggtttctctgagaccttgatttctcttagtaagtattggctgccctggaagacttcgagttctgttagagaatgattacagaagtcctctgattttactctgcaactgtagttaaactagaaaaaaaggggggggggcggatgtcttgctcagccttcattgtgacccttgcattggatctcgtatagttggtgtggcctcccctaccctccattcagctgttgttctcctctttctgtagtttctccccgaagagcaggatctccttcgataggctggccatctgaatggaactggatgggagggaacaaagaccaagttgctgtgacgttttctctgttcttcgtgatgcctcttaagtttgttgaaaagttccccacaagatagtgctaaatttgacctaaacttgaaactttcagcagtttttttcttctgttctatttttgctgtagtaaaatatacataacacaatttaccagaattttgtttttaaaggtgtcacctttaaaacctgagttcctcttttgcagctctcatttgcgtcagccttctgacttgcattgccaccgccagatgcttttctccggactggccatgctgggcaccccataccagcagtgccatcacaccctcccagatgggctgttgatgacgagcggctgccatgttagcggtaattacagtgttgatacggtggcaagtagaactccctacaaatagagtgaaggaaactatgctgtttgtgttggacagtatttttccaagaagtttttgtgcccctttttattttattttatttttatttttttggagtctcgctctgtcgcccaggctggagtgcagtggcgcaatcttggctcattgcaacctccgtctcctggggttcaagcagttctctgcctcagcctcccgagtagctgggattacaggcgcccaccgccacgcctggctaatttttgtatttttagtagagatggggtttcaccatgttggccacgctggtcttgaactcctaaccttgtgatccacctgccttggcctcccaaagtgctgggattacaggcgtgagccaccgcgcccggcctctttttgtgcctttttaagtagatttgacatagaaaggttatgcttcatcaaatataagaggagtcttattttgcatatgggcagagagcccatcatcaattaaataacataattagagagtatcagtaaatgctggctcagaaaataatctgcattttgttgccaaaataagtgttttgatctgtccattactctgtgtaactcccttcatcctcaaatcgtaagtgtaatgggtgagtgtctcttaatagcaaggtatttgtagttaatcggtgaaaatgatggtgcatcccttgtctggtggctgcgtcagtttgtgactcttgtgtagtcagtgctctgtgggaattcagtgtggcccgtttgataaactttatagaaaaatggaatgaattcaaataaaagttattgtcttgaaattttgaaatgttttcagtgtgtgttctcttaatttgaaattgtttttttcttttttttttttttgagacggagtctcgctttgttgcccaggctggagtgcagtggcatgatctcgactcactgcaacctccacctcctgggtttaagcaattctcctgcctcagcctcccaagtagctgggattacagacacctcctaccaaacacggctaatttttttttattgttagtagagactggagtttcaccatgttggccaggctggtttcaaactcctgacctcaagtgatccacctgcctcggcctcccaaagtgctgggattatagacgtgagccaccatgcctggcctcaaatgttatttttatgataacgtcccaaatggtgactgtggcctaactctgataccatgccccattcttgaccctgccccaagcttccagtcattctggctgcgttggc

SEQ ID NO: 84577 - DNA, 1030 bp, Homo sapiens
ccagcctggagtgcagtggtgctatctcggcttactgcaacctctgcctcccgggttcaagcgattctcctgcctcagcttcctgagtagctgagattacaggtgtgcaccaccacgcccggctaatttttgtatttttagtagagatgaggtttcaccatgttggccaggctggtctcaaactcctgacttcatgtgatccacccgcctcagcctcccaaagtgttgggattacagccgtgagccaccacgcctggccaattactgtgttttaacctgtttacttgcttttgacattttgatgttacctaaagctttgacctattgctcagactattactttatatttcagggcaatgtagatattacaaataattatatatttgaacttttaaaaacgatttttagtctgcattgctttggtactctctaatgttggtgtgacctccagtattgtttttttttttttttcagagcttacaattgagactgctaacccctacctttgaagggatcaacggattgttgttgaaacaacatttagttcagaatccagtcagactctggcaacttttaggtatgtatctgtttaaagaagcagctgagcatgactgcacacttaccgcctcagctacttgggaggctgatctttttttattttagagacgggatctcgccctgttgcacgggctggagtgcagtacaatggtgtgatcagagctcactacagcctagaactcctgggctcaagggatcctccccactttgcttccggagtagctaggactacaggcgtgtaccgtcacactcggctaattgttttttgtagagacaaggtctcactttgttgtccaggcccaaaggggcctctttactcccttatcccccagttgcagagccttgacctcttaggctggagtgatcctcccacctcagccttccatagagccaggactccaggcacacaccaaagcgcctagctaatttttggggggtattttttgtggagatggggttttgccacgtttcc

SEQ ID NO: 84578 - DNA, 1003 bp, Homo sapiens
gtccggctaatttttgtatttttagtggagacagtgtttcaccatctcagccagtctggtcttgaactcctgacctcgtgaaccacctgcctcggtctcccaaagtgctgggattacaggcatgagccaccacgcctggcgtgtttaagttcttttaaagcaacttcatatattaaagggattcgtgatattttcccaaatttgtgttcataactattttttattccctcacattagcaatttaagtagcaaagatatttaacgtaagttaaaatagtttattattttgtaattaggaaatactggactaagtgatataggatatgctttatttcatatttataaatcttatggatataagtaggtttttcagatggtttttgttttgctttggttatttaggagtacactgttgtcctgtatgcctcccctgtggttgcaaaacttaattgttaaatcctttctctatttctcataggtggtactttctattttaacacctcaaggttgaagcagaagaataaggagaaggataagtcgaaggggaaggcgcctgaagaggacgaaggtatattcatctgatgttcttcagtcagtagctgcctctggatgtctttacatttctgttttccttttagcaaggtgaaaccagtctggaaaatggggagatgggccgggtgcagtggctcacacttgtaatcgaaacgctttgggaggcccaggtggaaggatcacttgaggcctataccacatagcgagaccctgtctcactgcaaattaaaaggctgggcgtggtggctcacacctgtaatcccagcactttgggaggctgaggcaggcggatcacctgcaccctggccaacatggtgaaaccccgtctttactaaaaatagaaaattagccgggcgtgatggcacacgcctgtaatcccagctactcgggaggctgaggcaggagaattgcttgaacctgggaggtggaggttgctgtgagtggagatcat

SEQ ID NO: 84579 - DNA, 1148 bp, Homo sapiens
ctgtgtctgcaggtgtagctgagtctgaggcacacatcagacgtggggctgtgagctaacttgcagacatccctccatttcttagttttcctatgagtggaaaatagaaagtctatctgttgaaattttatttctcaaattgtggttgaggaaacaaattttttagacttggaagtacagatgttccttgaattaggatattttcagcttcccaggggctcactgggaggtagccccatcgtaggtcaaggagcttagtgtgcatattgcttttacaccattgtaaaatggaaagaccgtaagtggaaccgtcgtacgttaggaatcacctctagtttctgaatggtgtcctcttcacaatgctgaggttgtcattaccatgagttccaggcgggctctctgttgactgtagggttgctcgtctgtccctgcgtttctcatggtcccctctcctttctgccccccagcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaagtatgttggatgtatttgttgatgcttgaactaaacctaacttggctttgtaatctgagaaacagattgcaatcaaaaatctcaaactgtctttgcctatagttaactagactttttagtgggagggttaaataaatatagaagtgaatgatacaatgccaggagatttggaaatatagttatccctgggtatccatgggggctggttctcggacttcccaaggataccagcacctgaggatgcctaagcccctggtgtaggatgctgaagtctaagcccctgatgtagatgccgaagtctcagcccccgacgtaagatgccgaagtctcagcccccgacgtaggatggcgaagtctcagcccccgacgtaggatgccgaagtctcagcccccgacgtaggatgccgaagtctcagcccccgacgtaggatgccgaagtctcagcccccgacgtaggatggcgaagtctcagcccccgacgtaggatggcgaagtctcagcccccgacgtaggatggcgaagtctcagcccctggtgtaaa

SEQ ID NO: 84580 - DNA, 1036 bp, Homo sapiens
tcagccttccaagtagctgtgactacaggtgcctgccaccacacccagctaatttttttgtatttttggtagagacaggtttcaccgtgttagccagggtggtctcgatctcttgacctcgtgatccgcccatctcggcctcccaaagtgctaggattacaggcgtgagccaccatgcctggctgagtaattttttttaaagcaaattgctagataagtttcttactaattaatgacgaaacatttcccttctgtgcttgaagactgactgtgagcctcgtcagcctgacatgagtgaagccttgggatcctaggatggagacgtggggttggggcggctcaggtgcgtgggctgagcgctggcatcgtgctgctgatttcctgacttcgcccagctccttgcactttgttctttctgcacagaatcagcttaaaatggctcgtttcaccattgtggatgggaagatggggaaaggagtcagcttcaaagacgtggcaggaatgcacgaagccaaactggaagtccgcgagtttgtggattatctgaaggtgaaagcagcgtgggccgggagggaggtgtgagcagaggccggccgtcctcctctcccagaagggctcctgcgggacctggaattccatcgatgacgtgtcgtgggttggcggtgacctctaccatgtcccatggggacaccaagcaggtgctggtgcctgttcaaccagcagcacaagcctcgtgcacatggttcagccaagcagaggctgccaagacccatgcctactgtgccgttagccgtcctgggcccttcatcccttgcaaagctctgtgctttttccagaaccacataaacaccttagccagttggtggcagtgcatgagctgcctatcacgtgcgtcacttacacgtttcctccgcgggcctggtacggtgggtcgcacctgtagtcctggcacctcgaggggctgacatgtgttccctctgcaggcctggtacagtgggtcacgcctgtagtcctggcacctcggggcgctgaggca

SEQ ID NO: 84581 - DNA, 1089 bp, Homo sapiens
cacaggcgcccaccaccatgcacggctaatttttgtatttttagtagagacggggtttttccatgttggccaggctggtctcaaactcctgatctcaagctacgcgcctgcctcagcctcccaaaatgttggaattccaggtgtgagccaccgcacctggcctgcaagaagtttttaaaagtagctgggcgtggtgccacatgcctgtatattcccagctactcgagaggctgaggtgagagggtggcttgaacccaggagtttgaggctgcagtgagctatcatggcacccactgcactccagcctgcgtgacccagagagaccttacctctaaaaaacaaaaaaacggaatccccaagtagttagtgttgcattgtctgctgccgtccagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggtaggtgctgtggttgggggctgtgggtgggcttggctgactacctggctcctttcacacatccttcctctggtgtctggactgaaagggacacgggtgggtgggggagtagagaaggaaagcgaggtctgggttggcggaggggttttgtctgcgaagcacatgatgtttgcttcaaagccaccgtcacttgtggcctggggggccagcacggtgcgtgtgaaccctgaggggtggccaggggcccccgcgagcagctgccgtgtgtctgtttgtagggaatggagctggtagctttagttgtccttggtgtagaactttgtctggcccgggtacaggaagaggctttgttttttattaactgcccatttcctgattctctctgtgtcccctcaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggagg

SEQ ID NO: 84582 - DNA, 1037 bp, Homo sapiens
ggacgcaacgacgtttgcggagaatgcttcacacctctcctgctgcttgtcccccgtgtctccagtcgtctctcaacacgcttattcaggaactaacgcgtgagcaaccgagacctgaatggctgccttctgcacacacagcaagtggtcatgggagtcgagttttcagagaacacaatgtcttcagagatgtggggtgagcagttcagattctgtgatgtctgaggtgtcactgaggagagacccgtcctcagaggtgggtccttggggttcagggaccccaccgcctctgctgggagagctgccctgtacctcaagcggagatcaccatgcgttttagaggcctctggagcctacaggctcgctgtactgcttctctgcagagcatctttatgtggcctctctggtgctgtgtggccttcagtgtggcctctctggtgctgtgtggccttcactgtggcctctctggtgctgtgtggccttcactgtggcctctctggtgctgtatggccttcagtgtggcctctctggtgctgtgtggccttcactgtggcctctctggtgctgtgtggccttcactgtggcctctctggtgctgtgtggccttcactgtggcctctctggtgctgtgtggccttcagtgtggccgctctggtgctgtgtggccttcagtgtggccgctctggtgctgtgtggccttcagtgtggcctctctggtgctgtgtggccttcagtgtggccgctctggtgctgtgtggccttcagtgtggcctctctggtgctgtgtggccttcagtgtggcctctctggtgctgtgtggccttcagtgtggcctctggtgctgtgtggccttcagtgtggcctctctggtgctgtgtggccttcagtgtggccgctctggtgctgtgtggccttcagtgtggctctgaccattgcttctggaggctgctcaaggatgggtgggtggtttgggttttgaggaaatctgcagagcaccttgggttctggccgcagagtctgaggactctcggtgaggc

SEQ ID NO: 84583 - DNA, 1041 bp, Homo sapiens
tccagcttcacggtgggtcctcgggaggaaggggatggaggtggtgctgcctcagtgctctgaccgggacacctggggcccagcactgctctgcgcctgcagtgctgaggatgcctctgtctcgaccccgccctccaggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgtgagtcggctctggccacaccgctgccctctgtgctccccggggagggagtccctgggtctaccacacaagggtcgcccacggccgccccagcggagctcagctgcaggccccacctgggtttcttccttctgggctctgctgtagttcccacctgtggagtattttcttctcaaatgaggacatagatgctcctaatgaaattatagatgtgaatctgggaagaatatcaaataaatacaccgagcaatagacccagggcccacatgtccttcagactgggccaggaagggccgatgtgtgcctgtgaggcagctgtgggtgggtgtgggtgggtgggctggcatgcggagccctgctttcctggcactggtcacaggggcaggagaccacctgtcggctgaggagtcctgttcctcctgggaggggaaaggccgtgttcccagtctgccatttcttttctgtgctttggtgctggagccaggcggccagccttgcccctgacacagttccctccactcacaggaagcaagactgctggtggccaaggcctacagacacaccgagaaggtgctgcaggacaacctggacaagttgcaggcggtgaggccctggccaggcgtgggggctacggcgtcacacagtgtccacacagcacccacggtccccacccctctcgtgaagtatttccaaggcacacagagtacagagaacactctgaccgatgtgaattcta

SEQ ID NO: 84584 - DNA, 3402 bp, Homo sapiens
gagcgagactccgtctccaaaaaaaaaaaacaaaaaaaaaaaccacaaatgttctaaatggatgggaggagaataaacgctggaacgacaaggacgaaggccttaggttgcgcaaactcggatgtcactgaagtttttctgcctttgcgctgcaaacgtgtctcacaaatgtgaacaaacagaattcctcgggcgtcgcccgttcgccgtcggcccagataccggactcgcgcgcgttagcccgcaagacaggactcggccgcggcccgcgcagcggctgaagcgccggggcagtaacggcggacgtcaagcaagtccggccgtcggttactcagggcccaggaatcacggccgccccgccgcattctcagcggcaacatgtctgcgacggcggccctagggctgccgggagagccgcggcgacgtcagttcctcctttcggggctctgattggtcagagcgcccggcgcttctggttggccggccctgctatcatcccagagtgcattgcggggccgcttcctttccgctcggctgttttcctgcgcaggaggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccaggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacag

SEQ ID NO: 84585 - DNA, 1046 bp, Homo sapiens
tgggggctggaggggagcactggaggctggaggggaagccctgggctgcagaggagcattgggggctggagggaagcagtgggggttggaggggagcactgagggttggaggggagcactgggggctggcaggaagcactgggggctggaggggagcactgggggctggaggggagcactgggggttggaggggagcattgggggctggaggggagcactgggggttggaggggagcactggaggggctggagggaagcactgggggctggaggggagcactggaggctggaggggaagccctgggggctggaggggagccctgggggctggagggaagcactgggggctggaggggagcactggaggggctggagggaagcactgggggctggagggggagccctgggggctggaggggagcactgggggtgggaggggaagccctgggggctggagggggtcactgggggctggaggggagcactgggggctggaggggagcactgggagttggaggggagcactgggagttggaggggagcactgggcgctggaggggagcactgggggttggaggggagcactgaggcctggagggggagcattgggggttggaggggagcactaggggctggagggggagcattgagagctggaggggagcactgagggctggaggcgaagcactggggactggaggggagcactgggggctggagggaagcactggggtttggaggggagcactgagggctggaggggagcactgggggctgcaggggagcagtgggggctggaggggagcactgggggctggaggggagcattgagggctggaggccagggctggaagggactgttctcctcatcccgtgggtgaaagccagggcctcaggttgggcacacagggccttcctcaggcagccacagctgaaaaagtttccatttcacagccataggtggaaccccacgtccccaccgggaccccccattctgtgcacatacaccctacatgatccccacacccagttaacgtccttcctg

SEQ ID NO: 84586 - DNA, 1504 bp, Homo sapiens
cccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaactttctcaagctttgctttggagccttgggtgagcccctggatgtggccatctcccccaagctgaggaggggttcctggagtgttcactgctaggggctgggcagatggctatgctcattctcgggccccatccaaaccgacaatctcccatgttcagttctctgcttactttgaaataatttaaaacttgcctaacagttgcacagtacatggtctctgtgcacctcggccaaaccaggatgcttgctgggcaccgtggtccccctgagcctctggtctgatgggcactgtggtgctcctgacggtctctggtctgacgtccctgctgcacgtccttgtgctgccgcctccaatctgggagggttccccggttttcttcatgacctgaatggtttgaaacctgctggctgctattttgcagaatgctcctcagcttgggggggtgcggttttcccacgatgcactggggtcttcatgactgctcggt

SEQ ID NO: 84587 - DNA, 1411 bp, Homo sapiens
ccaggctggagtgcagtggcgcaatctcggctcactgcaagctctgcctcccgggttcacgccattctcctgcctcagcctcctgagtagctgggactacaggcgcccgccaccacgcctggctaattttttgtattttttggtagagacgggcttttaccgtgttagccaggatggtctcgatctcctgacctcatgttccgccggcctcggcctcccaaagtgctgggattacaggcgtgagccaccgcacccggcaaaaaaatatatatttttctaatagagatgaggtctgactatattccctaggctggtctggaactcctgacctcaagtgatctgcccgcctcagcctcccagagtgctgtgattacaggcgtgagcgactgtaccgctggaaatcagctctttgatgtctaagagttaccaccttgctatttttatccatttacctttgaggagaaagagtctgtaaaaagtaaactgtcaagtactgaacttttaaattggcccaggctggcctcaaaccctggctttaagtgatccactggcctcggcacccccagagtgctgggattacaggtgaacttttaaattgggaaagaatcccaagggacatttgcaaagttgcattaattataaaccaccatcttttggattctaaccatggccaaaagatgctgcgtccatgacctcttctgtcctcacactaaccctttgagattggctggtaccaccctcatgttcccaacaaggaaacagggagggagggtctgcatttgctgggccctgtggctagcaaggagccagggctggcacacgaatctgtctcgtgcctcccctgttggggggggctccccgaaggccccaggcaggtgtggtctgtgtgtgtgttctagctcctggtgtctagaaggaacctagtgagtcctgcctgccagaagtgtaacgtcccattcccaatcctcaaaccattaattccctctttctttgcagataccctgttccagttgaaggtatgtaccgaatggccgttcaccccagccctgttctggtgaggacagatagtataagccacgctcactcagagccacagaaacagtcgggcagattatataacagttgagtgaccgccacacagggctcagactgctgaccaaggaggggattattgagccaccttggtgacatattagctcttttcttatctgaggctaagtggaggcagatccttagggtcatccatgaaagccatgaaagaaatagtgttatcttttttttttttttttttttttttgagacggcgtctcactccgtcgcccaggctggagtgcattggcgtgatctcggctcactgcaacctctgcctcccgggttcaagcgattctcctgccttagcctcctgagtagc

SEQ ID NO: 84588 - DNA, 1030 bp, Homo sapiens
tgccacccgggcagctctgcccgcctcgctagcggcactgcccggctgggtctggggagcctcgtgtcgcgctgccgcgccgaggcttccggcacgggcgggaacgacagtcccagagttccccgcggcgggggcggaagccggggcggggcgggctcaggacccccgacagccggtccctggagatctgaggggccggggcgggctcagggatgcctcgcgcccgcggagagacgggcccgggacttgggaagagcaagctccgggatccagctcgggcgctgctgggttcagcgcccgagctgggctttgcaggctgagccgcgagccacttgtttgtggggagaatttacacccgcgacgagttcgagcttgaaggctcccgctgggcttgggctgcatggagcggggtccagcgctgcctggcggcttcacgcgaaccctgggcgcgtcccttgcggaggtgccggtgcctccctctgcagagaccaggagagagcctctgggcgttgggcggtgttgcccaggtgcacggctggtgggggtggagagccctgaactttggccgctggtttgtgtttttaactgctggctggtgctctgagaggccaagccacgtgttcagtaagaatcattaacagatcgtggctggatgacaacaggagccacactttactcatccagacgtgcagcaggcgctcaccgcgttgagagccgtgtgctggactctggggtgaagtagtgagttggccttttcttttttgttgtttttttgagacagggtctagcgctctcgcccaggctggaatgcagtggcgtgatcacggctcagtgcatcgtcagcctcctgggctcaagtgatcttcctgcctcggcctcccaagtgctggaattacaggcgtgagccaccgcccccagcctggcctggcatttctttgagttcaggaagtgtgacaaggatttggacacccagaaataagcgtgtcgagaagagcacaagcagaggatgtgagaaggggaattaaggcgg

SEQ ID NO: 84589 - DNA, 1042 bp, Homo sapiens
ctgatatttctttcaaagcattggcccagtatcgtcaccaccttttctcatcagaaaagcccaagaggccgggtacggtggctcacgcttgtaatcccagcactttgggaggccaaggcgggcagatcacttgaggtcaggagctcaagaccagcctggccaacatggtgaaacccagtctctactaaaaatagaaaattaggcggttgtggtggcacctgcctgtaatcccagctactcaggaggctgaggccggagaatcacttgaacccaggaggcggaggttgcagtgaaccatgttcttgccactgcactccagcctgggcaacagagcgagactcagtctcaaaaaaagaaaaaaaaagcccaaacgtgtggttgcctttctgtttggtgagcaagacgtgagtgggctccctggtacaaattccatttgaaatttcctcagttgttccatcagctgccaaatttccacactggcaacacccttctgtttcagctgggacgatgccggagtgtgaaggagtttgagaagctgaaccgcattggagagggtacctacggcattgtgtgtgagtggccaaggctaggacatgtggccgcagctcgtggctgtgacagtgtgggacgagactgtcgaagcagcagccgcgttggggctggaagggactcagaccctgtgctctgaaacagggcagaaacctgttcaggaacttcaattcctgatgtagttatcacaaacattgtaccatttctgggtaaacgtaagcatccggttgctaatgcccataatccaaacgtgtcactgcagagtacacagaactgttagagaaataaaatacagaactttccagaagcagcaggagctggacatggtgctcatgtctatcacctcagcaactctggaggagtcacctgagcccaggtgttttttctttttgtttgtttttgagatgggtcttgctctattgcccagactggagtgcagtggcatgatcatagctcactgcggcctcgacctcctaggctcaagtgatcctcc

SEQ ID NO: 84590 - DNA, 1018 bp, Homo sapiens
tcttgggcggagaaaggccccgtggcttagagccacttgacccagcaggggaggagcctctgtggacgtccccggctctgttcctagcagacaggctgctctcgctgacccttctggccttcgaaggcctaaacacagctgcctccaaggaccgctgcctggcctgcattgaggaaccctttttctccccgctgtggcctctgctgctggccctgtacaggtatggacccagctgtacaaccacctgcgtggcctagtgtcttccagcccagtcccccaggaggcctgccctgctccctggcactgtctgctcccctccatccccaagactcgtgtttgctccccctagcctgtgctttaccctgaggccatcctcaggggcttccagtttgcaggtaggattattgccactctcccgtgcctggggtcttggcaacgctggggctttttgcttgagatacatagccagttttctccaggactgagctccagccacagccctgcttctgtccccagggcaaggtccctggggcagcttagcctggcctctctctgccccaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcataggtcagcaggttcgagagtcagggggagggacaggctcccatcccagtaggtgacctggagcctgtgtcttcaccactgagcttctcttgtcacgtgccggtggggaggttgggggaccagaacaaaagtggtgtctgagcaacatcgccagggtcaccgtggctcttcccagccgtgcacatcaggaggtgggtgggtgggcggggtataaggggtggctcaggctgctggacggggttaactgcccc

SEQ ID NO: 84591 - DNA, 1082 bp, Homo sapiens
ccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagag

SEQ ID NO: 84592 - DNA, 1035 bp, Homo sapiens
aagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaattacctgtgctgtcattctaaataaggctgacacattcctctttaattgaaattttttacatctaggccataaatcctttaagtggatcttagaaaactttccaatcacttctagagagacagcttaattgagaattaattactactggctgggtcatttcacacttgcctttaaacaaagctagaaacagtttgaaaaagtgacaagagccagaaagagaagactgctgcggtctccttggctgtgcgcagtcccaactcagcatcatctccctgcaaggcctcctgtcagaagtgtttgtaaaatccttgaagataagcccacaggctccagcctaaagtagggcctgactgggcagggtctctgtggacactcctcgctgcacactagggtcctaaggccctggagccactaaaatcccttctaacaaaactacacaagaaacctgaagacgtactcagaag

SEQ ID NO: 84593 - DNA, 1007 bp, Homo sapiens
gacctccgcctcccaggttcaagcgatcctcctgcctcagtctcctgagtagctgggattacaggcgtgagccaccatgcctggctaattttgtatttttagtagagacagggtttctccacgttggtcaggctggtctcgaactcccgacctcaggtgatctgcctgcctcagcctcccaaagtgctgggattacaggcgtgaaccaccacgccctgcctcgtttttgtttatttgagattgagtctcactgtgttgcccaggcagatctcaaactgctgggcttaagcgatcctcctgaagtgctatgattgcagatgtgaaccgtcatgcccagcttatttaaagtctcttaaaccacagcattgtttcattaatttcctaccaattttttaaccagccagaaaactcagacaccacactggggccagagccaggcagtcctttgttctctgttgtaggagggaatgcctgatccacagggccaggcatgggcaactgaggaaaatgaggcctcttcttccaaaatgtaggcagctggggcccaagagcacagggcaaggtagacaggaccaggccagctgcctgctcagtcagcagctctcagaacgccaggatgctgtgggggcagcaccagcacctgcccacactctcacgtggacctgggggatgcagacctagtttctgatggtcctgaaacccttctctgtcctctgatggaaaggcaggccccaaaggtgacaggtgggaataaggacttggtttctatggcgtggttgtatggttgtaaggccctgcaatgaccccgttctctctgtcccagtttcctctcccctgaggctgcctccccagcacccaacccggactggctctcagctgctgcactgcactttgcgattcaacaagtcagggaagaaaacatcaggaagcagctaaagaagctggactgcgagagagaggaggcaagataggaaattcttttactgatttattttctcgcaagcttg

SEQ ID NO: 84594 - DNA, 1072 bp, Homo sapiens
cccagctcagaggagtgtggtcccttcactgtttcgttcccagctcagggcagtgtggtcccttcactgtttcgttcccagctcagaggagtgtggtcccttcactgttttgttcccagctcagaggagtgtggtcccttcactgttttgttcccagctcagaggagtgtggtcccttcactgtttcattcccagctcaggggactgtggtcccttcactgtttcgttcccagctcaggggagtgtggtcccttcactgttgcgttaggccaggctcttccttctccaaattccacgtcttccatgagtgtgggtaataaatgcctcatggaactgctttgagccttaattgacgtaaaaaatactggctttggagttccagagcgcagggcgagtgtgggcctgtagtggcctgtaggagcactgggggcttgtcatggctggggcagcggaggtgtgtccatctcagccaccctcatctgtgtgctggtgctctctccataggtgtggtggccgagcctggagcctgtgctgctctgccggtggaggagacactgccagagcccgctgccccgggaactgcagaagctacaagaaggccggcagtttgccagcgagtacgtgtgggtggtgagatggggtgtgcccgcccagatgcacttcgggacctgctcaaggtcatctcctaaacaccctggcttgcttgagagaagcggtgtgggcagcctctcgtgtgagcagggagaaaagaaccgagttctcgtggtggtgggcgcctgtaatcccaactactggggaggccgaggcaggagaatcagttgaacccaggaggtggagtttccagtgagccgagatcactccaacggccaatagagcaagactctgtccagaaaaaaaacaaaaaaaaaaacagcctctgccagtgtctcgtctgagtgaggaacggcctctcccaggctcccgtctgagtgaggagctcgagtgattcctttgcacctgctccccttcctcttaaatctaatgtgggctcctagagtgcaccgcgtgctggtagggtcagtgtcatggggac

SEQ ID NO: 84595 - DNA, 1053 bp, Homo sapiens
gcagaggacgtgagactagcaaaagctttcagaaaatcactatggtctcctttgaattcttatgaatggctgtttttcagaaagctctcagttggcacgtgacagccgacagacaggaaaacaccatagacagcacttggttagtgaagggaccagaggatggttggcccttggtattagtgtcgtcctcaccacagttctacgctccgggtgcgtccccttccctgcggctgcttgtgcctccctggcttcttcctggagcctacaagactgtttgggccagagctggtgggctgcaggatctggccgcccagggaagccgttaagtttcaggacagcacagccagggcgccaggcccggtcagcccaggagcaccatccatggtggccacgccaagccttagcgagtgtttttctcaaaactgaatccacagcagccactctgcatgttggtctcgcctctcttcctgtgggcttttcttacctgccttgaactcttttgcagagaaacttctgctcccacggaggtgccctgacacaggacatcactgcccacttcttcagggtgagatgctccctcagcccctctcgtggccttctcagaacgccgtgggtggatcctcctgtcagcttcctgtgagttccttcactctactagttgtgggtcctcacaaaccgctgacctcctgctgcgttctctcctgcagggcctcctgaacgcctgtctgcggagcagagacccctccctgatggtcgacttcatactggccaagtgccagacgaaatgccccttaattttgacctctgctctggtgggtcagctgtcttgtttggtgttttgttttggggatgagtgggagactccacagctgcctctggcatctctgcagcacgtctccatcacgggtgttaccatctcagggaaaatgcatcaggagacatggaagccacagttaaagatgccagctcatagcagatgagggccgcacatcctgagttcccagaaccgtccctgcccccaccgccgtcaccatggcacccgcaggacttctc

SEQ ID NO: 84596 - DNA, 1050 bp, Homo sapiens
cactcttgtcttctggtcacacctcagtatatcccctcagctcctatctctgtatggcctggtttttcctaggctatgattattgagtgaggattatcataatattggaataaaaagtaattgctaccaactaatgattaatgatattcatatgtaatcatatctaagatctatatctggtataactattcttgttttatattttattatactggaacagctcgtgtcctctgtctcttgccttggtgcctgggtggcttgccacccacatccttgcattcttgggataagcctccttggtcatggtacataatttttgtatttcctaggttggggttggtagtattttgtggcagtttttgttgtttattgttgactaatgtgagggtcacactgtcagagaagcacagccatcactcagctccggaggcaggaggagaactgggaacttcagcactattaggcgatactgaggaggattttattgtattttcatttcagctcaaggagttatgaccactcagaaaattctgatttggtctttggtggccgcacaggaaatgaggatattatttccagattgcaggtgagtttgagggtgccacaactcagtgcattcacttcatttaagccgcgtgctattaagatatttattgccaggcgcggtggctcacgcctgtaatcccagaactttgggaggccgaggcaggcggatcacacagtcaggagatcgagaccatgctggctaacacgatgagaccccgtctctactaaaaatacaaaaatttagccgggcgtggtggcgggcacctgtagccccacctactcgggaggctgaggcaggagaatggcatgaacccaggaggcggagcttgcagtgagccgagattgtgccactgcactccagcctgggcgggcgacagagtgagactccgtctcaaaaaaaaaaaaaagatatttattgttggctcaggcttgtaatcccagtactttgggagtccgaggctggtggatcacctgaagtctatacaggtaggcagcatgtacctg

SEQ ID NO: 84597 - DNA, 1241 bp, Homo sapiens
gacggagtctcgctctgttgcccaagcaggagtgcagtggcatgatctcagctcactgcaagctccacctcccaggttcataccattctcctgcctcagcctcctgagtagctgggactacaggcgcccaccaccacgcccggctaattttttgtattttgagtagagacgaggtttcaccgtgttacccaggatggtctcgatctcctaacctcgtgatccgcccgcctgagcctcccaaagtgctgggattacaggcatgagccactgcacctgccccagcctacatttttgtgcttgcctattctgttcaccaagctcatgtgctgtgtggccagcagttaccccgtgggatgtcatcctgagtggcctttgatccgtggaaggtggggtcacaaaggtcactcctgagaccaggcctttcccacatccccaggcatcccaccctgcagacagtgaggtctcatccctactccaaggtcccgagccgccagtctcaacccagctctcactagtgctgtgtgtcccttactatgggcctattccctggttatggggaaccgctggccacgaagcatttctcagaattgatagcagtgtttgctgttctaggcaggacttccaccagtgggcgatccatgagcactttctccctgagtcctcggcttcagggggctgtgacggagacctgcaggctgcgtgtaccattcttgtcaacgcactgatggatttccaccaaaggttagcagcacacactgtattagggttctctggagggacaggactaataggatatatataaaggggagtttctggccatgctggtgcccatctaattagcttagggtgggtctgcctttcccagcctatacccaaatgtcagtctcctttggcaacaccctcacagacacactcaggatcaatgctttgcatccttcagtccagtcacgttgacactcagtattaaccatcacacaccgatgaggccttacttttaatcatggtagttctaagaatgcatttttctctcagtccaattttggtatgcaaagtacacttgagcctatcacatagcaaatctatgtcaatacaaaataaagccaagcttcctgcatcggttgtttctttatgtgtatagacttgtcagaagcgacaacttcgggctgggcgtggtggctcacacctgtaatcccagcacttcgggaggctgaggtgggtggattacctcaggtcaggagtta

SEQ ID NO: 84598 - DNA, 1086 bp, Homo sapiens
ttgttagtttcttttttcttttttttttttttcctttttatagatagttctcactctgttactcactgcagccttgacctcctgggctcaagagatcctcctgcctcagcctcccaagaggctgggaccacacacatgtgccaccacacctggctgatttttaaatcttttgtagagacggggtgtcaccatgttgcctaggctggtgtcaaactcctaggctcaagcaatctgctggcctcagcctcccaaagtgctgggattacaggcatgagccaccgtgcccaggtaatttttaaatgagatgaggtcttactatgttgcccagactaaaatagccgttttatacttagaaagaaggattacagtactaacatctttgtgctagggaaatcctgtaagaaatcattcttgataaaactaaggtttctttcctgtggaactctcagctgcaatttcattataacacagggacatggaggactgcgtatgagatgaaatgacaaactggtttataaacctgtcggtggattgtgtgttctgtcctcattgtattgaattgcttgctctctttctcagttaacttaccaagactggttacacctggagctggaaattcaacctgaagctgatgctctttcagatactgaacggtaagtgttgaaaagagctaccctggccaggcatgatggctcacacctataatcccagcactttgggaggctgaggcaggagatctcttgaatccaggagtttgaggtcagcctgggcaacatggggaaactccatttctacaaaaaatagaaaagaaattagccggacatgcggcacgttccagtcatcacagccacttgggaagctgagcaggagcattgcttgagcctgggaggtagaggctgcagcgagctgagatcacaccactgcactttagcctgtgcaacggagtgagaccctatctcaaaagaaaaaggagcttccctttaaaatgttacacggttttccacattgccttaaagcctatgtttcgtcattttatcctcaatttaatgtttggtttacctgttaatctttgagcacaatttcaat

SEQ ID NO: 84599 - DNA, 1055 bp, Homo sapiens
gagggagctggtccaaccaagggccagacaagggaccaagacaaaacaaagcagctctcaccaggacatcaaagaatgcttaacgatatagacagttactatctactattaatttcagcagtttagtataatatgatctcatttttatgaacaaagaaacaaacgcacgcatattataaacaaatgacagataaaattctggaaggatatataccaaaatgctaaaaagtggttatctttgggtggtatgtctgcatgtctgtctcttctaattttatcaaacgagcatgtgtcacttttcgagagagaggagagaagacgcgactgtggaagaagagctcacttcaggcagaagaacaaggaatccctcgtcctacaggtcaggaggctgtcaaagagcgcagggacaggaaggccagcaccaggtgcaggaggacccacatccacctctgggagcgcagacctggactcacccaggtgcacggccagggcagccaaccccagcacatgtggggcactcaggctcgggccctgcaacgagaatgagggtggcagagcagactgccctcttccaagctggaattttccagggcactgaagacgaattgagaagtagcagcctggccctcagagtgggcccccaagggtggcccccatgaaggagagcctcacctggtgacggagcagctggcagagccgggtgagcactgcagggagcacacgtccacacatggtcctcacgaagagggcagcccagggaccctgcctgcagagacagccgtgaaaccatcagtactagccattcagtcctgcacatccctccaacagctaatccaaccaccagcggccgaagaaagagccaagctgttccccaaaacagtggtctttctggaagacaacccatcttctgcagtgcttcccaacttctgctgcgtcctatttgatgaaactcagcatcgccgcatgctcctgcggagacgagctcatgagtccctggtctgcagacttggcccagcaagaggtggcacccagaggagccccaccactcagggagc

SEQ ID NO: 84600 - DNA, 1061 bp, Homo sapiens
ttgactgagtcttctctgttgcccaggctggagtggacgatcttggctcactgcagcctccacctcctgggttcaagcagttctcttgcctcagcttcctgggtagctgggattacaggtgcacaccactacgcccagctaatttttgtatttttagtaaagacagggtttcatcatgttgaccaggttgggctcgactgcctctttagaatatgcgacagaggctgtttctggccccaaaacctaaaatatttttctggccccttacacacaaggtttgccagtcccgcctgctgctgtagaattttgtgattggcgattacttgagggctgctattcccaagattggggaatgggggccctgggcaccagtttgcattgtaacatgccctccaaacaagcctgttttggaggtctttttgcaaagcagaattgcgatgtctgtggcgggagcgctggccggcttccttcctgctgctcccgtccccaggacaccacgctcatgagaactgtgtctctgcaggctgtggacctcctgctgacgtctttctgtcagaacctgatggctgcctccagtgtcgctcccccggagaggtgaaggcgcgggcagctccctgagtggtggggctcctctgggtgccacctcttgctgggccaagtctgcagaccagggactcatgagctcgtctccgcaggagcatgcggcgatgctgagtttcatcaaataggacgcagcagaagttgggaagcactgcagaagatgggttgtcttccagaaagaccactgttttggggaacagcttggctctttcttcggccgctggtggttggattagctgttggagggatgtgcaggactgaatggctagtactgatggtttcacggctgtctctgcaggcagggtccctgggctgccctcttcgtgaggaccatgtgtggacgtgtgctccctgcagtgctcacccggctctgccagctgctccgtcaccaggtgaggctctccttcatgggggccacccttgggggcccactctgagggccaggctgctacttctcaatt

SEQ ID NO: 84601 - DNA, 1047 bp, Homo sapiens
atttttttgtatttttagtagagacagggtttcaccatgttagccaggatggtctccatctcctgacctcgtgatctgcccgcctcagcctcccaaagtgctgggattacaggtgtaagccgctgcgcccggcttgtgttttaattttactaatggtttgctttgcatactcataagtctgactgtaaagggctgtgtttctctactcagcactgtggatgttggaagtgaattgtggcctccctggagtcccaggcagttcccagactaacggtgctgcgctctgctatctatcctcaggtgcacattctccacccacccctggttcccggcaagtaccgctccctcctcacagactacatctcattggccaagacacggctggccgacctcaaggcaagctgtccctccatgcccactcctcacacctgtcccagcagaaactgctttgttttcttgttctcattctgtgtcttccctgaaggtttctatagaaaacatgggactctacgaggatttgtcatcagctggggacattactgaggtaatgttgcttgagccctgcagggtctcagccagtcacgcccaccatgcaaaggtccagtttcttttgactcttgagttgagtttttcagccttcccagtctcatgtctggtcttgcctcgggcgcagctgggggcgaggctctgcgggcctctgtgttgctgtgtcccaccttgtgtgtccccagcattggcagggaaagggttactgtgtggcagagtgaagtgcctcaggctgcaggacatttgtccttttgggagatcttggttcctgtggggttgaatggagaggtggttcgtcatgtttttctctgaatcacagaaaagtgttaactttttttttttttttggagatgcagtcttggtctgtcaccaggcttgagtgcagtggcgcaatctcggctcactgcaacctctgcctcctgggttcacgccattctcctgcctcagcctccagagtagctgggactacaggagccgccaccacgcctggctaattttttt

SEQ ID NO: 84602 - DNA, 1007 bp, Homo sapiens
gagctgtgaagggatacctcatgaatctgtgggtcacagggaagcattttcttgtctgtgtgttttgattaaggcctacagattgtagaagtcttgatggatgtgggccctctggggggttgaagtggatctgttgtctgaaagcgcctggggattgtttctggtgggctgccgccgtgtgctgacatctgttttctgttcctggctctgtcttcagttgcacttgacgctttggctgctggagtacaggaggagtcctccactcacaagatcgtgaggtgctggtatgttcctgagggtggcctgcctgagtgtgcagcagggaggtgtctgccaaattaaagagccaagatattttaaacacttccagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctca

SEQ ID NO: 84603 - DNA, 1002 bp, Homo sapiens
tccataagacctcccttggaaaccacttttatttaagagaaaaaaattgggctgggtggggtgactcatgccagtaatcccagcactttgggaggccaaggcaggtggatcatgaggtcaggagttcaagaccaacctggccaagatggtgaaaccccatctctactaaaaatacaaaaattagctgggtgtggtggcggcgcctatattcccagctactggtgaggctgaggcagagaattgcttgaacctgggaggcggaggttgcagtgagcgagatcataccattgcactcaagcccaggcgacagagcaagcctccgtctcacaaaaaaaaaaaaaaagaaaaaaatctgactataaacttgttccctttcaaatagaagtgcaagaggaaaaaatctggttcatctaagggtcctgattgggtttggtgaacgctagtgtagctgtggtcaggtgagcagtaacttctgcagcgttcctcaggttaggagcagctcacaggggtcctggtgggcccaagccatatgctcacccgcccctctgaagtggatggtctgtgccattcacagttgcttggagaccatgatgtccataaataactttggttttatggtttttcagattttgttcaaatgtttgttttgaggggatttcagaaaaactcagatctgagaagaactgtggagcctgaaaaaatgccgcaggtaggaggaaaagtcaagtgaagagtttagcggaaggagccgtccttattccaagtgttgaaatgtatttacgtgtctctctattgaaacgtgctgtttgtacctatttacggggtacatgtgatacttgttttgtgcatagagtgtaatgatcaagtcagggtgtttagagtctccgtcacctccagtatgtatcatttctgtgtgttggcaacatttcacatgttgcagttactttgaaatatacaatctgttgttaactatagccgcctcactctgctgtggaacattag

SEQ ID NO: 84604 - DNA, 1004 bp, Homo sapiens
acagtgttcacagtgagtggctaaagcagatcctgttttatcaaatgggagagggttgagtgagaaagacaagggacatgcacagggcacactgaagcctgacctttgtcctggcagcttcgaggagccagtgaaggcttctgaaggagagactgtcatgtcagtgtgtgtaatactgtgttggctgtagtgtggagaaagggttagaagtaggctacagtgcgtaggaagagagaaggaagagaagcaagtgttgggcaacggtgtgtgggtgcccaaaggccagggagtttgaaaaccagtacagctttgtaaaaaaagatgtgtttcaggctctaagtttttgcttgaggttaattttcaatacggcatggttaagaacctaagttgaacattttgtaggaaaatgcattcataaaggactcagaatgctgggggtttttttgtttttgtttttgtttgttttgttttgtttttcagagttctttgttgcttgaagcggtgtggcatcttcacgtacaaggcattgtgagcctgcaagagctgctggaaaggtagcgtgctaatgatgattcagtgttactgtttttgcagtctagtctagtataaattatatttcaaagcccagaatcagacgggtttgatttctggctttgacatataatttgtactagactagattgcattgcatatttatactagactagacctggaggaactattgctttattatttcaagagaacgtttatggtgttttggttttgtttgctttttgtctgttttttttttgagacggagtctcgctctgtggcccaggtgggagtgcagtggcacgatttcagctcactacaacctccacctccagggttcaagcaattctcctgcctcagcctcccaagtcgctgggattacaggcgcccgccaccacacgcagctaatttttgttatgtatttattttttttagggacagagtctcgttctgtcacccaggctggagtgcag

SEQ ID NO: 84605 - DNA, 1160 bp, Homo sapiens
gagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctggtgaggagcgcggcggcccgggtgggggtggggtggcccttgacgttgtggggcggggcgagcgtccagccgggtcggggagcggggttgtgatgccaggggtgggaagggtgacgtgggtcccagccgcagtggggagggcggggccgtgcgtcggggccagggcgacgcgggtgggcggtggcgtggggtgaagacggcgggccgcggagttagactgggttctaaccccggtgaggtgggcggggctaagggatggggcggggccgtgctgtcggggcggggcgaccgaatgggcggggttaagcggggtccgggttgtggagggtgcggggccttgatgccaagggcgtggccaacgtccgcggggccgggccacgacgtgggcgggattaaatgggcctgcggccacgtggctgtcgtggggccgtgacgctaaagggcgtggctaaagacgggggggtggcgaggcgatggcgtgggcggggttaaatgaggcctggggccaccgtgggggtggggccacggcgtaggggcaggagtcgggtggggcttccctttctcgagtctagaggggccttctctcggttccagggttgaggacttgccaggcctctgcgagcattctgctttaatcctcacaacaactctgcctaacccagggccttgctcttcgcgcatccccatcagcctaacccagcggattagtcttactctttgctgcatctccggcagctcgtttctggcacagggaagtaacagtttgactgtatggtttgctcatgcggtcctgtgacgttttctcctaagccctggcctccgtctgtaactctgcctctgcgggctctgcgatcctcccacctcagcctcctgagtatctaggactacaggtggatgtcaccacgcccggctaa

SEQ ID NO: 84606 - DNA, 1010 bp, Homo sapiens
aagcagacgggatgccgtctcctggtgtagaccagacggcgggtgttttgggaaggtgtccggagctggtgacacccatgagtacacactcaggtcaagtttgtcgatatcgcagaggcctcatccagaacaccacgaaggtgagggctgtgctcggagctgcccacgtccctgctcccggcacaccctccctgagcactctcccctcccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggtgcgtggtccctgcagcccctgacaggagcaggggccatgtagccaccactgccctgggccgcctgcttccctggtggctgggggaggcatgctgcctcctgcccttcccaacaggaagggtgccagtctctgcagggcggtctggccctgtgaccagaaggagatgtgttcggaggctctaggccaagcgagctccatccatactcagaggagaggctggagcgctgctctctcagccgttcctggggaccgtcgcagtagtgccgtgtgatgcaggcccaggactctggggcttctcactgctgcccttgcctcctgcggctcagtgcaggcgagcagctcagattcccggcccccgtgcagcccccggacggcccccacacggccccggacggcccccgcgcagccccagacagccccggacctggacagtccccgtacagccccggtgcaaccctggacagccctcatgcagcccctggacagctccccttgcagccccggacggcccccgcgcagccccagacagcccccgggcggccctcacgcagccgccggacagctccccttgcaaccccggacagcctccgcagagctccccgtcatctccctgtgggaaaagcaggctgctgctttccattcctctttcttggggcttagtgggg

SEQ ID NO: 84607 - DNA, 1012 bp, Homo sapiens
accacgttgactcactcctgcagctcagcgatgcctgccgctttcaagaggatcaggagatggctcgagacctcgtaggtaaggcagagcccccaccccattcccctcagctgtgggagcacctcaagctatcaagacagatgcgatggtgtaagatgacaggggttgccaggatatccatgacagctttattgagatacaacctacgtagcacaaaacttacccatttaaagtttttgtttgttggtgtttaatatatgccacagcctcccgagtagctgggactacaggcgcccgccaccagacctggctaattttttgtatttttagtagagatggggtttcaccgtgttggccaggatggtctcgatctcctgaccttgtgatccacccacctcagcctcccaaagtgctgggattacaggcatgagccaccacgccccgccctctggcttttatttacaatgaagttttcaaggttcatcctcactgtagcgtcgatcagaacgtcgttcgtttttatggcttagtaatactccactgtgtggacggaccacatgttgtgtatccatcattagttgacggccgtgtgggctgttgtaaataatagtgcttacgtcagcatgcacacgcagtcttaggtggacacatctgtgctgcacacatggacgcctggttctgtcaggacgtggcagcagttgtgcctcatggtgttgaaagtgttaccatgtcaagctcacaagttctgtggttgaaataaatgcagcgtggcatccagggtgcccaggggcatgtctgccctctcagtgtccaggactctagtttcgtgaccttccgtccagacctttccttgttgtccattatcagaggaggggccgtggttgctgtgtgtggccatgacaccctcccctggcgtccctgtgcccacagagagagcgctgtacagcatggaatgtgcgttccaccccctgttcagtctcaccagtggggcctgccggctggattaccgcag

SEQ ID NO: 84608 - DNA, 1042 bp, Homo sapiens
ctgctgtccccactggactggacattctcatggacaggagcattttgttccctgtactgctctccaagagcgatttccagcagggaccagtgcctgtgcctgtagccgtagcagtgacgatggtgacacacccaggtgtcccttcatggagatgaactcagtgacttcccacaagaagccactggctacggctctcatcgttcttgttctttggatgaagaggctgagtcactggccatgtggctgggattggtccccagaggctccccagccgcaggccagggaccagccatggtgcctctgctcgagagtaaagtgtacagtttttgcagccaccagagatgcagcgagatgcctcgtgctgggtgggggtgggggccgaggctccatggcggttaccatttcatttgctgtgctttatctgctgtgccttgtttctccccggccctaggcggaaggtgctctaccagcgtgcacccaggaatatccaccgccatgtgatcctctctgagatcaaggaagccgtcgctgccctgcccccggtaagggagaaaggctgaaatgggagctctgtgtaagccggtcacatgcacgtcccttctgctccgggcggtccacatgcaggcgtgcgtggtgcgggctccctcagcagcccagccccgccacggcaggggcagggtctagtgcagagggctcctcctttcctggcagcccgggttcggatgcttgttgttttgagagagaaatcctttggggctcagagcacaagctgagtcgtcaccgtggtgagctgctccatccgtggtcttgtgagcgcgtggtgcggctgctgggggattctctgtagtcgtggggtgtagtcctgctctgacgcctcctgtgctggaggtgccgtttctgtctcaaaacctaaggagtttgtactgttgttaagggataagatagaacgagtgagaaaaccagcaagtcagagggtcgcaggaccgtggaccgtccactggggacagcttagtgcctcctggtttaacttcagctgctctgc

SEQ ID NO: 84609 - DNA, 1050 bp, Homo sapiens
agtcttgttcctccaagcaagtggggtggagatgttggggtcctttggctggatgccactatctgttgaatctgacaaaataattttcttttttttttttgagacaagagtctcactgtgtcgcgcaggctggagtgcagtggcgcagtctcggctcactgcaagctccgcctcccgggttcacgccattctcctgcctcagcctcccgagtagctggggctacaggcacccgccaccacgcctggctaatgtttgtatttttagtagagacggggttccaccatgttggccaggatgctctcaatctcttgacctcatgatccgcccgccttggccccccacagtgctggggttacagctgtgagccaccgcgcctggctctgccaaaataattttattagagaacttgagggcagtgcccagaattgaaggcgaagccccagaagcatgttttgcagagaagtgcccagggaagctctgagggcccatgtagcaaagatcaggggatagtcggtctgagggtgaatgggccactcggaccaagaccccagtcttgggggagggcttagctggagcaggtcctggcacagttgactgatggtgcacagaacccgtgcatcccacggccccacggtgctgcagctgcaggaggggcggaggctgcagccagacagcatcagaagccagcgtggttctggaaggatcgagaacaccaaggtgttagggctgcagcaggggtcctgtcccctggcacccctcaccgccctaatcttttacccttaggaggcagcagacacgaggggctgcccgaggctctagggcggccagtgaggcaggaaacatgttccagccccagctaggtactggtccgtggacccacctcccagaaagcccatcactgtgtaatcgtctaacctggggctcgccgaggcctgtgagttcatccttttggcagttcctggtgtctccttactctgctcagcatttcctgggcgggagcttagggtgcaggaccctccccaggacgacgagggcccagtgtccatgac

SEQ ID NO: 84610 - DNA, 1082 bp, Homo sapiens
gacggcctggagtcgacactggggttcgtggattttgctgtgtagccatgcagtggtttttctctcgcccccgtggtcacgcatgaggtgtccaccttagaaatgggatgtctctataatgctgtcttgaggacttttggcaccgagtgtcattccacctcctcattttgagtggctctttcctgtctacacaaggctgtgggctcctctgtgaatgcagactggacggtgtgcagatctgagtggtgcccagctctcacggtgcctcctttctgtgcggcttcctgaatccctttcccactcctggctatctcagctcctccctaggggatgggaggcaggaggtagcagctgacgctccacacctgtccccgtcttcctccagaggccctgcctgagctgccccctggggagccggaattccgctgccctgaacgcgtgatggatctcggcctgtctgaggaccacttctcccgccctgtggtaaggttttagatctcggaggggagagggactgagggaacccccaaggcaggaagggccagggtttccttgtcactccctcccaggtggcagggcagtgtcctgtgagctggggtacagtctcactccattgtcaggctcagcagcccccacctcagccagggctcctggcttcgaatctgaggcctgcatgacaccacagacccccaccctcagagcctgagtgaaggcaggtggagagagcctgggattggggttcatgaacctggggctgcttctgtcccctgagctccatgtcttcatgaagcaaatgtgcagagaatagattccctctggggtccttgaggtcctgtacacttgccgagagtcagggtgtgggaggcaaggggaagccccttgtctgcctcgtactgaccagtcggtattacagggccactcttgtttgttccgtgttttgttccatggaagccttgtgttgaagaagaaaagggggaggatataatgatttttttaaaaaagtttgaggccgggcgcggtggctcacgcctgtaatcccagcactttgggaggctgaggcgggcggatcacgaggtcaggag

SEQ ID NO: 84611 - DNA, 1057 bp, Homo sapiens
aaagaaaaatgtatttgcttggtgactggaagatcctccagtgtcaggaatcttgctctcttccaactcgacttcctgtgtctgatccagcctcaggcaggccttccctgtgcggtggcagagacggtcccggcaaccacatcttgctttccaggagctgagcctccctgtgcagatgacagctgccttttcacagtggttatagcaggaacctcaggcctgactttcattggccagtcctgaccggatgacagtggctgactggccagttctgggtcatgtgcccacccctgacccaatgacagtggccgattggctagttctgggctgtgtgcccgcccactgacccaatgacggtggccgattggctagttctgggctgtgtgcccacccactgaagcaagcgggtgggctaagtaagttcctccctgagtgagccacatggacaaggacgggtggtgtcttgaaggtgacaacaaaagaaggtggtgggtcccaggccacagatgttcctgatgcagtccttgggtctgtgtgtgctttggcctggctgccctgtgtcccctgtgctgattcaggtatccctgggaatgtagaaagtagaatattcatgaggaaacaggtaaattggtggtaagaaaaaaaaaccccaaaacatagtggcttagagaagatgtgttcgtttcctcacgtaaaaatcccataggtggtctggggcctctatgacagctaatggtgttggggagggcctccttttccattgccctgcacctaaccggcaaaaagcaggaggggcagagaggccgggtcgctcccgctcacatgcccatggcccggtgcaatcccacacagcccctcgctgcaagggatgctgggaaaggtcgcaagggatgctgggaaaggtagcatgtgaccttggcggtccttgtccagctgatcattgtttactgtgaaagggagaaaagggacatggcattgtgctgaaactcacaatctctgccctaaatggtgcctggaagaaataagttgaggggcttgtgcgaagggaaaggaactt

SEQ ID NO: 84612 - DNA, 2375 bp, Homo sapiens
cagctctacagagcgatggtgtcacacagatgggactgtggcagaaactaaggttgagactgaactcgctcgagctagtcgtttgctcagtgtctgacaggtgttaattactgctacgttctgtttaaaagtttgaactaggctgcggtgccccagggtgccgtgatgtacagtttgggagccaggggagggataggaacaggtgggaatcgtgaggaagggctctgagtcgagtctggcgtggccacctggctcagcccctcagctgtgtgaactgggacctgtgtggttgggggatagcaggtagcgtgaggacccctggaggtccacatctgcacgcccgtaagcgctctgcacacggccatacagtcacttgcatctggctgcagactccgactctgccctttggtaacggctgtagaggggatgataggagctgacctaggacgcttggggggattcagtgctggagtttcctgtgcagagagccccgacctctttctgcccccagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccga

SEQ ID NO: 84613 - DNA, 1073 bp, Homo sapiens
gcgtgttggggccgtgcggccgcaggcacatacaagcggcctgggtcctggggctccagagaacaaccgaccaagcagacaaacggaactccgtgagggggacactgcggcagaaacgtccaggggcggttttccagtgcagcggagggcggaccgggcgggtgttgtttcgggagctgctttccatggaggaccccagaaataagtgttgatgccgatgcccgatttaagataagtctaaaggcgctggctatccccttagggcccagctgtctgggcagggcgaggctgcgctggcgatcaaaccctcgaacggtcaggcgacggcgtggacacccaagacggggccccagccggcgccgcgcccctgccgcgcctgcgcgagtcctccctgcgctcgcggggccctaggaccgctctcccattgcgcatgcgcgcgcccgggcggcgcgggatctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacaggtgagcggggaggcgctctccgccggtgccgggcggctggtctgctctggacgccgcgtgacgccattcgcctgcgccggccgcgggggagcgcgggagggcggcggccctgacctggtccgcgcagtgaggccgacagcacctggccagagcttcccgcccccccgcctcctccgtctccaaactcctgctcttctcctcgctacctcttccacccacttcttgcggaattcccgctgtttactggatgcccggtcccctcggacatcggaaccgggacctccagcctccttgctcggctttgtaaagcgccgggcgttgagcgatttgcgcttgagtcccacctcctcgcgaaccagctttgtggccccgcgtgccagcccgtgtcctcctgggctcggcggcgttcggctttatccacctcgcagttactcagtgaaccagacacgataagaggcgtgaaagggttt

SEQ ID NO: 84614 - DNA, 1113 bp, Homo sapiens
ggcaagaccgacgttattttcctggtggctgtgttcaaaaccacccaaaggtacctgtctttcatccaccatcattaacagcatgaggtttacaggaactgagtggcttcctcagagtgtgacttctacagtgagtgaccagggggcgagggtccagacaactcagggcacaccccactccaccccgccccatcctaccccttcctggcttccatatcgagccacacaacatccagcaccttctccatgtctttatggtgttgatatctcactaaagctggtgagagaaaagctctttccaaaggaaggtgctagatgaatcttttggaaggtatgggaacaaaccttggtttctgcgtatctgactctgaggaccagctaagcctcatgtttggaaagcagaacagaaacaatgtgcagactggcattacctcagagcacacttgcccacttggagtccttctgtaggccatggacctgtgctttgtgctttgtgtccagggacagtgttcactgaagcccctggagaccctgtgtctccacagagtagaaggtgctccctgcacttccctcagtgttaggacctgagggctcatgccgattgtatgaagcaagaagagaggcaggaggagggaaaactggcgtctctctcactttctctatatcgtcttgacagtacggttgcttttcttggtgtgattctgtcttctaaaatattagaaccaggctgggcgccaccgtctgtaatcccagcactttgggaggccgaggcgggcagatcacctgaggtcaagagttcgagaccagctgggcaacacggtgaaaccccgtctctaccaaaaatacaaaatttagctgggtgtagtggcgggtgcctgtaatcctagctactcaggaggctgaggcaggagagtcacttgaacccggaaggcggaggttgcagtgagccgagatcgtgccactgcactccagcctgggtgacaaagtgagactctgtctcaaaaaaaaagaaaaaaaaaaaaaagaaatactagaacctcatcattttgtccctcagggtttgagaaatactttaagaggagtggaaggaacacaaactgagaaacatcaaca

SEQ ID NO: 84615 - DNA, 1028 bp, Homo sapiens
ttcatggtgttattttgcagctgttggagtagcactgtatttgtgaagtggacagtgtcatggcttacttgttctggaacttgtcctggaacattacaggaagaggctggtaggtccgtgggacacaaatatacgtaggaggccagattttttggaggagaggcagactctgcttagaacaggtggtttgtgttccctggttctcttgagaagggggaccacccataccagtctgtcttaacattttcttcctttctttctttcccctaataacagccagttttgggactgttaccccaaaaaagtttactattaaagctcaatatgaagccagcgaggtgaaattttagggattttagatgtatctgaagctacttctcagcaatatctccccagcctcatccttttcctgttgtctctttatttccagaaggcactggtgttattaaaattgtgtgttggaaggtgtttttctgttttctgaatcttctttctctggaaaatcatatgtaattgctttgtgaagtcttactttgttttctctcagagactggtgaactagagaatgctgagtctggaggagacggaggcaggagaggagggaagcaggataacgttgcctggtggaggcggatgcagaaggtttgtgtgcatcttagtctgcgcctgctgctgtaacaatacatcagactgggtaatttataaacagggtacatttactgctcacagttgtggaggctggaggtacaagatcatagcctggacaacatgaacgctgtctccacaaaaaatacaaaaataagccaggcgtggtggtgcgtgcctgtagtcccagttactcaggaggctcaggcgggaggattgcatgaagctgggagtcgaggctgcggtgagccgtgatcacaccactgcactccaacctgggcaacagattgtgagggcaccaatcccattcgggaaggcagagcccttgggacctaatcccctcccaggggccccatctcttaataccttcaccttagggattg

SEQ ID NO: 84616 - DNA, 1082 bp, Homo sapiens
actagcctggccaacatggtgaaaccccatctctactaaaaatacaataattagccggacatggtggcctgtgcctgtaatcgcagctactcaggaggttgaggcatgagaattgcttgaacccgggaggtggaggttacagtgagccaagatcatcccactgcacttcagcccgggtgacagagggagactgtctcaaaaaaaaaaaaaaagaaaagaaaaagagacaaaggcacaccccagcagttgttggacattttacacttccatctagaacttaaagactaatttcgtggggccaaaaccagagtcttctgctgttagttagtttcccttggagctagcctctgcacaggcctcacccatgtggagattaaggctaggagaagaggcagtgggagatgcgtgtgtgagggtggggctcagtgtgggacacggcgatgcaccctaagcttgctcttgctctctgcagaagttcttgtggtttaacattggcagcgttgataccttcgagcggaacctggagtctgctcaaggggagctggggatcgagccccacaaccaggcagtggtagtctacaccagcgagagtgatgggtgaggaggatggcgaagggcctctgtgtgaacacaaaacagaaatgcaacatttaagctgtgttggaatttgtttttcaagcttattagaggcatctgtaataagcaatgtctgtagtaaaaaatatatatatacttttatatatatatatatacttttatatatacatacttttacatatatatacttttatatatgtatacttttatatatatacttttatatatgtatacttttatatatatacttttatatatgtatacttttatatatataatatacttttatatatacacttttatatatatacttttttacatatatatatatatatatatatatatatatatacacacacacacacacccccacacacatatatgtatatatttgttttttactgttttttcatgagaattgaagcagggaaatatttggctaggcaatgttacaaaagaaaaccagtcgttgggttattgttgga

SEQ ID NO: 84617 - DNA, 1078 bp, Homo sapiens
cgaggcaagcgcccagctccttgatgacgaggtccggcacctcgtcagtgccacctacaggtgcaccctggacctgctgacacggtgccgggagcatgtggagaaggtgagtgtggcctctgcccagacaggtcgtgggtcccatgttgagtcacggtcatgccacacccgaaggccacacccgtccttcagcttgcttaggtttgggctgtgatcatgtcctcagagccgtctgacaggtgggccgttgtttccaggtgggccagcggctcctggagaaggaagtactggagaaggcagacatggtggagctgctgggcccccggcccttctcggagaagtctacctatgaggagtttgtagagggcgtgggcagcctggaggaggacacatcccttcccgaggggctgaagggttggaaccgcggacaggaggaggaagatgtggagagcagcctgtgcagggggctctgtgtagcctgtggcggtcgcctgcacctgctgctgggtggagttggggtgactgccacttacctggggccttggcaaagcagctgcggaatctcacccaaaacaaattaaaacgtgacaactgtgaatgggtgttttagatgagggtgctctgagcccacatgcagggagtaggagtgggagtgggcagagggggtaccctgagtccctgggccctcccgctggaggacagtcgggtccaggcttagacgggagaggccccagggctctggcccctgtggtgctgaggaaggcacgactgtagcttcgagaggggcttgcgtgggacaccttggagacaccaggccttcctggggcctccgtggaggagcgttgatatggtcataaagacactcggaggagcctgggtccagcacagaaaccctcaccgtttggtagaattcagaagaggagaacgtcagccaggcatcaaggggaagtcagggttctaaagcagctgtttggatcggtagaagccgatctgctgttctgtccttagaaaggaaaaagcccacaccacccacaggtgcatggctgagggaggaggtggagctgtggggcctcacacc

SEQ ID NO: 84618 - DNA, 1011 bp, Homo sapiens
gattgtggctgggtggccacacaggcctcggttactgctcactggggtcagctgacattcagctgttggcacccccagtgcagggagcgattagcaatgcctgtcactggcaaaggcaggccgacagtggtgtgtgtgctgagtgtgagcatcagcagaaaaactcagtctaaacccctttgttcttctcttgcagagcttttgcctgcaaggctgttctgaccacagtgggcgttttgggcccgtttacaggctccatgttctgtagccgtaggggcaccacgtcttcctctgctaagctgctgtttgctgctgcctttcagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggtgctgtgcgtgggctgggctggggaggcacactctgcctgtcctagaatgtgggctgcagagtcctggggatccagaccccagctctccaccccaacacacccagtactttttataagattgtttgacaatgcccctctcatatccttaactgaaattcctaaataacgtaacctatctctacctattgttaaaagcagtcaggatattgccctcaccgtagtgcagagggggaagtaatgaagtgtgttctggtttgtaaaagctcagatggaaccgcagtgagggccgtgatgtggctggagtggataggtgtcatagtcactgcctgcgacaggtggataggtgtcatcgtcactgcatgctggcagtgacaggattttctacagtagacaacggcccttggtggaatcttgaacaaagtatagtccttcagtctgcatggaagctgcattcccagaaaactcagaataagttgaagc

SEQ ID NO: 84619 - DNA, 1027 bp, Homo sapiens
acccgaaagcacgtcctgcaccccagtgaagtcgtgggcagggggcataggcttgccgtgtttcattctttcataaaccaaaagccatcatctgtccctgacagtgcagaccacacccaacccagaccaggccatgtcccctgtatgcctgagcctggggcctttctcctgagccagcaggatggtcctggccccagaggagtccactgcctggcctttgcttttcctgttctctgtccaggatgcctggcacaccccagcctcagcttttgtgtctaaattatgcccatccttaaattccagctcgtccaggaagcccttactgagtgcccctctctccctgaatggtcccccgcacttcgcgttctctctggagggagccgatctcttcttccgtccatccacctttcattctatctggagctcctcaagcgagtgcagggactgtgagatttcgatgctggtgaccacatctctatcgatttgaggatttgtcttcgttatctggtgcctcctgtctgtctctgggcctgaaggagggagtaaatgaaaatcgatggtaaatgaataagcaagtgcaggacgccctcctccactccccagacctggattcccagccctgtctgtgcccatcagctcccgtgcctggggctgtcctcgggggcctttccatggcagcctggaagggggaccaaggaagcagcgctccccaggtaccatgtcctctccagccctctgaggtagtcctgtggctgtcaggggtggtcaggtggtagccagcaaagggccagaagcacaccccatatctcctggctccagggtccctgagggagggagggaggggcaggctctgagctgcttctggctgccagtggacccctccctaagcggacaggccctctgggcctcagagccccctttctccctttccagacccacaacctgcagggagtttccaaaccaaaggaagagcgtgtttcccccaaccctgcaccctggcccggaggtgggtttggaagagcaggct

SEQ ID NO: 84620 - DNA, 1104 bp, Homo sapiens
cttggtgtgcagcctgcaggcactttgtcctcagcaccccgactccctcatagcagcctctcctcgctggtcctaccggatgctgcgtacacctctgctgcctatgagttcacccccgacatcgctgccacggacagacattggtggggaccgtgggatgcaatgcagtggagaccgtgcaggcggggagtccctcaggaggagggggtgcaggcctggctgggacactggcctgaggggcactgtggctgcccagcctggaactgagtggcccgagattggctggagaagtggcggtcctccacctggtccctctgccacccttggacctcagaccttctcctgctgagccctcgagatctgtccatgtccctcagacagtgggagcagaagctggtggacacctgtgggtttaaaatgctgcttggagccagttgagccggagaggctgaaggcctatgggggcagctgtggcctatgccccacttcaagagctgccactgccccgtctgctccaagtcagggcatacacacacactcacatccacgcacacaaacacaaccgcattgacacacgctcacacctacacacacatcaccatgcacacacacacactgatatccacacacacactgacatccacacacacacactgacatccacatacacactcacatccacacacacacactgacatccacatccacacacacatccacacacacacccacgtacacacacactgacatccacgtgcacacacacatgctctcatccacacgcacacacacatccacatggacacacacgctcacatccacacacacagacatccacgtacacacagacacatccatgtgcacacacacatccacatggacacacacatccacacacacatccacatgtacacacacgtctacacacacttgcgcatgcacatttatgcacacacatccacatgcacacatagtgctcacatccacacacacatccacatacacacactcatatccacatgcatacacacttgctcacatgcagacacacaagctcacacacacatgcatgtacacacactagcgttacactcatgcacacag

SEQ ID NO: 84621 - DNA, 1044 bp, Homo sapiens
gtgcagtggcatgatcattgttcactgcagccttcaactcctggggtcctgcaatcttcccaccccagcttcccgggcagctgagactacagatgtgtgccaccacgcctgtctaatttttaattttttgtagagacagggtatcgctttgttgcccgggctggtctctaactagccctcaagcaatcctcccacctccgcttcccaaagcactgggattacagacgtgagccacagcacccggcctctcccttttcttataaagacactagtcctatcggattagggcctcacccttgcaccctcattttaccttaattacctcctaaagaccttctctccaaatacagtcactctgggggtcagggcttcaacataggaattttgaagggacacagttcagtccatagcacccacattctcctcgttggaattcttgttttcttaaaattggagctcccacagctagtcccatattttctgtaatttacataaaagcctctggaagcctttgtagctctccagcactggatgtcctgagccggcagggaaacgcctcagtctttgtgctcgtataaatgtctcgttataattgtctcgttactcgtataaatgtctttcttgatcgcttcgcccattgtgagccaatcctgggttggggggatccaaaaagagaggttttcagaataatcgcttccctcacgtcctgaccgtcaagatgggcagacagtattctctagtgtgacgtgcactgtggttgggactggggttcccaggactcagagcagccaggagggctgcctggaggagtgggcccctggaggctgggcaggtttctgaaaggctgagggcagagggaagggcatccggggaggggaagaccacacaggctgaggccggaagctggaaacgggctgggcaagtgctcaactgtgaggatgatgcctggggagcacagaggcgtgtgctgaaggaaaaaggaacacaggatgcaatggcagattcgacttaggaacagtggaccgaggaggagggacggggcat

SEQ ID NO: 84622 - DNA, 1049 bp, Homo sapiens
gtctcgctctgttgcccaggctgagtggaatggcgccaactcagctcactgcaaccttcacctcccaggctcaagcgactctcctgcctcagcctcctgagcagctgggattacaggtgcccaccaccacgcccagctaatttttgtatttttagtagagacggggtttcaccatgttggccaggctggtctcgaacacctgaccttgtgatccacccgcctcggcctcccaataatttgtaagttatgttagcgggatcctcaaggccttgctttgccccgtggagacgcttgctcggatgagctcaggaaacagtaccggctgcgtggcaggtctgggtgttgtgtgcgaggacgtggcctttgaacaccgctgtgttctcagaggtccttaggagatatttttttttgtcttagggggactgtgttaagttcagacaaatcatgctgggtgtgtagagagtgtgaaatacgtcagtgaagtaagtagcagtgagcgattgtgaatgtgtaatgtaaatggaaaaccgggttttaccgtgttaagttattcactagggagccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccactgattaaaaacaaacattcccaagtgtctctgagagatgctgtttatttgttaattaaaaagcttttttctctgtcttttaaattatggctttcatgtaataaggatatttttagtgaaaaattgttttcctttcaaattacagaccttttaaaaaaacttaatttgagcgagtaccttttcatttgacacttttcctgtttctaaccttaggaaaccagaatagcgtttggcagacacgacgttttcagtttacctttgacacctgccccactccattttgctttgtgatgtcttcatttaacaataaattatctgaa

SEQ ID NO: 84623 - DNA, 1047 bp, Homo sapiens
accactgcactctagcctgggtgacagagcgagactccatctcaaaaaaaaaaaaaaaaaaagaggaaacggaggctcggaagagtgaagtaacttggctgaggtcttaagcttgtgcgagtgggagcaggatccagggctgctgcccgcagtggctaacagtgatgtggggccagctttggaagcctgcacccctgtatttaaatcccagctccagtactcagtggcgctgtgaccttcacctctgcacctcggtttcttctctcagggtcgttggggagattaaattggatcccgtaagtaaagtacttagacgacgggtacctggcacatagtaagtactttatagactctgtgaccctatgctgcttctcactggggcggccacgtttctacatgtgcaccccacaaatgactcacggtcacagtggggaccccaagcccccggctcagaggagcggcttcacgcggcctcttatgtctcccgcccaggtacacctccttggtcaagtacgactccgagaggcacttcatcgacgacgtgcagctgcccctgggcctggcggtggcctcctgcagccagacggtcacctgtgtccccaatggcacgtggcgcaactacaaggccgaggtgcgcttcgagccacgccacaggcccacccgcttcctcagtaccaccatcgtgtaccccaagtaccccaaggccgtctacaccaccaccctggattacaactgccgcaagacgctgaggaggtttctgtccagcgtggagctcgaagccgcggagctcccgggcagcgacgacctctctgatgaatgctgacccagcaggctgggctggggtcggaccggctctcccgctgtcctgcccccgactgccctggccaagctgggcgaccttacccttcacgtcattccagccccagaggagtctaacctagagatacctccaagcgcggccgggggaagagaaaaaaaagaaaaaatcactgcatctcataattattgagatctttgtgttgtaattttcaagctgtttttagaggg

SEQ ID NO: 84624 - DNA, 1047 bp, Homo sapiens
cagcatgggggacacagatcccagttgggcccatcagctggaggctcagacccacagccttctgtgggcaatgcttagaaatggcccgtgggggccgggtgcggtggctcacgcctgtaatcccagcactttgggaggccgaggtgggcggatcatctgaggtcaggagttcgagaccagcctggccaacatgacgaaaccccgtctctactaaaaatacaaaaaaaaaaaaaaattggccaagcgtggtggcacatgcctgtaattccagctactcaggaggctgaggcaggcgaattgcttgaacctgggaggcagaggttgcagtgagctgagattgtacgattgcactccagcctgggtaacagagcgagactctgtctcacaaaaataaaaaataaaaaaaaataaaaaataaaagaaatggcccgtaagagctctaactgcattcttctctgtccttgaagagtccagcgtctctccccctggctcccggctgtgcgctgaggctttgtcccctgtcctttggcgaaggagtggagtttgaccccttaccaccaaaggaagtaaggtaaatatagcaggccccaattttattctttttttttttttaacaatttttattttttattccagatattaatgcttgttgttataaaaaattagttaattgcaaaagtatgacagagatgattaatagtttggtgggtcctctttctgttcctgcattctaaccaattaaatatatagacatgcttttaaaattaaaataaaaatgagatcatgttatgtataaagttctgcattttctttttgcaattcatgtatcatggctgtcagagggttacaattttgtcaaatattaattcttctttccagaagctgctgtaccctactcccttacctgccaacccagtctctgaggtcttttaaccttgtctcatagtataatttcactaggcaagcgctggtcttcctctggggattatctcatccaggattatctgggggcaaagatgcattgaaaggctcaggtaaagagaggtc

SEQ ID NO: 84625 - DNA, 1061 bp, Homo sapiens
catgcccggctaattttttttttgtatttttagtagagacggggtttcaacgtgttaggatggtcttgatctcctgaccttgtgatccgcctgccttggcctcccaaagtgctgggattacaggcatgagccactgtgcctggcccacaccacgctaatttttgtatttttagtagagacggggttttgccatgttggccaggctggtctcgaactcctggcctcaagtgatccgccgcctgggcctcccaaagtgttgggattacaggcatgagccaccgcacccggcccacacccggctaatttttgtatttttagtagagacggggttttgccatgttggccaggctggtctcgaactcctgtcctcaagtgatctgcccgcctcggcctcccacagtgctgggattacaggcttgagccaccacactctgcccgtaccctctcttttcctaagatttttttaaacctttgattctggaagttctaagaaaaaactaaatcggaggagaaagaaaccattataacacatttcacagtttctctttgtttaggcatctgtctcttgggcacatttaggttcgtgatgtctaaatatgtgctgacatcataacctttttgtttttaggaagtagagtgcttaaaggcttgaagcttagagccaggctgcttagtttttaatcgtggctctcctgttttcttgctgtattactctggacaaggtactcaacttttctgtacttaactctttgaaaatgaggatagtaataatacatactatgtaagtttattgtaaaaagtaaatgagctgggcgcagtgagtggctcacacctgtaatcccagcactttgggaggccaaggtgggtggatcacctgaggtcaggatgtcgagaccagcctgggcaacatggtgaaaccctgtctctactgaaaataaaagttagctgggcatggtggcgtgtgcctgtagtcccagctacatgggaggctgacgcaggagaattgcttgaaccctgaagatggaggttgcagtgggccaagatcatgccgctgcactcca

SEQ ID NO: 84626 - DNA, 1030 bp, Homo sapiens
aggatgcttgaatgacattcttgccaagcacttgttttgagccattcttcaccctctctggctgggccctacttcctggtgatttgtcttttacatttagggagctataggaccacagaggaacaaatggccctgttgcatctgaggaccagggtagcctgtgaacctgggtctgtcccaggacctctccaaggaaaaatcccccaaaggccaaaagtggtaagggaacgagggcagggaaggcccttctggacaagctgaggcagctgaacagggtaaccacgtagagaccatgaaaaactgacaggagcttactcaagtttgcaaagacaatgctttattgtaaaacacaggtacaggactgtcagaatggcagttggccaactgtcagacaccttctgtcccgggaggactgggctgggggtactggtttctcagggcagcacagcccctttctgcctgaactcactcggccagggccaagctcctggcctggagcccagtgtctcctggccgaggtggtgctctgtggtggtggtcaggggtcagctaggaacacttgagcctttttccccagctccttcctttttggttttcatatttgaaatgttttggcagaactggtctttaaatcatcccctcttcattgttcagttgttgctctcctctcctctcaagtttgcagagtttcaggttctaaatccttagccagaaaagcctgatgaacaccatgagttctttctttccctctctatttagtcagctctcctctccacagacttctctaaatccttcagcttctttaattcaacttcgtcctcctaccctattctttgtgccaggtatcacgacctggcagttattctgcattccaaatcctgaaaatggctgtctgatatccttcaagggttttcccttaaagataagtttctaggaaggcaacagaagccctatggccactttacccaggtgggacgggccttgaggaatcggttcactgcagctctgctgtgaggagacgtgaaggctg

SEQ ID NO: 84627 - DNA, 1093 bp, Homo sapiens
tgtctggtgcagacgttcccccactttaccccttcccatgtcttccaaagctgcctgtggtagatagttacagttgtatatatggacaactctcagttgtccccatttgtgagagaaactgttctaggtatctatttctttgtaacaaaccagcacaaaacttagtagcttaaaacaataattgttttgcacgtataatttggcctggctcggggaccagctcatccctgctccgtgcagcattagccgaggcagctcaggaggggactggagaatgcattggctcactctcatggctggctccttggtgcttgctgtcagctgggagcttggccaggccgttgctgggattctttgttgtcttccacgggctgcttggacttcctcacggtaaggtggctggttccaagaatgagcgtcccaagagaaccaagccttggaaatttcatagcatcacttctgccatagtcacaaggctgctaagattcaagaggaaggaacatagtcttctcccacccactaacgggaggaatgtcaaagtcacattgttacaaaaagcatgtgggatgggatagattgctgtggcggtctttagaaaatacagtgagccacggccgggtatggtggctcacacctgtaatcccagcactttgggaggccgaggcgggtggatcacccgaggtcaggagttcgaggccagcctggccaacatggcgaaaccccgtctctactaaaaatacaaaaattatctggacatggtggcaggtgcctgtaatcccagctactcgggaagctgaggcaggagtcacttgaacctgggaagtggaggttgcagtgagctgagatcctgccattgtactctagcctgggcgacagggtgagactcaaaaaaaaaaaaaaatacagtgaaccacaaaaactttagatacgataaaaagatgactttccccccaaccttattctttccttcttattgctgttgagttttaatcccagattcagatccagtggaaaggaaagtaatttctcagagcgaaggaggatgaggattccaagggaggacgaggaggagttgatgcaccaccttttctgt

SEQ ID NO: 84628 - DNA, 1039 bp, Homo sapiens
ttccattaccttggatttgctgagatttttgattgtagacattgttcttccattaccttggatttgctgagattttttattttagacactattcttccattaccttggatttgctgagatttttggcagccgtattacatggttggcttctactgagttggcagtcacctgaaacccccaggtcaagagtcgcaaacagatgtccgcagagctgggaaagtaacctaagcggcgtaagcaggctggtgtgtgtccacatgcatccaccaggtcctaaggggatagtcacaagtgaattctaatcagctgttgtcacgtctgaacgcagacctggaattgccagatctatcagtttttcaagagcagccggaaatccggattttcatgtaactctcacaatttttaactattggcttagtgtttttcacaaacactgcaaagggcaaacaaaacacatctgtgggccagtactgtcccaggtctttcttcatatgactttcatttaaactttctccacctctgtttgtgcaagagagtctttgaaattgtcagaccgtgtgtgtctcagctttcgtttcatcccactagttctgctcgattgtttatcccatcaagatctttgggagccttgatgacctccccactttatcattagcagatttgccagacatgccttctgtgtcttcattcaagttgtagatgaaaaggcagaatggagtggattcagagccgtgtgacgtgccgtcagaggcttcctgttcttcctcctcacttcagcgcaaagtgccagacccaaaaaacaggatttctacctgtctgtgtgtgtcgtccggggctgtttcttcatcttcccatgtcttgattttcaccaaaaaaggaggctgttaatacttgccttcttcacttttacatagagatatcataaagattatgaactaaagcagcaaagtacattgccttccaaggagaaagtgttccttgcttttcttcctcaaaattagcatattatgcaattcaagcattagaacgaaaataggcc

SEQ ID NO: 84629 - DNA, 1047 bp, Homo sapiens
agtcttacagtgcaggagtcatagatgtttaaaatttcaagaatgtgaaaatagtgagtgattcatcggcattttttgttgggtcatgctgtgcataatagatgtgtatctttcagttatttacgtttcaacctgtggttctggactcttgcaaactagcggtattacagagtcagacccagaattcgacagtctgcaggaatgtcggcgttctcccccatcccgtattaataggttacaggttgccgcagcagagcaggtcgtatttcacagagcaagaccacattttcaagaatgtttagatagcatttcaatctgtgatggaactttgtattcgtctccttagaatccagacagaaaggaagcccagaagaaataactgcttttcctgtcatggccccatctgtcttttccagcactttgtaatgcaaactgaagtacaagcttttttttttccaaggagctcttgggtcctgtccttgtcaactcctaggtatgaaagccttgctctccagccctggctggctggtttgctaaaaggagtctatttgactgcaacagacttggtggaattacggatgttccaaaatactgagttttgtaggtcaagaggccccacgttcccctcttccctggaagagaagagaagtttgctttcagcactcgcttcctaagcttctgaagaacactcagaagggagtggcatatggacaaaaggaggttttcgttttataaatttaatcttgattgtgtttaaccagaaccgatgtgccgcttttaaatttgtatttattattatcatgttagggacagggtcctgccttgttgctcaggctggagtgcaatcatttttcacggtaaccttgaactcctggggccaagtgatcctcccaccttagcctccgaagtagctaggactacaggcatgtgccaccacacacagctatttttaatttttaattttttatttttggtagagatgggttcttgctgtgttgcccgggctggtcttgaactcctggcctgaagtgatcctcctgccttggg

SEQ ID NO: 84630 - DNA, 1045 bp, Homo sapiens
agaggagctggaagccgtagatctgcctcaggcatggattgcatgatcagggcccggaagcactgattccatctatcactctggctctttccgcctcataaggggaccgagaaagggattgtgtgtgaggtaatttgagttatctggcatgttcacgtaaaggctccggaactttgtcattcctgatgtactccatgaaaaatcctgcagattttattagtcctttcagatagctctgactattaagtgaaaataggcatttttaacaacaaggcgatgcatcagcctgcactgggcttgacttcccgcacggctgtcgctgccctcctcctgcctgatgccactcacacatgtttggttttctggacaattaggtgcagtctgcagaagttgatgaataaattactttttactttttttcttttggtcaacctagaataaagattatttgaatgactgtatccttgaactgttttgctaggagactggatgacaatattcgaactgttgtaagaggtcagacgaacgtggggcaggatggacggcaagtaagtaactcattcctccatattacctatgctcccctggtttctcccggcaaccagatgaccaaaacgtcgatgtgccctcttgcagagcactttccgattgatccgtttcatacatggcaggacaagacagggcaggcgcccacagcagccacgtgctgtccctcagtgtcccttggaccaggaccgtgaactgtggcaccgctcacccgaggccagatgagaacactggggcttccttgtctttctccttcgtgtcgggcatctcttgtgccctcttttattttgtgggctgtggctaaatgaggttgctgcattcgtcagctgagttgttggggttttgatattttgtggctgtaaaagatagtaacctgacatagttaccatttcctcgtacctcgctttgccagcaggcaggtgactcaagattcattaaaaaattttacaagttggccgggcacagcgggcacagcggctcacgcctgtaatcccagcta

SEQ ID NO: 84631 - DNA, 1026 bp, Homo sapiens
acttgagttcaggagtttgaaatcagcctggccaacatggcaaaaccccatctctactaaaaatacaaacattagccgggcgtggtggtgggcacctgcaatcccagctactcaggaggctgaggcaggagaatcgcttgaacccgggaggcggaggttgcagtgagctgagatcacaccactgcactccagctggggcggcagagtgagactgtctcagaaaaaaaaaaaaaaaaagacacccagctcaacccagctgctggtctgctgtcctggaaggccatacctgtgcgactggcacaaggacaaagagaatgaccgcatgatgtgtgatcatgaggcggtttcgacttaggaagtttcgaagagtgagggagggcgcacggttctggtctctggttcggcaccattcacagaggtacatggcgtacgagtcatagatcatgtatggaatcagaaaccacacatattcccgggcaagccagtgcctgaaagaaagcatatgaatggcccgtgaaatcattgtggatatccattatgaaggctcacagccaagcttggtgcttgatcagctattattattccaaatactttacaataaagatgttgaaactgataaacagggagagtagaccacttgctctcagtttcagggccaattcgtgagtgtcaaaggcaaaaagcaggcattcactcagccctgcctgttgaagcagcttgctgtcactacttgcctgacttagctactaatttgtagtagatgttctggcattttgtgataaaactgattttgatatagatagatatacaaatgattcaacggccccaccaagaagctggtttggaaagtgtcccaaatcacaaatccaacatttctagtttaactccttagctgctcaacagttgggggttttactaacttaaatcctggaacctgtgagttttctcttgtctgcatgcaaccccactctatggagtttctgggaggcaaccctggccattttctttacaattctagagctggcc

SEQ ID NO: 84632 - DNA, 1105 bp, Homo sapiens
aggttgcagtgagctgagatcacgccattgctctccagcctgggcaacaagaacaaaactccgtctcaaaaaataaaaataaaataaataaataagggtaacgtgcattaaattctttaagaagtgtctgggacctaccatctaggaaccagaacatctagggtgctttgagaccctaacatctagcacagggcctggcacattttgttgaaccaaacaggctgagtgtcttggcatgactaagttcgatacacaaaagtaggcttgcagccttccttccggctgtcatcaaaattcagagcttggtgtgggacgccgtcatcctgtctgaatttgcctctggatcctagggcttggaccatcaaagtgctgttgccacggaagcagcggtacagtagtctgcgcttgcctattgagcgtcctttgcccgtcacagttacccttttcagtagccctcgttggaattttccttctggtggtttcttaacctccacttacttccccttttcgtttcgtcatccgcagaggctccggggagaccttggggacttctttgtcggctgcatcttcacggcagaactgagcactccgtttgtgtcgctgggcagggttctgattcaggcatgtatgaatgaaatgacagagagtgtgagggttctgattcaggcatgtatgaatgaaatgacagagagagtgagggttctgattcaggcatgtatgaatgaatggcagagagagtgaaggttctgattcaggcatgtatgaatgaatggcagagagagtgagggttctgattcaggcatgcatgaatgaaatggcagaaagagtgtgggagggagtggattctgcttttccttcggagatggtgggtgtggagaaatccctagtgccaggagagtgggatgagagatccttcaacagccttaaaggtcagctggtcatctcagccagtgggggtgaaattgtaggtttgatctaagtttgatagtttgatacagctcattctattttttccctggttacacacatactttaatccacggttcctgtactcctgtcagctgggtggcctgggtcaaattcaaaatcactattggagaaaatg

SEQ ID NO: 84633 - DNA, 1086 bp, Homo sapiens
cccacgccaagtcagaagctgctcatcttctgcaacagggtttggcgccgttcttcagggccgatgccctcagcaatggactttaagaagcgctgctcgtgtgccctctggagcaaggagctgacagaagggttggtcttgctcaaagtctcatagcaggtgagggtttccaaggctaaaacgtagagtggctcacagacctccgggtggagcatggccatgatgtgcagagcatggcagaacacctgggtgtaaacaaacagggcttcctgggtcaggtcctgctctggtccttgaacccaagggccagctgcctgtatcgccctgactgagtccaggaggcgggtcagactgccacagaggagtttgaccacgtggttccagccttccagaggaagccaatcacgacagctatggctgcagagaaactggaaagtcctcaggaagaggacggagagttgcaactcctgggcaaagggcttcaggttgagcaggggaacaaactgaatatattccaggctataagggacatggaggagctgcttctccagcagtctcctggtcagctggtgaaggcgctgccactcctgagggctgcaccaaggcatgacttgcaccagggccaccagaaagcctttgctgaacagtctgacctcctcaggattgcccacgtccaccaccaagagagacagcatcctctccgagatgccgctggagacgcagcagcactccatccaggccaggagccccgtgccagccccgtaccctgggtgggcctgggaggtccactcgtcttctgaaagcttacagatctcaaaaagtgtggctggcacttcacacttgaagtgcccctcgaagaagctcttcagcctcaggcccacagtccagtctagctgttctaacttgcggtggagccaggacagggacttgatccagacatccggggagaaggtctcagcattggctgatacaatctcacacaggagctccaggatatggatcgctagatccttcctatccaaagagaggcaccgcttctccttgggaagctgccagtatttgctgaagcggtccaagagctggcac

SEQ ID NO: 84634 - DNA, 1147 bp, Homo sapiens
gggcagatacctctcagaatcacatttcccagcttacttccctcctgaacttccacctggcatttccgttgctggaggacatctgtaccttgatggccaaagctgaactcatctttcctcacacctgctctgattctcctccattccctgtatgtgatgtcacctggtggcctcccagttcccaggctggagagctcggaagccattctggattcctcggccaagtccttctgactccagctgtgcagtggctcttgtagtcatcccttctccccgtccgctgatgtcctttaaaacccttgtcatctcaaaccatgacagcctactaacagcagtggccatctggaaacattttcactatactgtcttatttggcttgtctgtgtgcaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacga

SEQ ID NO: 84635 - DNA, 1055 bp, Homo sapiens
gcgcttggcgcgctcgttcgtgaggactgcgcgtgcgcggcggaggctgtgggcggggccgggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggtgggtgccgcggctccccggccccgggctgcgtccagcaatgcgccaccagagcggtgctgccccgtcgcgtctcctcctgtcgcgcacgctcgcgcgggcccggaccgaaacgtcccccgcgtcggggcgggtctaggggtcccggggtggccttggcggggggtggtccgggtcccgccgcgcgttgggccgcgtcttgccgcctccggccccctgcgcttgaaaacacggagcagacgtgaagttagagcccttggaagcgcccggggctcgcgcacgtgctttgggaaacgggctccctccgagcacccctgggcgccccgacggcctcatttcctgaacggcagctgcgttcttgagcaagtgtcttaacgctccaagtgtcttacgctcatgacgtttcctcatcgacagagcggggagaatggaagtgtgtctccccactgagttttgggcgactttgcattgagatcgccgaggtacagtgtcccttgtggggttgcgcgggtcacacccgcggtgggggcggctgcgctcctgaggtatcactttgtgaacctgcgtgcgtccggattcagaatcttacaggcaaggtctgggagggagcccataggaactagatgctccctgctaaatcttggcacacgctgctaagaccaggaggctgttctgggagagctgggggtgaggcaccccgagatgtgtcagcagtagtaggctggggggaaatggtctggtccccgcccccagacagcttttcaggagcggaatggcagagctctaagggcttggagcccctcagccgtaattgcttcccagccccaccacattcaggctgggacaccc

SEQ ID NO: 84636 - DNA, 1014 bp, Homo sapiens
aacgcttgataccagatcgtttgagctttctgactagctagttcaacccagctaagaactttgtccttcccttcttgaggtcctttttgattgtggctttagtatcaagttcagcagttgtttcaagagcagctgagataataaattcaaacaaatggcgccttggttctttatggtatctgatactcctctaggactgacgagggccgtgtcctgagtagtgtgtgacccctggctcacgttgcctctgttttcctcaagttgccagacttagaagacttgatgaaaagggagaaccagaagattctgactcccctggtgagcctggacaccccagggaaagcaacagtacaggtggtcattctggccgaccctgtaagtatttctcaggcagggggcaggctggaccaggggtttcttcaaggatgtctttggcaggtgtcttttctctttattggtgtaggacggacatgaaatttgctttgtcggggatgaagcatttcgagaactttctaagatggatccagagggaagcaaattgttggatgatgtgagtcccatttctacatttatgtcaccatgggcctgagagggatggcattaagtgtgtgtgggaggagactaagcaacagggtccaggttcttaatgtcagaaccacgtcctttcgctgttgggttgacctcagccaaggaccgatgtcttcactgccacctgtgtagactgcttgtctagacttagcatttgtgccttaccacaacctcaggctgccctggaaccactgctggtggatctgtgcttattctgctctccacatggagatgcctctatccgaccccctcagctctccccatggagatgcctccatccgaccccctcagctctccccatggagatgcctccatccgaccccctcagctctctgcatggagatgcctccatctgaccccctcagctctccccatggagatgcctctatccgttcccctcagctctcgccagggagatgcctccat

SEQ ID NO: 84637 - DNA, 1036 bp, Homo sapiens
tcaggatttccgatgaccaactacaagtcagggctcccgctcctgcttccttgggtttgatagtctgctacagtggctcatggaactaagggaaacgctggaaacacttacttacatttactggtttatcataaagagtacgagtcagaaatggctggacagaggagatacacagggcagggcatggggagtgggtggcagagcttccatgctcttctgggcaggctccaatccagcacctccctacgttcagcatcccagaagctcatgagtctcattgttcaagcctaatagagcccagtctccatccctttccttcccagaggttggtggatgggactgaaagttcagtcctctaatcatttgtctttctggtgaccagccccatcctgagtctatgtagaggccccactctaagtcacttcattagcataaactcaggtgtgactgaaaggggctcattatgaatataacaaaagatattcctatcaggaaattccagaggttttgggagctctgagacaggaaccagggacaatgaccagatatgtttcatattatgccacaaatgcaaataagtacatgctctagatgaagcagcggctttccagtatctttttttttttgagacagaatctcactttgtcacccaggtgggagtgcggggtcattatcctggctcactgcaacctctgtcttctgagttcaagcaattctcctccctcagcctccctagtacgtgggactatgggcatgtgccaccatgcccagctaatttttgtatttttagtagagacggggtttcaccatgttggccaggctggtctcgaactcctgacctcaggtgatcctcccgcctcggcctcccaaagtgctgggattacaggcctgagccaccacgcccgtccatctcttaagcttagtaccgtgacaagttggaacagtccaaggcctattaggaatttcatgcttgttgattgatagtcaaggaaataacaggtcagttggagaactgtctttaggattctgttccttg

SEQ ID NO: 84638 - DNA, 1104 bp, Homo sapiens
cttgctgcagccgtcggctcctccctccccagccttgttccctgttcccttcctgcatttcttttttttttttttaaagacaagagtttcacttttgtcacccaggctggagtgcagtggcacgatctgactcactgcaacctccgcctcccacattcaagcaagtctcctgtctcagcctcccaagtagctgggactacaggcacacgccaccacgccgggctaatgtttgtatttttagtagagacagggtgtcgccatgtttgccaggctgatctcaaactcctgacctcgtgatccgcccgccttggcctcccaaagtgctgggattacaggcgtgagccaccgcacgcggcccccttcgtgccttttgaggaagcagcagccttggtcatggcccataagaactcagacttcaactgaaaaaagtggctcttccctacacaacagtccaggaagctggatattgggagtgtggtgagacgagaactgacccatccataagctattctggattctctgtcactctcagccgtggagcatcaagcaggcttcctgaagcttcgggaggacctggcttcagctgctgtctcagctgctcgaatgtaacatggttccgtagttgagacttcagtcatcctgagcaataaaccagctcatccactaacttggctcctagcttattacatgtgtgcactccctgcactgatgaaaacaggaaacatggcgggcgcaggggctcacgcctggcatcccagcactttcgaggctgaagcaggaggatagcttgaggccgggagttcaagactagcctaggcaacgtggcaaaaccccatctaaaaaaaaaaaaagaaaacagaggaaacacaatcatggaatttttaaggtggcaacatgttttcttaaaaacaggtgagcctgtcagctctgctcctgagggagaggtagcttggtcaagagggcagccccaggccctgcagtacagctggtgattttcagcccagagccctggaaccttggatggggagtgtgtgtgagggctgtgcgtggtagaatggcaaaagtggggctaagtgtggcccagcgtggctggtgcggacatct

SEQ ID NO: 84639 - DNA, 1003 bp, Homo sapiens
gtctgtggaagagaggcaggcacgggggacggggagggaggagaagccaacctgaaggcaaagctgcccatttcccggctcagcgcctggggctctccgagggcctcctccaagcggcctttttcctgactgtggctgcagcctcttttgagtccgtgcctgcggggcccaggacagcatggcgaggacacggagcccccacctggcttctgaggagcactcaggggcttccccgaggaacggctcctcctaagacgaggtgtgccgggacgggccgtgttgggccgcgtgactgtctgcataagcagaaaccaacttgggcccaaggaagccactcgtgttcggcccctgcacgggggaaagcacccatgtctgctgtgccaggctgcctcccctcagctggtcctgacgagcttggcctacagccatgacgagtgcacatccctccaaaggtgaaccaggggcgggaaacggaactggcttctgcggccgtctgccctgtgctaggcacggcacagatggcactggctaatccttatcacagatggggcgggcagcatcaggatccccctaacagatggtcaaggtgacccccaggtcacccagccaggcagtggttacagtagggatgggggtcacccagccaggcagtggttacactggggacaggaccctgatccacctgttgcagaagctgctgctcttcctgccaggccgtggacgcttctggggtcctcacagcacctgcgatggggactgtcttaaccagggcggggaagtcctgtacctgcagctttctgcaccacccacctccctctgctcctgggggagaaggctgagaccacagccaccatttccctttctcccccttcacacacgccctgttcccccagcccttgaagcaggttctctgaaatacacattttttttttttttttagacgcagtctccctctgctgcccaggctggagtgcagtggcgcgatctcggctcactgcaagct

SEQ ID NO: 84640 - DNA, 1071 bp, Homo sapiens
ggggagctgaggaaaacctcttcttgctgtaaatactgggggatgtcccaattcaggcctggattgtttgagattaggacgtattttctgatttgctcagctttttagattgtggtgaagagacagggaagggggaggaagggggaggatggaaaagagccagagacgaatgtaatcagacacctgtcttggatggctgttttttgttttttgggttttttttgagacggagtctcgctctgtcgcccaggctggggtgcagtggtgcgatcttggctcactgcaagctccacctcccgggttcacgccattctcctgcctcagcctctcgaatagctgggactacaggcgcccaccagcatgcctggctaattttttgtattagccatggggtttcaccatgttagccaggatggtctcgatctcctgaccccgtgatcctcctgccttggcctcccaaaatgctgggattacaggcatgagccaccgcgcccggccggatggctgttatctcagctctggccctttgctgtgtctggtgctatttgaatgtacacggatacacgcggataaggaatcacaaaacaggcattcttcccggagtcagtcagctcctctgagcctcagtttcctctgcttattgccctctctaaggcctcacttatcagtgaatttccttcacctcaaaactcccgccccagtttagactgagtcaccagtggcctctgccgcttatgttcctgttcccaaaaggatccgagatgccggcacacacagggcactttgtacattgttgtatctgcggtgtccacaccatcctgggcttggcttattggcccgcagtcctgctctgccatgccacagctcccgcctctgccgtgccacagctcccgtctctgccatgccacagctccccgtctctgccgtgccgcagctccccgtctctgccatgccacagctcccgtctctgccatgccacagctcccgtctcagcgtgaagccgtgccaggtgcagcagtcagtttttttttttgtttttttttttttttttaggtggagtctcgctctgtt

SEQ ID NO: 84641 - DNA, 1062 bp, Homo sapiens
ctgagtcccctatgctgttgcagactatgggggccagtggggtcatcagcctccacctccaagtcccccacactgtcgcagaccccggggggcagtgggaccatcacctccctcctcggagccccccgcactgtcacagaccccggggggcagtgggattgtagttaacgtgcccctttgcccagcagccctgcttggcatccattattcttttctgtgtgcttgaatgcttgcctgttcatccagcctccagacctaaggggctcaaaagaactctgcaatgaatctggtttggacttaaccaccttcttttgcttttcttcatacagctcaaactttggaacaaataccgaatttccaacattccatcactaatattcctcgacgccaccactgggaaggttgtgtgcaggaacgggctgctggtgatccgagatgacccagaaggtaaaacctcagcccgtgcatatggtcctcttattacccagccctccctcctccatgcccttaggctaatctccgtcccaccggtggagagagtactggtgaaatagatacacgtgggtttacgtggtagagaatgtcgtcttggtgaaatcatagtattccctaggacatggttttaagattttcacagggatcagaatgtccctcctaggggctttaattcatgggccaaaagagatggactctgccgtaagaagctccgcttggagggccgcagaggctgtgggaaagcggagagctcagaccccggcctctagtgctgcatccgtggcggctgcccccttcacagttagaggcaggctgagtggggtttttcctctttaaaacattacatagcgaagtcccagcccccgtgtcactctcctggccttggcggtgagtgcacctcgttgcttggagctgtcactccctgcgggccttggtcttgctggctacgcgtgggctgtgctcctccagccgccccgctcagggccgtccgcgtggcgtctttccctctggcagtgagtgagaacagggctgtgagatctcctcccctcacttaatccgtccagtgag

SEQ ID NO: 84642 - DNA, 1069 bp, Homo sapiens
cggaggttgcagtgagctgagatcaggtcactgccctccaacctaggcaacagagcaagactatgtcttaaataataataataataataataaattttttaaagttaaaagtatataacataatatacaaagagaaggctcactttcactgccgggagtgagcgttttccttagcttctgactcaccctttccaacttccttactgcagaagtaacccacacctctctgccctgggccctttgcttgatgcttacaaaggaagggtctgagatgctggttctcaggatcggctatgaccagaggagacacattagaacagattggagttcctgctcttccctctgttaatttgctcggttttgcctgttgtttagtcacctatgaaaagtcagagtaccccgtggaggacagggaaggggtgtctggaacggcctgagggccaggcctttcagagagaaggaagcagcctgagtttggtttggatggtccattgaatcgcgtttgatgggagtggagctgactgtggtgtccccagagcagatctgggatccgtgaaacaggtcgtgacagagcagatcagttgtttctctggcaggcccgtccgtgcagctgttgttttgtatttgagtagtttgcgtttccctttccttttcatacaagattatctggtcctaatcccctccctcctgcataagggttgctgggaaccatttttttttcttttgaataaacgtcttggggaagtcaacttttcacatttgttgttgttctttacttgacattaaggagcttttataagcaattaaaactaggagaaaacccaaaccaaaaatttcccctaaactccccgtgacctcagtcggaatcgctccagtattcctggtcttaactcctttggtgaatttagagagcgactctttattccacttccaaacgaccgctttgaactatcggtcagcgtggataaacacatctcagggagggggcccatgaaatatggttgtgggctcagactgagaaggcctcattttcaaactagagctggacgggaaactgcatctgaaagta

SEQ ID NO: 84643 - DNA, 1130 bp, Homo sapiens
ggcggctcacgcctgtaatcccagcactgtgggaggccgaggtgggcggatcacctgagttcaggagttcaagaccagcctggccaacatggtgaaaccccgtctctactaaaaacagaaaaattagccgagcatagtggcacttgtttgtaaccccagctactcaggaggccgagccacacaaatcacttgaacccaggaggcggaggttgcagtgagccgagatggtgccactgcattccagcgcaggcgacagagtgaaactgtgtctcaaaaaaaagaaagagctgagaaatttaaatgtgttttaaaatcttgagttgatactgatatgttgcactcagaaccagctgcccagggcccttccttacttccccagtccgtatctgtgttcctctcatcccactgtgataaccttgtttacagatttgcaacatccgtaatcatggccagcagtgatcctaacaagtcaagttcaaactttcttttcagttctttttgtccttagatcacatccaagaaaggaggaatagtcagagagctagatccaaaagtcacttaaattatttgcctttttgtctagataggtaatagttactattagagttagggtcacatgtttctgctcatattaaactttaggatttgctgtttgctcctacttttgacttgattttattcttttagtaaaagtaaaatgtttacgaggttcaaaagtcaaaactatgcaggccgggcgcggcggctcacgcctgtcatcccagcactttgggaggccaaggtgggtggatcacctgaggtcaggagttcaagaccagcctggccaggatggcgaaaccctgtctctatggaaaatacaaaaattagccgggcgcggtggctcacgcctgtcatcccagcactttgggaggccaaggtgggtggatcacctgaggtcaggagttcaagaccagcctggccaggatggcgaaaccctgtctctatggaaaatacaaaaattagccgggcgcggtggctcacgcctgtcatcccagcactttgggaggccaaggtgggtggatcacctgaggtcaggagttcaagaccagcctggccaggatggcgaaaccctgtctctatggaaaatacaa

SEQ ID NO: 84644 - DNA, 1008 bp, Homo sapiens
cactggttgtgtaatgtttagctttataagtgtttgtaatttcagattttgcaatgttttatgagattaaaagtgaaaaacaaaacccaagatgtttcttgtttaatcttcattattctgtcacttaaaagaagattttgagatgtgttcctctcgtttgactaggacagactgctggcagggagtgtttttttttttttttttttttttttttttgagacgaagtctcactctgtcgcccaggctggagtgcagtggtgtgatctcgactcactgcgacctctgcctcccaggttcaagcacttctcctgcccccgagtagctgaggctacagacaagtgccaccacacccggctaatttgttttgtagttttagtagagacgggggtttcaccatgttggccaggctggtctcaaactcctgacctcgtgatctgcctgcctcggcctcccaaagtgctgggattacaggtgtgagccaccgcacccagccgggagtgtattattaaaagtgctagtcgtggttttcagtgtttaaaacatgaggcaaaggtttcatggatcctacacctaatggcacctgtagtcttgaatttttggtctgaagacagttgttggtgctcatgggatggaaggagctttgtgataaccctgaagcgctctccagggggcctttggtacatgtttgggatccactgccgtggactatttggtttaaccataatggcttcggtccaaaaaagtagaacatgggttttttgttttgttttgtttcctttgagacagagtctcgttctgttgcccaggctggagtgcaacggcacaatctcagttcactgcaacatccacctcccaggttcaagggattctcttgcctcagcctcccaagtagctgggattacaggctcccaccaacatgcctggctaatttctgtatttttagtagagatggggtttcaccatgttggccaggctggtctcaaactcttgacctcatgatccgcctgc

SEQ ID NO: 84645 - DNA, 1046 bp, Homo sapiens
gagactccgtctcaaaaaaaaaaaaaaaaaaaaagaagacttgcattaatggagaaacagactgttcctggctagaaatacaaaatattgtaaagatgtcatttctttaaaattaatttatagatttaatgcagtcatagttaaaaatcccaagcaggggcagggcatgatttttattgttaagaagcttagggtagagtatgggagacagaaacataatgttcacaaaaatatgccttgagcagttacaaagccgtatatcaagtgcaaagcaataaaattggatacatatgcactgtgggaacttggagtcctttgagaggacacactattggcagagtggagttaatcagcaaaaaaaatactttaaaaaaaagctaaaaaagataagctagagcaggaaggaatcttccttaaagtccagagtctcccggaacatggagactgtccttcccaagccttctcgcggggagggaattccttctttctgccgcctgttacatccctgtgtgagaaggtctgtgagctgagcccacatcactcgttctgctgcccaggtgtgcttccatcttcactgtggaaaagtcattttgaactccccggtgactgcaaattaagtaatcaaggacagatgggactgggttgaccattccaaggagtacagttacttgaagaatctggaagcaataccgagcacatttgttggcattaattcattggagcaataatgctgtacgtagaaagtatgttgcttttttaaaaaaacatcatcagttctgagcatttgtagcaagtgaactctaacttggaacggatgataaattcttctaaaaaacaaataaaaaccctccagacaatattatgcattgagagctttaaaaaatatatatcctacagcatttggaaaacactttgtctgtctatgccacttacaaagattagaacttttttttttttttttaatggagtctcactctgtcacccaggctggagtgcagcggcgcgatctcggctcaccacaacctccgcctcccgggttcaagtga

SEQ ID NO: 84646 - DNA, 1379 bp, Homo sapiens
ctctctgtctgtcgtgttgaggagtctctgctgtgggcaggggccgacatcttcatctgtgatcacttctgtgttgaaacagctaagccagcgctagaggcaaaaagggttcccagactctggaaaactgacaagcgaatggacttttcagactccaggagaaaatgggccatcctgggctgtgggggtgctctgtggatgagttctgtcatttgggagctggcagtggtttggtgatcaactgttggcttttccagattttacaaaatcgggaaggatttttggtgactcatgaattttctgttcaattttacttctcctaataagaagttagcctctatttatgttcagagaattaatctagattttattggtgactataaaagagatgactgtaatataaaacttctatatggtccaaaataccagaaaccagatcaaatgataaaccctagggtgagaaaagatatttccaacgtatatgacagagaaaagtgctatttttcttttctttctttcttttttccgtcctttcctttctcttttctcctttccttgtttcactctgtcgcccaggctggagtgcggtggtgcaatcttggctcactgcaagctccatctcccgggttcaagcgattctcctgcctcagcctcccgagtagctgggattacagacacgtaccaccacgcccggctaatttttcgtatttttagtagagacggggtttcaccatgttggccaggctggtctcgaactcctgacctcaggtgatccgcccgcatcggcctcccaaatgtaatcttcatgctgggattacaggtgtgagccactgcccactggcctgttttttttcttaatgcataaagagcttttaaaatcaatttgggtaaagaatttgaacagagaaagacacataaacatgaaaagatgcctggttctgtttgcaattaaagaagtacaacttttgaaatatgtgattattaaactggcaaaaggaacatttgataacatacagtgttggcaaggatgtagacggggtctctcccgcgtggttgggggagcgtaatctgatgcggtgtctttggcagtgttttaacacagttaaaaatgtgtggaccgtttgacctgtcagtccaatttctgggaatttctcaacagatcttacaaatacggttgaccctcaaacaacgttggtttgaactacaccgttccatttatacacagatttttttcaaccgaatgtggattaaaaaatagagtatttggccgggtgtggtggctcacgcttataagcccagcactttgggaggctgaggagggtggatcacttgatgttaggagttcaacaccagcctggccaacatggcaaaaccccatc

SEQ ID NO: 84647 - DNA, 1031 bp, Homo sapiens
tccatctcaaaaaataaataaataagctgtcccaaataaataaaataaaaaattagtcgggtttggtgatacacacctgtggtcccagatatgcaggatgcagaggtgggaagacccttgagcccagaatcgtgccactgcacggcagcctgggcaacagagtgagaccctgtctcaaaaaaaaaaaaaaactttttgagaatttgaaaaatgtagaaaagcactagaatataggaatcataaacctccccactgctaacattttgcactttatttgtatatctttcctttcttctgtaaaatatacttaaaaaaatacaaaagtggggtttaactatatacctgtcgttttgtcgtttccacttaactatctcacgaatattctcctcgctcatcaaatattaccaagtgtttcatcttcactcttgcttgatgtttcatcattcctgacccccgatgaggttgtccttctggtatcaaacgcacttgtgtcctatctgtttcttttatgctgcttatcaaagtttctagttacatatgttttggggatatttgatgtctgttttcttacaagagcgtaaactctgtgaggacctgtccccaatgctggacgcagtgtcctgcacgttgcaggtctgcaaatagtgactatatggatatgttgttgaacattacattttccaatttttgcttggatgggatggcctttattttaaaattaattaaaaatttttgtttgtttttgagacacggtctcgctgtgttgcccaggctggagtgcagtggtgtgatcacagctcactgcagcctagacttgctcaagcaatcctcccgtctcagcctccggggtagctaggactacaggtatgtgccaacacacctgactaatataaaatttttttggtgtaaagcggggtcttgctttaagttggtgcacaagtaattgcaccaacgtggttatttttctgtgcgaaacactggagtggcacccaggtggatgtaaacagagtgaataagacaagggccctgcc

SEQ ID NO: 84648 - DNA, 1164 bp, Homo sapiens
aaactagccagacatggtggcgggcgcctgtaatcccagctactcgggaggctgaggcaggagaatcgcttgaacccgggaggcggaggttgcagtgagctgagatcgcgccattgcattacagcctgggtgataagagcaaaactctgtctcagtcagtcaatcaggaaaaagccagaagcctctccagcctcctctgtgttcctgggtttggggtttctgaagctgcctggatgtgcttctctggaatgttggggcctccttgtacccgtcactggacttgttcaggcaggtgcagtgtgaccagctgtcaagagtattcctaggtttgctttccgggaggcgggaggcctcattcttgacttaagtctctgtatctcctttccaccccttctttcttcctccctgtcctctcctttggtgcttctgcgagacaccaaagcctgagacagtcaaacctgagacaatcagctttgaacaagagatgcagaggcttttggtggctagttcttacacctgaatccgccggctgctcccaaggccctgggccaaacctcaaagcaaatagttacttttccttcccatctgacttgtaaaatctcttctcccaacccccatcccaaattgccacccaggcctgtctccagctctgtgtacctgtacttcctgcctttacctgggcattcctttctgagtgatgggagtttcgcagatgaaagtaacttacaccgaaggtgtgaatgaggcttggtctttgaatgtttgcattttaaaactgaatgaggcttggtgctgccaagggctggggctggggagcaggggaacggaacggaacggaacggagttagtctttactgaggacggaatttcagtttgggaagatggaaagttctggagacagatggtggtgatggtagcagaacaggagatgcacctaatgctgcaggacggtccaccggaacacacttgaaataggacattttctgttatgtatgttctatcacaacaacaaattaaaaatcggccgggcgcagtggctcatccctgtaatcctagcacttcgggaggccgaggtgggcggatcacctgaggttgggagttcaagagcagcctggccaacatggtgaaaccccatctctactaaaaatacaaaattagccggac

SEQ ID NO: 84649 - DNA, 1029 bp, Homo sapiens
ggcgtgagccaccgtgcccggccaaatattgttattttttttttaggagaaggattgtcgagttaaacaacttttaaaaaacattattttaagaattgtggtagaatatacataacataatttactgtcttcaccatttttttttccttttttagagacggagtcatactctgtcactcaggctggagtgcagtggcgcgatctcggctccctgcaacctccgcctcctgggttcaagcagttctcctgtctcagccccccgagtcgtagctgggattacaggcgtgcatcaccaagcccggttaatttttatatttttagtacagacggggtttcaccatgttggccaggctggttttgaactcctggcctcaagtgatccgcctgcctcagcctcccaaactgctgggattacaggcgtgagccactgtgcccagcccggtaatattcttttgaagaaagatatgatttaatgaccagatgttacttttttttgggatctcaaggctgggcagagtaacttagaaagttacggcacgtggggaacagacgtgcttgaggtcatcactcggggcctctctgggccttccctctgtgaccttagaaccctctggccagtcgacctccgtggagcctcctttccctgttggtgacctttctctggaggtcctcgaacctgggtagttcatacagagctgggagtcggtggttcgctgggtaacttcatgcaggacaagcacctcagttgacagatttaaagttcacaaacattttagtcgagagagagaatgatgatgcctgcgcaggggctaacattaatatttaccttaagaaaccgacggttattttaaaacgatgaagtatgttggtgcagggaagggaggagggtctagtgccgggccaccccactgtaaatccagggaggtgtttggtgaattcatggctgcaccctggaatcttgttcactgtaaatccaggaaggtgtgatgtgagttcatggctgcaccctggaatcttgttcactgtaaa

SEQ ID NO: 84650 - DNA, 1050 bp, Homo sapiens
aggctggtctcgaactcctggcctcaagtgatccgcccacctcggcctcctgcattgctgggattacaggtgtgagccaccacgccgagccctgaatatttttgatttggggttagtcgaatccgtggatgtagaacctgtgggtacagagggcccattgtccataactgtgtaaaatcagctcaatgcctgtgtagccccattatgtctgcccataatatttaggaaagtgagtcttttagcctcattcacatacagagtccatctcacatcagcacctgcgcgtccccgtcacgcttgtgacctcgaaggccctgaggatgattcctgtgacggtttttcagccactactgtacgtgggttactagtgctttgtcatctagaatggggttcgtaaccgagggggacgctgccggtgcatgatcatgacaagcctaagagtgagaggatgcttttcactgagtggggggcccgtgctgggccctgagtgctggcgtgtatcgtctctcctcatgcggcccctggaggacgcaccgtggggccgactggctttcccggttgtgctgctgatacgtggctgaaccaggatctgtgctctggccctgaagctgtgaactgcgtgataaccagccaaggctgccacagaaggctgcaacctccccgtgccagggactgcagtggagacaccttctaggcattgcctcatttcattctcccaaggactctgtgacgttggcgtgatcacccccattttccaggtgaggacactgaggcccagcgatgcggagatgtgctggccgagcccgtcagcggtacagtcgcccgctgcggggggtcgtccctccagagccgattctttttccctgtgaggcgccgaggctaacggggagcgtggttttgggacttttgggaagcaaatgtcaccgctgtcttttggtgggaacttctcagccagggcgttagtgggcatgataactcaagctcaggtcttgagcacacccactacggactcttgcaagagggagagttgaggaaaatggttctaaaacc

SEQ ID NO: 84651 - DNA, 1018 bp, Homo sapiens
ccaggcacagtgtctcatgcctgtaatcccagcacttcgggaggccgaggcgggtggatcacctgaggtcaggagttcgagaccagcctggccaagatggtgaaaccccatctctactaaaaaaaataaaaaattagcagggtgtggtggcgcatgcctgtaatcccagctactcgggaggctgaggcaggagaatcgcttgaacccgggaggcggaggttgcagtgagctgagaacatagcactgcactccagcctgggtgacagagcgagactctgtctcaggaaaaaaaaaaaaaaaaaaaagaaagagatgagcatgctggaaaagagggaaataccacaggcccatctttcccgtgtgagtttacatatcccagcctctagaaaagaccactctccccgtcgcgggggctcattcctgacagcagagttgttttcctgtggaagggctggggtcaggcccgggacgcggggcagacctcctatgtggaaagcctcgagtggctgtaacccagggctgaaaaaacaaacatgttacctcactggacaacagctcagagctcttaagagggggaataccagcgctgaaatatgtgcaatgtaaagaaaggaatttacagaaggtcaggtgcttcaatctgggagtctaggccgatgcggcccctaactggtagagagccattccattccatccagatggcttggcagccacagtactttttcctgttgggccatcagggaaggagaggaggctcgtgatcctggggcccgtccgggcagttagcccccttcccgagtggtgttgagggacagctgcgacctgagcacctggcactcggccctggggcctggggtcgtgggaatcagccctgttgctctgaggaagtcactggaacctgagcagggaggtcgaatatgcctgagtaggagaaaaacaaaaagttggtgcaggacagccccggacacgtgcttgccctgagcctggagaatttggaagggaggctgccgggtcagac

SEQ ID NO: 84652 - DNA, 1032 bp, Homo sapiens
ccgcgccctgctgcttccagtttttgaaggctttgctttagcgtagggttagccccagtcagcacgttagcattttcggaagatgagtaaccttgctcaccgtcatgtcttgttgggcagaggcaccggggaagggacaagctggcagccacctcctgcaagaaaagccttctggaaagaagaatgtgcaagtgaccttttcaaacgagggggagggtagtccagtggattaagacagagagatattccagatataaatagccgtgtgggaaggaaggggaaagttgagacggagagggttcatttgatcctgccgaggcgcctaagtataggatggagcgagaggatgcatgtttggaacctgatgagtgatgggggctgcccgtgctccgtggaaacattttcacgttctgtgaggaaaacagaggttcccttggcagagccccaggaacatacattctgggcgatgctgacgtggaggtgtgatttctgtgtgaagactgagaagctgactgcgggggtctgtttgcaaggtgagagctgcctctctcgggtctgggcttggactgagaaagagagtctgggttccagacatgccacaggacaggaaacaggtgctttttgtaccaaggaggtttgacctccttgacgggataggagacaggtgcttttgaccaaggaggccacactcaaaccaaagaaccttctgctgggccgggttgcagaaatgcttttttttttttttgagatggagtcttgctctgtcgcccaggctggagtgcagtggcttgatcttggctcactgcaacctacacctcccgtgttcaagcagttctcctgcctcagcctcccgagtagctgggactacaggcgtgcaccaccacgctcaggtaatttttgtatttttagtagagacggtgtttcgccatcttggccaggctggtcttgaactcctgacctcatgatccacccgctttggcctcccaaagtgctgggatggccgaagtgagcccctgcgcccggcccagaaat

SEQ ID NO: 84653 - DNA, 1073 bp, Homo sapiens
tgttcaacctgtgattgcctctgcttaggaaaattcacctgcagtgtctcaggaatgtatctattgctttgagaaaagtgtacaaatatgatgtcaaaagtcttctcacctactattacacacaactctcccccgttttcctgaatgttccttcttttcttcttttcttgagacagaatctcactttgttgcccaggctggagtgcagtggcgcgatctcggctcactgcagctccacctcccgggttcaagtgattctcctgcctcagcctcctgagtagctgggattacaggcacgcgccaccacgcctggctaatttttgtgttcttggtagaaacgaggtttcaccatgttggtcaggaaggtcttgaactcctgacctcaggtgatccacccgcctccacctggcaaagtgttgggattacaggtgtgagccactgcacccagctaatgttccttattttcttctttatgaggccactgagaaaatttataattcatttggttgcaggttcatgtaagcaagttgcttaagaaaagtcaaagggttgctatgggaatgttaattaaataaatagatagtagaaattatgaaaggcaaacttttcaaagattcagtgagccctaagggaggacttgatttaagaagggaaggggaattaatgtcagtttagaagtgagaatatgatctgaattagtcataaatgcagatgaaatgtacatcctgtaggttaggacaaaactgttaagatgcttacctcattttaccttgccctcctgaagagattccttacagctgtatatcctagtgagaccctggaaatcctctgaatgttaacaatcatggaagggttaagtaaattacaatacttactgtcttgttgaacagctatttctttttcttttttttttttcttgagacggagtctcactctgtcgcccaggctggagtgcaatggcatgatctcggctcactgcaacctctgcctcccgggttcaagcgattctcccgcctcagcctcccaagtggcaggcacgcgccaccacacccggctaatttttgtatttttag

SEQ ID NO: 84654 - DNA, 1055 bp, Homo sapiens
tactcccagctactcgggaggctgaggcaggagaatcgcttgaacccgagaggtggagttggcagtgagctgagatcgggccacggcactccagcctgggtgacagagcaagactccgtcttggaaaaaaaaaattaaataaaaaaaattgccccataagagattataactgcgaagaaagacctagaagaatgaaacaacaaatacagtgccttaaagtcccgggatattactgatacttactgagctctgtatttctatctgccaatgacgctccagactgctgctgatcgacgaagcctgggaaagatttaagttactattaagttaccctttcagtcacccttgtaacttaaagatgatcaggcactcttcttgagagaaattacgcacaaagcaatcattttgtggtttcccaaagctattaggtgtgtcttccgctgaccctgtttgcttaactctgggcggtgtagaggttgaaagactgctgtttcgcgtgggaaatggagggtgctcatctctggagctgtagaaacgccacctctagcgtggacctgcctcccgtcccagctctggaatgctgcgggatgggtttgctcagacatgtaggcattgctggtttggtactcatctcccagttagcagctcaggcctgcctctgagtagccgtccacagctcttgctgatcgatttgtcttctgacacgggttggaatgtgagctagagcacagaggcaagccctggaagttagggtcactgatttgattctacctttttttttttttttttgagacgcagtctcgctctgtcgcccaggctggagtgcagtggagcgatctgggctcaccgcaatctccgcctcccgggttcctgccattctcctgcctcagcctcccgagtagctgggactacaggggcccgtcaccacccctggctaattttttgtattattagtagagacggggtttcaccgtgttagccatgatggtctcgatctcctgacctcgtgatccacccgcgtcagcctcccaaagtgctgggattacaggcgtgag

SEQ ID NO: 84655 - DNA, 1059 bp, Homo sapiens
aaattaggattttctgccttcttcataagaagcccggaccagccaggacaggctcccactggtgactgtgtttctaggacttgggccagtcttttagtaataaaggacaacagtccagttaggagcaggccgggtgtgatggctcacacctgtaattcagcactttgggaggccaaggtggggggatcacttgagcctaggagtttgagaccagcctgggcaacatggtgaaacattgtctttgcaaaaaataacaattagctggtcacagtggtgggtacctgtggtcccagctactcgggaggctgaggcaggaggattgcttaaacccaggaggtggaggctgcagtgagccatgtttgtgtcactacactccagccaggacaacacagcaagaccctgtattaaataaataaataaataaataaataaataaaaataaagtaataagagcaatgttccttgagaggctttttcttgttccatcatttgtaatatattttttaatctctttgttttttctctgcataataaggcagtctaatacatggctaaaaatatagagtcttttgtccttctgcttgagttcacgcccccgctctgccgtttattagctgtgtgtccttgtgcaaggcgctgtacatctctgtaccacacgttccttttccatttgtgataacagcacctgccttattgtgtaaaggctacgcgagataatatacacgtgcctggcatgtggtgagtgctcaataaatgctattattgtgtttagataaatgatcattaagtttagtcattcatttcatagcttgagccttgggaatctatcacattactgaactgtaaaacggttatgaggtatatccatatatctatatatatatatctatatacttttttgagatggagtctcgctctgtcacccaggctggagtgcagtggtgcgatctcggctcactgcaagctccgcctcccgggttcacgccatgctcctgcctcagcctcctgagtagctgggactacaggcgcccaccaccacgcctggctaattttttttgt

SEQ ID NO: 84656 - DNA, 1048 bp, Homo sapiens
ccagacctggtggcgcatgcctctagtcccagctactagggaggctgaggcaggagaatcgcttgaacctgggaggcggaggttgcggtgagccgagatcgcaccattgcaccccagtctgggcaacaagagcgaaactctgtctcaaaaaaaaaaaaaaaggaattattttcccccttgaaaccaaagagatgtggaacaaatgccttttctgtaactgagtttttgtctcatttgaagttagggtgcttagaagcccgtgagctaatgatgctaatttccccatcagaacaagtgaagagccggagttctcccagctgagggcactggatgggtgaacacgtcttgtggatggactctatccgtgtcatttcgccaatgataaaaataactctagagaagggaattttgttttacactgaagggaaaccagagttccagattgctaattttttttaaattctcattaacatttgttctttaagcccatgcgtatacttcttcccattgggataacaaagggtatggttctaattagttattggctggcatttctctaaagaaaattgaaaaattatggtggggaaagaaaatgctgtgtggtatttctttttttcttttattaatttctcctttatatagttaaaaaaaacctggggatgaccgtatatgttaagcctgcattttgcctggttcctctcaccttgacaggaactgtgagaaaacaccaaaaaaaaaaaggacaaaaatgtaaaaaaacattctttatacaaaattgtcctgtttctgcctgttgtcatggtaggtacaaaagtaattgaagcttaatttttttggcttccaaaacacatattatttcagcttccaaaacacacattattatatagctgtgcataaattgtaattagatggtaatagaactttgagagcatttataacaatttcatcagcaaatctataatcctgaagttaaggcagttagacttgttttaataagtaggttggtagatgattttcacatttctagagagaaggaatgtgatcgata

SEQ ID NO: 84657 - DNA, 1259 bp, Homo sapiens
ggaggatttggggaaatggatactttgctgtcaacttctcgtgtctcccagtttgctgccgagttgagtttgggtttctgagtgtgtcccttgggtgaggatgtctgtctctgtgataataaagcacatccaggacattttgtaatgaatggagtcagaaaaagttttggagcgctgttgcttcgtgagtgtatatgatgcaacgtgtgaatccagcccctttccctttttgaggaaagcctgtttctggagtggacagaagggctattctgggggcgtttagtttcctctggggagcatggcgaggcgtgccacgtgttccttttatatgtgcagaatcttgttgagaagcatgatttagatttactgggagcaaaaggcttacactgtgaccccaaatgtcttgagtaaatcatccatcccgaagcagtgggaggtagagattcgagatttaaagtatgaaatacagttgatccgatgcagtttgtaaatttcatattgggaaaacataggttcactaaccactcagaggcaagagttggcatttttactgctttttaggttattttgcccattttgattgacatgcttgatatagtatgaatatgcatggccagtactttttgattcaaaatacgagaatcctttgttttccttggtggtggtttttgtgatacgttcgtggagaaataatgttcagaaagggatttgccaaaaaacattttcattgttacggcaagtttctgttgtagactaaagtctacttaaaataatgtccttatccggcaatacaaatgatttctagcttttgaaaacatagaattatggtaaaatgttacaggcttaacagcctattgttgtgttttttactgaagaggaaatacattttttggatagtaaaaatatggagcaaacagatgttttgcaaatgcttagagctttttccgaaaaaggagaatatttgataggacatgggccatggctggctctctataccctggacaggctctttgcatgacaaaaagtattctgcggccctagcctggacctgctgattcctccatgatgagaacctggatgacacagggcagactctcatttgaaaataccgttgagagtgctggacgtgcccaaaccctggtgcgttagcatcttaaacattttattttttggcccagagtttttctgactcacatcctatactttattctctaaaaccagtccagttttcaaggaggtagtttctttccttggtcgtg

SEQ ID NO: 84658 - DNA, 1041 bp, Homo sapiens
gttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcagccctgtggtgtggatgtttgtgttcgcggtgg

SEQ ID NO: 84659 - DNA, 1037 bp, Homo sapiens
caccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccagatgtccgcagccgaggtgaggtgtgctttgctctccacttctgagggtctcagtaacgtgggtccaaacacggtagccaggttgtgaagtgacattttgttgatgggctccttctcggcaaccctaagaaggagaagatggggaggaaagaagcccttcctcagcagccactcggagctccaggacccttggccttcgctgtgggaactcctgaaggactcctggaaggggtcacctcgtctctgtctcctaggagtggggacctcccccgggggaaggggactcatccaggagagcagggccccagccatgtgccagtgttctgtgctaacatctccagctgctgggtccccctgaactgatggtgaactgccagagccagggagcccacagatgccaactccagctcccttgcctgagagcagatactgttctgaaaactccctggaacaactcacactcgccgcagtcctttgaggtaaatatgattatcgtcacccccatcgtgtagatgaagaaaccgaagtacagaggggttaagtgacttgcccaaggtcacacagccagcaactggtagagctgggatttgaaccccggtagctgcctccaggacctaccgctctgttgctttctcatgtgctaagtggcccaaaagaagagttaaggtgggtggggcaggggagaaaggcaggcagggcctggagcccagcaggagtcactagctagacccggggctctgccagctgtgctggggcaggagcagccctacttccagatgagcccggggactgtccccccgtgcctgtccggaaaggtcggcctcgtgggacccagggcttcct

SEQ ID NO: 84660 - DNA, 1026 bp, Homo sapiens
actagacatagggaaactgagtccccacaccaggcggagacttgcttgggttagtagcagacctgtccttagagccctcaacttccagatcctaaattcagacccttcttgccttcccaccaccctttctagtcaggtccaaccaagagtggctaaagttggttgtacttgtagcaaagttcagaggtcctcaggcttgcgtggggaggtggtccctgggcgtcccttaaacccacctgcacgccaggaccggggagccccctcagactgctctgcggaacaattcttccctgagctcagccccagctcagggccaggccccccgctgcagctcagccacgccaggctcgggagagccagtggagacctggacgcgcccggggctggtgtcttgtttttcccatcatgaaacatttttcctctggtttggccaggactagagccccaaccaattccgaaagcatttggcaagccttgtggggaggagtgggaagggaaaattcattcggcttccaccctgggaactgggcacagtctgttcccacatctgggcccctggctggaccgtgtgcgcgcgtgtggtgaggggctggccccgctgcacagctgcctgttggcatcacagtgtttgtttgcctgtttccaaagcaggcgcagccacagctcctgcctggagggtgggaatgatggtattgagggtgagaggcgctgcttagggtgggtgggtctcagcccagaaacattttttgagactgaaggagaaccagaggccctctgatatgtttgctgaccctgggcctgcctggacaccagccctgatggcagctcctgctgttaccccagggaagcatcgcagagcatctggcctgttgagtaagagaagcaggagaggatccagagggaggacaatcctgggtcccacgaggcagacggagaggcataggaggcagccctgggtcccatgaggcagacccttccggagaggcacaagaggaagccctgggtcccacgaggccgacctttccg

SEQ ID NO: 84661 - DNA, 1123 bp, Homo sapiens
tgtggctaaggttaagccagtagggacatatcctgccagcggtggattctctttctccaccccttctgctgctggagcgtgggtgcaagcagccttccgtgggggctgaagctccagtctgccccaggagcagagaaggctgaagggattccttggggctgggtttggcccaggtgggtggaggcggaaggcctgctggccggggccctccgcagaggtgacgggacggtgtgtggtcccgctggaaggctcagcacaacccatctcgagtgccctatggcttaagccagcctcctccttggttctgggatgctggcttctggccactcacctcagggcagtcttccctggatgctcgagcttccaagcaagaggccaacgtccaaataggaagcagaaggggctgcccatggggacatcaggggcaagaggcaggcgagaaagggcccagtgtctgcaccaggtcccagcaggccacacctcaccctcggacccctcagccacaggccccagtgcactgggaaggtcagccagcaaaggaagccacagatatttctcctgctggttacttctccgggcagggagtcctggctcagtctggcccagcccagtcctaggagccctcagggcctcaccgatgccctccatgaaggctgggtagagtcggtccgtgaggagcggctcgggcagttcccggaagtacagcttgagcgtcccggcgatggcgttgatgtccatgtcactcagcatcagcaggatgtccttgttatctgcaggggtggggccgaggtcaggcagccttagctgggccagcagccccgttccacccccgacccatcctgacacagcccccacccactccagctctggttctggtctcccctggaagagcaggatgtagagagggcccacaggtgtctgtgactcggctctgtgggtcggggttgggggaacagggagagatagcctgggggccatctgctgtggctgcttgggaaagggtgtttggggagtgaaatccatcacccagagttcagagccacattcataccatgtggcctgcagcttccttccgactggaacctctccatcgctaagcccctctctggaaggcattgcacac

SEQ ID NO: 84662 - DNA, 1035 bp, Homo sapiens
gcccctgcccccgccccagctctccatcccaaatgctagaagctctccagggtgtgtgtgtgctgggtgggggttgctacgggagagctgtcgtgggggctgccctccacccatcctcacgctccaccccaggcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccagtgagtctgggaggcccagccggggcaggtgtggctgtgtctgagcaggctggtgggatggacaggagagctcgggggaaccaggagcctccctggagaggaggcttgctctgcttcagagtccccgtggcaagtgctttctcttgtaatcccctcccctccaatctcttgtcccttgctgcaggtaagcaactgcagaaactcacaagggccgactcacttgcccaggatgacccaacttgtaggttttggttctggacttaaaactcagatctgactccagtgtctttcttgctagttcctgggtgcctggtgagccgcagggaaagagctttgagcctgcacctgctgtctccagggccccaggtcccctctggggcagtgctgcctctgcgtgaagcccaccatggtgaggcctgacctttctggtttctcctccctgctcctgctggttcaggtgcagcagccacataccccactgtcaagaaacctgcactggccaggcagggatgaatccgtggggagcctggagtggaggacggggtggggcctgggaactggccggcgttggtgcctctgtgcagcctagaagctgaggctttgtcggaacatgcttttacgtgtgaaaagtgtgcaatgccttccagagaggggcttagcgatggagaggttccagtcggaaggaagctgcaggccacatggtatgaatgtggctctgaactctgggtgatggatttcactccccaaacaccctttcccaagc

SEQ ID NO: 84663 - DNA, 1071 bp, Homo sapiens
ttgacccaagttttctccctgaatcttcccagcaatcccagggaggcaggttctgttgcagatggaataactgaggcttagtgagtttaaaacttgccaggattcaaacccaggcagcctcctgtgcgcgggctcctgactcttcaacacctccacgtggatgggctggttccctcctgatggacttgagcgcctcctaatcaggtgcttaccttttgtgagcctcagtttctgcatctgtgaaatggggtaataatacccatgtcccgggctggcagccaggagtgcctaacagggtgtgccctgcctcccccacggtgggtaacagagtgtgccctgcctcccccacggcgggtaacagggtgtgccctgcctcccccacggcgggtaacagggtgtgccctgcctcccccacggcggccacaggggcctgggggctagggtccccccaaagggttgatttccaggtaaacatcagcttatcccagctgctcacttccgccttcctgactgtgtagctggctctgagcagtgctgacccacggggagatctctggcttggcctccgagctggcacctctctcacccacattctctctctgcagctggacccacaaaccgtggagaccaagaactggcacacggacgtgattgagatgaacggggtgagccggggatgggaatgatcagtggcgtgagccgggaggtggaacgtctgtgcagcaggtgggcagcccggccctgtggctgctcctggggccgctgtgccgcctcgacctccccgcagcccagccccctctcccctcctgcccacaccctgcccgctgctgtcctgcaggtgttgtgttgagggagacctgggtgtgagctagccctcatttgcagtcttggggaggggacccctgtgttttgggggcattcctcgggcactcacaccctggggaatctttacctgcctcaccccccaaccagatcaaagtggaattttccatgaaattcaccagccgagatatgagcctgaagaggaccccgtccaaaaagcagaccggcgtcttcggtgtgaagatcagc

SEQ ID NO: 84664 - DNA, 1030 bp, Homo sapiens
gtggccccggccctgggctgctctgtgtgacgagcgattccatcccctaacgtgtgctgtgtgccacagtgtgtccgtgtcgtggacgcaggggtcagcgctgtggcggacggagggacgtctgccacagtgtgtccgtgtcgtggacgcaggggtcagcgctgtggtggacggagggacgtctgccacagtgtgtccgtgtcgtggacacgggtcagcgctgtggtggacggagggacgtctgccctgtgcttcccacctcactgtgcgcaggccagcgggtgagcagcagagtcaaagggccaggcctcttgctttctatcctcagccacattaacctggcattttcctgcaggagcttcacagttgggccgaggggctgggactaggcagtttcgtttcggtggggtaagggaagggtgcctggtactgcccagactggcaggagggattgcctcattaactcctcgttaactttgccctgagtgatgctgtgggtgcgagaaacaccggtggccctcctgcttccactgacctgaaggttcattaaaggctggaggcggggcgtgactcatccagggctgggattaaacaatctgttcagatggaaaggtctcatgatcagaactgagcctttaaatagtgcagggcctctggtttctgggggagaggaggcagggacactcacggaggatcctttgggtaccagcgggggtccctgtggttgggctgttcttgtcaccggaggagagttcaggggccaaagcctcattccagcccctgacttggcagtcagctttttgtgcgagtgtttagctgggagacacgtggcatctgggtttgtgggttcagccagggctctcggtattgaacttcgcgtttctacttttctttccttttccctgtttgtttttttttttttttgcctcaaatcacactcaagtagaccaggcccggtgccttcctctccctcccatccttccctcttctagattcttggttgagctttggatgggaaggggctgaattc

SEQ ID NO: 84665 - DNA, 1161 bp, Homo sapiens
cgagcgcggggaaagccggcgggactagggaactagcgggactggcagccgggactgagcgctccacaggcgccttctctccagcgccgcgtcccgtcccccccggcatgaccgacgtcctgccccagcccgactgcagcccgaaggcggggcgcgaacccctggcgctggaggagtcggggagcaagcgcccccccaacaccggcgcccggctctggggccgcgtgcgcaacaagctgctccgaaacaaggtgcccgcgggggctggaggttccggggggtgggggctcgggggcgctgcggggctcggggggctgcgggggctgcgggggctgatggggtcccgctcccgccccctccgtggagtcccgggacagagctggggtctgtgcgcgtccctctaagtggcttgaacttgatggcgaacgctggggccgcccccacccggaccctggcgctcgggcatctgcccctgcctcgggagaagggaggtttcttctcggcaggtggaccctgctttccactccgggagtgcaaacagcgcacggggagacgcctgcctctgggtctatgtcttgccgccctgttcagcctctacctgatccctgcatccagcgggccttgctggctgcccctttgctgaggggcgccgaccgcagcaccgtctgccgtgtgaggtttctctgtgcaggattgtggggaggggagatgctgccgggtctgggggctcgaggcttcccttcagggaccacccatctgactgtgggcccagtgcccgccgggcaccaggcgttccgtccatgtgccagggcagaccgccggtgcccctgcagccccagacctgagttgggattaaaatctgagatagaagccgactgtcctgcagctgggcaggctgcctcggggctggcttggggccctggcatcaggcacgtgaggaagagccagacccagcgcccagcgcacaggaagtgctcgataactctgcagatcaaatcaactgtccgagttagctgtctcagagtgccagtccggctggccagggctgggcccatccatcaagagagcaacaagggaggccttggccagtccgtggtggggatctgcagctcctcctgaggctcacaggacctctctgcaggctcttactgccagccggca

SEQ ID NO: 84666 - DNA, 1051 bp, Homo sapiens
ctgggctcaagccatcctcccacctcagcctcccaaagtgctgagattacaggcgtgagctgctgcgcccggcctggttgcgctttttatctacctgttatccacacgggaatctgtgagtcagttagacagctaatagtttctacccatttgccagaggaggtaaccgagtcacagagaggagaaaagacttaacatcacagaggatcagaaaccctgactctctccctctccacctgcccctcccactccctgctcttcactggcaggtggggtctgccctcacccctccctgcagcgccccacacagaggtgactccccgggccgttagagcagcctttcccaggaagcctccctgagttcctgggggcaaactggcctcccttctttgtcccttctttgtgcccacatcccctcaggttccttgtgcccccatcccctcaggttccttgtgcccccatcccctgaggttccttgtgcccccatcccctcaggttccttgtgcccccatcccctgaggttccttgtgcccacatcccctgaggttccttgtgcccccatcccctcaggttccttgtgcccccatcccctcaggttctttgtgcccccgtcccctcaggttctttgtgcccccatcccctgaggttccttgtatccccatccctttgaggttccttgtgcccccatcccctgaggttccttgtgcccccatcctgctcagggcaagctggttatggcacctgtcatgctgttttgtcacttaacaatttgcgtctcccactgtgagttctctgagggcgggaaccaggtctcctttaccctgggatgcatgggagctcagaaatgtggaatgaagtcgttaatttacacagcacctaccgtgcacctggagaaggtgagaacatggctggcgtgtggacgtactcacatgtgcaaagcctgtggcgtgttcagagcctctcagtctcacggtccgctctgagcctccggcatcccgccgaggtcacggaaaccatccctgttttacacacgaggacgccgaggctcgga

SEQ ID NO: 84667 - DNA, 1050 bp, Homo sapiens
cgggagtctgggggggttttgagcagtggggagctgtgatcagggctgggaactgaccggagtgggtgtattctagctgcctgtgtgctgggaaagggtccactttgtgaacggggtcctgaaggcaagctttcctcgacataaatcattagcagaatgatttatcatattggtcagttttcagtgccaggataggcaggatttggagggagagacagtacccatggggaatggtactaagtccctgggccaggatggtgggtgtgctggacccccccaggctgagtggaggagagaaggaccccctagccctaccccgggcagctcacatataaggccgccgtggccttcggaaactttttcatctggccaccaggtggtgatgttggaccaagactcagctgagtctcataccccgtctgcctcccgccggcctggggtggaggctgaggggatccgctgaccaccctctgccctgggggcttttctctcttgcagacgatgagtctccaggactctatggcttccttcatgtcatcgtccactctgccaagggatttaagcaatcagccagtaagtgccctggccaggacgaggttgggtgggccattgtggattctgcactgctctgcccaggatggggccctgccagcacgcctttagacatggggcattcccctggaggccagaaaccagctcctcttggcagggaggtcacccctggcctttgtctccaaagtcctctttctcaagccctccctgaagctgtctgaaacctaggggccgggcgcggtggctcacccctgtaatcccagcactttgggaggcccaggcgggcggatcacgaggtcaggagttcgagaccatccgggccaacatggtgaaaccccgtctctactaaaaatactaaaattagcgtgggcatggcggtggacgcctgtagtcccagctacttgggaggctgaggccagagaatcccttgaacccgggaggcggaggttgctgtgagctgagatcatggcattgcactccaccctgggcgacagagcg

SEQ ID NO: 84668 - DNA, 1178 bp, Homo sapiens
ggagtgcaatggcgcaatctcagctcactgcaacctctgcctcctggattcaagagattcccctgcctcagcctcccaagtagttgggattataggcgcctgccaccacacctggctaatttttgtatttttagtagagatggggtttcaccatgttggccaggctgttcttgaactcctgacctcaaatgatccacccgcttcggcctcccaaagtgctgggattacaggcgtgagccaccctgcccggcccctcgtctctatatttttaaaaaaattaaaataaatacataaataaaacataaagcagtggttttcaaccattattatacattcaaatcagtaaagaagctttatagaaatgctgatggcccttgtggtcttgcagagatttgggttgagttgacggggctggggagcagcatctgtatcttttaaccgctcccccagtgattccgacaggcagccaagctcggactgcgggtaaggctggtggccctgctgaggctgcattttcttcacagccagcagattgctccctgaagtgtctgcttagccgcgcacggggtatttatatctcaggctttggagaactatcaggtttggggcccggctagggcgtgcgtgttcacgctgggacctgtcacaacctggtcttatgggacacccagtctgggatccttcttcccagatgaccaacctgcctctgtcactgcccctgcggcaggaggcccaaggtcatgaccccagggacagagcatccaggtgcaggactgaagctgagcctcctgttgggagggtgggcgcagccgcgtacaggaagggtgttgggaagtgttgatccaccagctgccacctccacctgtccctgctgaatcccagccatcctcacttggtgtccgggttgtggagggtgtggctcttgggggcctgggctggccttgcctgcgtcctcccagcctctttggggctctcatatgtgaggcctaacctgagttgcttcaggaaacctttgcccctcaggctgccacgtgtttgagagcacagccttttttctttttttttgagatggagttttgctcttgttacccaggctggagtgcagtggcatgatcttggctcgctacaacttccgcctcccgggttcaagtgatttccctgcctcagcctcccaaata

SEQ ID NO: 84669 - DNA, 1060 bp, Homo sapiens
tggaggttgcagtgagctgcgatcacgccactgcactccagtctggtgacagagcgagaccctgtctggaaaaaaaaaagtatctattgagtcccttgcaggaataggaaaacacaggcccctctccacaatgaggacagagcccacgcctcttacccagtgtgcagagagaggatggctgaccatagtttcttctcccagacccatggagcagatgtgtcaccctctgcctgggaggacgaagtgcagggtggggaagtccctctccatggagtcaagtggctggagaggccaggtgcagtggctcacgcctgtaatcccagcactttgggaggccgaggcgggagattggcttgagcccaggagttcaagaccggcctgggaaacatggtgaaaccccgtctctattaaaaatacaaataaaaggggctggagaaatggtgctttccctgcggtttccagcccaacccaggaactacctggactcccctggtctgtgttcagatcagccctgccaaggccgcccaagatcccggggtcagacatggtgcagagagtgtggggtcttctcttggcctgggctgattgcctgttctctgtgcctaggcagaaacccccacacccaaccataagcccctcacagcctgcccaccctggagggcagagccaggcccctggctttctgccaggtggcttctcatcctgactcactcgatgacgtgcttgcttcctgctgaggctgccacttaattactgcaattaggctcctctctgcagcaggagtgatttcataccctagacttcactggagggggcgtgaggaaacattcccgaaatctgggagtccaggcaccagccagagacacaggctggggacgctgagtatcccccacccccccgccccccaaaatatacacacacccaagctccatctccaggagttttctctgtctagaaacagcttgagacagaagtaggaagttcctgctgtctgagcgcttcctcccctgcagaccaagcaggtggcatcacctcggcagctgaccttggcctcatcacc

SEQ ID NO: 84670 - DNA, 1105 bp, Homo sapiens
gtacctaaaaccatgtgcacacacggggcagacgagcctccacacagaagcctccgtcctggcctctggggtgcttgtgggggtcatcttctggggccctcctgcttcctggtgggctctgattacaggaaaagcctgggagcctgggccgaagtagggggtgaaggaaaaaagatgaagccaactgcattgaaattctggatctccttgacactgggaactgagcttgggaactgtgtcttgctacgctggggccacagggtgaggccactccccagagcccctcccaccgctggccacgactggccctcctggggtggactcctggccacgctgcatcgcaggctctttatctataaaacaggtgaatgaggccttcctccctgggctccagtgacgagtgactcgggtggcatggcagcaagcatgccaggccttctggggcaggaggtggaggaagtgggtacatttctttcccttatttcgaaaggccggtcgctgggggacagagctgacaaacggctatgtgaagtcccactggcaagtgagaaccggcccaggcccgtcttcctgagaagcagctggtatgggagccagggttgaagtcactcacgggtcctctccgagaactcgagtggtgaaatggagagccggggcctgcccttgtccctgcagcaggactggggaggagggggtgcctgagtggtgtgctagcgctttggcagaatggctgtgccgtgccgaagctcagtgtgggtcaccttgcctttcagtccaccctcctgcccctgagcccatacgcaggacttcaccagagacaaataacggcctcgagggtcctggccagccaagggcacacacccagccctgtcccctccccgcgagtgaaatcaggagtaacagccaaggtccccatcgtgtcatgagaaccatctgatgccccaagcgcaggccccgtccttgtgactggctgtgggtgagcgtccatttcttccccttttgcagacggggtgggaagttgaggaggaagcataaccattgtgttttgtcttcgtgtgggtggcagatgagcgcgtcgcggcttctgagaaatcccgtctccttg

SEQ ID NO: 84671 - DNA, 1090 bp, Homo sapiens
cccctcaagggctcaccccgcaatcccctgctctgtatttcagctctgcaacaggatggagcctctctccagggagggcagcttctctgctgccaatggaattgcatgagccccacctagagcccagagcttctgaagaattctggggggagtggggggctgtggcctgaactcgggccacaggtgtggttcatttagacggcaccatgttgttttaaaatgttaattatttgccatcgttttaaaatcaggagcattcctgttaataagccagattttagcttattttgaacagagatcaggcagccatgagcttgcgtttcctccagcagccatcggctggagtgagtggtggtttcaccctgccctacctggctcgcttcaccggctggcctcacccgcaggcctcacccgcaccctcatgggtgccgtttgcaacctttgctccatcgttgggttgtaaaagagcttttcccagggcctcctctggactcctcctcccatggaaggaggtgtatgtgcatctgggaactagggccagggggaccagaatgtggcctcactccctgcacagttgggggttctgcaaccattggagaagccaggggaagctggctgggagtgggcagggccggagatggtgcctgtcctgggttctgtgtgcactccccttgcaggatggctccctgcggtggggtggctgggggggctgcttggaggaggtgggggtgctggtctcagcagtgcctgtgagtaggtgggaggctgctcagaggaggtgggggtcctggtctctgcagcgcctgtgagtaggggggctggtctgtgagtgggggggctgctcagaggaggtgggggtgctggtgtcagtagcgtccgtgagtggggggactgctcggaggaggggggctgcttggaggagggggatcctggtccctgtgagtgggacgcccaccgctcctgtgcaggacagtggtggcgccgcgctcctgcctgggggcaggtcaggcctgtctgttgcaaagcctgactcctccagcggcggcgggacgcggctgtggcttctgggcgggccggggcctcccctccg

SEQ ID NO: 84672 - DNA, 1056 bp, Homo sapiens
aggagaagactctcgctcccatctctgccttcagctctcaaaccacagcagggctcagagccccgcccggggggactcagctctcaccccactgtgagcagctgcaggaagatgctgcggaatcccggtgtggggccagggtctttgccgctgcctgtccccgcgccacctccctctttgctccctgtccctgtgccctgtccttgtcgcgtgaccaccatgactggtttccgtgtccgtcgattttccgattcctttggtgctggcaggtgccttctctcgggagacagatcacgggcgtcacgcacagatgcccccgcctggcgctccggggcttcggggcagaacttgacttggtggctgtgcgtcttgcttggtggctcacgagggactcacttggcttgaggaccttgaaatccagagatgctagagtgactgccccctaaagtgcttgtggcccccagggttgatgtttacaccatcgactagaagccacgcaaggcaggagtagggagcacttgtccagcctggggatcgtccgggcaaaggtcccatccgcgcacctgccttccctcctcggggagcgtttctgccctttccgctgggtcaccggccccacctagtggactctgcagggattgctgtttacacggggtgcctggagggagctgacgcctcttcctgagtacttggggatgttttggttaaaaacactattaataaaagaccgaggtttctgcggcttggctgtgcttatttggccaaacaggtcccctcccctaccaggcttcctgctggggccttgggaacaggggggacttctggaccaaatcagacaattgttgtagatattcagatatctggcttctggcaccgccttatcgctgggccttccacgcccaaatatgcagccaacgggaagcccaaggttgagtctttgtgttagtcagtgttctctagagaaacaaaaccaacagggcgtgtgcgttatctgtatctatatctacatacgaagaaaagtattagaaggaattgattcaggtgattatggaggct

SEQ ID NO: 84673 - DNA, 1160 bp, Homo sapiens
ttccctccccacctgctttgccaacgctgccgcccctgtctctccccgtctactagccgtctgctccccaggcctcccagacccctccgtgcctctttcagctttcccctgttagcctgtctcctccagaggacccaggagaggaccaggctctcctcccctctgcacccaggccaggcagtggctgcatgcgtggcccgtgggctccaggtgttcagatgctgctcccgcaaagccagcctgggcctggtgctccctgtgggtgcaatgagctgcccgctccagccctcctctgttcactctggaagggaacaaactctgatggcatccacctctccttgttgacagagacaagagttctgctccagagagaagcattgtagaaggaatattaagtatgtgctctgagacaggccagggatagaaactgtggagggtttgcggtccttgtcattaacgtgttcctggcgacagggactgacgctgtctgagcgcagctcgtgtgtgcgtgtcggagacacatgaacgagcaaaacagaggttctgggggttgtttgcctggagctggtgggggagaagaatccaagccggtcctctgtggggggtgtgtgttgcaggaggcggtgggagtgccccatccttgcttggtcctgctcgtccgggtgtgttttgtagggggtctccgtcctgccttctgacgtccccagaggagcagtcgctgagatgccacgggctgcctcttcttcctccaggggctagtgcccccccaccccagctgaggccgcctgaaccctcccattcttgagaaccccctgctccttccagccccgccggccaccctccaccccccacagagctctcacccctcttcacacaccggggtggctgttatagcctttggcaacaagggccttggcaacgggcttcccacttgggggaagccacattgctgccatggcaacagaggccgaggccgagtttagcggcagtccaggcgtgcacctgtgggaagggctggcggggggcaggtgggaggcaagggggccggcgagggggttggtcagtgtgttgttgacctgccctaagacgggaggcgggttagagacaagcgtctcggacctgcgggggcagggtttttgccctggttctcctggaggcat

SEQ ID NO: 84674 - DNA, 1019 bp, Homo sapiens
ttggaaaatgtgaagccctgagctgctgacctgcacaccccgctcgctgcactggctcagcctcccctcccaaggtgggtgggctccgtgcctgggctctggagcccaagtggtgctggcagccctggggggttaatgcggctcaacttcccggtcgcctttccttccctcctcctttgaaggaagcccacactggggtgatagaaataagcaccggctccgaggagtctgctgtgagcccctgtccctgccaggcctgggcacagcctcctcgcccacgccctgctgccttgggctccgtcctccgtgcggggccttgttctgagggctgagggctcccctcccacactccagaacctgccctggacccctggagggagtgggctcagtacaaatggtacccaaggaggagggccacaggaagtgacatcgaccggccccccccacctccttattccctataaaaagcaaaatggtgactcagagaggagagttggaagcgtcctgcctcttgctcccactgttaatttttacacttggaattaggcagaaggcaaagaaaacagcagcttgaaatacgcggctgacatgctcttcatcgggtagcaacagcagagccgctcctccccgcctcccagcagccccggagcgggcagggcccggtgcctgctggctctcccccgcccctcaccaggcccaggcccccgcacagcccccgcccgggccaggcgtggatggtgcggccggggccatggctgccgggggccgccgccggcgcccactacgctaccagtccctggcagctctggtggaggattctcagtggcctttcttgttccttgtctcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagg

SEQ ID NO: 84675 - DNA, 1051 bp, Homo sapiens
cgggcgtcccaccttgggagatttccgtatcgctgaagttccctttgtggagcgtggcctctgtgaaaagtgttaataattcacggtagaataggttctcagatgcgccacgtctgtcctcccccacttcttcaacagagaatggcaacacctccattaacctgaatgtgagctcctcgggggtggccctggctgagtcatctgcgccgcctccctccccagagcctcgtacgcgctcggcgtctggctgtcgtgtgaactcagctccacagggcagacatttggtctgtttgctgctccgtcgtacccctggcacctggaacagtgcctgaaccatgagaagtgtttggtgagtgaatgaatgaatgaaaaatgaatgaacggacattcactgggattcagttctccttagagtcagagagacgtaggtgtcaatgctggttgcatgaagctgttacatctttgagcctgtttcctcatctgaatttggggtgtaattcctactgactgtacagttgcagagctgacatttcatgaactttgcttaaataatgtgtgagtgcctggcccataagaggctgtgttagtccttttgtgtgtgtgtgtgtgtgtgtgtgtggtttttttttgttattgttttttgtttttgagacagagtcttgctctgtcgcctaggctggagtgcagtggtgtaatctcagctcactgcagcctccacctcctgggttcaagcaattcttgaaccttgtaccagagaggagaggtacagcggccctagaccccagggctctgctcctattggtgtaagtgtttcctcctgcgccctacctccctgtctccaggcagggcctgctgtgggtccctctcctctcagccccaagggacctgttccctccagaaggcacctccccaagcggcggcagcgtcacgtgtgaggcctgcagttcagggccagcatccctcatccctcgccgagatcaggccctggaggggctcccacaggtctgactcaaaggcacaggtccctgggcctccctcctcagcatcgtgg

SEQ ID NO: 84676 - DNA, 1034 bp, Homo sapiens
gcatttctagcaagtcccaggtgaggcccgcgctgcccacactggatgggaaggaccaggcgcctgcagcatctgccctccaagccttcgtagctccctccttcctgcaggataaactctaaactccttagcacaacgtgggagccttctcagagactgggtccaacccatctccagccgcagcctcccctcctggccccactgccacacccccgggcctccggccacactgagcctctcccggtttcccaggatacaacactcgcccattcatagtgtggtgccttttgcacgtgctgttcctctgcttggggatgctgttggtctttctcagccaggtgaagaggacgctgaatgtcacctgcttgagtatcaggaccggggactgggcactggacctagactcttggccctggagagaagccctgcatggggccgcagcctgcccccgtccctgctcacagaaaagctcagccttgcagccgcgtggagtcagacgacttgcctgtcctgctttgaacgtgtggtgttcctaccacctttgagtaaaaatagagctgagaatgaccgaagtgaaactccaccttgggctctgggagagcagaggtgggaccacgctggggagggtgggtgcggacactccgggggcgggggctgaggccatctgcgtgggctctgggagagcggaggtggggaccgcgctggggagggtgggtgcggacactccggggggtgggagctgaggtcatctgcgtgggctctggggagggggccctgtgagccgggccaagctgccaggcactgggggtctacgccctggactcagagagaccatggcaccctcaaggctgctctcacttgaaaattttcgttttggggctggacatggtggcccacgcctgtaatcccagtactttgggaggctgaggcaggaggatcacctgaggtcatgagttcgagaccagcttgcctaacatggtgaaaccccgtctctactaaaatatacaaaaattagctgggcgtggtggtggatg

SEQ ID NO: 84677 - DNA, 1029 bp, Homo sapiens
tctgcctcactcttgcgagtaggatggaagacttgttctctgtctgaggtatgatctgctttctgggacaattccggtaccttccttcgtagagggagggcatgatggctctcgtgggtgttgtgtggattaattcatatttataaagtgctttgaaggtgaggagagctattgagcagctcagctgtccagctcattgcgctcctcatccgggaaagcctcgagggactgggagaggccggcacaggacttaggaaggggcagggaatgtggcaggaggaccggcaggaacagggtatcagaccagctctgaggcagcgcctcccacagcggctcccgcacaggccctccataggtgttggttgtctgagtacgggtgggaaaaagaaaactcgagttcttggctccttgagctcctccccgcagcagaaacccctgttagctgaaacctgtcagctggcccgtccatgcgtttccggctgtgtggatttggtcattgtactcgctcgtagtggagtcagagacccccaaagggagtctcgcgcttttgccagggtttatgattggaggacttcactgccagcgttggcggcagctgtttggctgagcttgagccctttgggcgcaaacctagggcaggcggcttcaagacaaccctgcgcccactgcccctgccaggcccttggtggtggcgggtgttggtgatgtgtggggggtgggctgaggtgatgtgttgagtggactgaggtgatgtgttgggtgggctgaggtgatggggggggtggactgaggtgatgtgttgggtgggctgaggtgatgtgttgggtgggctgaggtgatgtgttgggtgggctgaggtgatgtgttgagtggactgaggtgatgtgttgcgttgactgaggtgatgtgttgggtggactgaggtgatgtgtggggggtggactgaggtgatgtgtggggggtggactgaggtgatgtgttgggtgggctgagatgatggggggggtggactgaggtgatgtgttgggt

SEQ ID NO: 84678 - DNA, 1081 bp, Homo sapiens
cgtctttgcccaggctggagtgcagtggtgcgatcttggctcactgcaacctccacctcctggattcaagcagttcccctgcctcagcctcctgagtagctgggattatgggcgcctgccaccacaacccagctaagttttgtatttttagtagagatggggtttcaccatattggtcaggctggtctcgaactcctgacctcaggtgatcttcccaccttggcctcccaaagtgctgggattactggcgtgagccactgcgcccggcctgtgctaggcactttctatccattctctccaaatctcacaactctgcaactcttacagagtaggaaagtgaggctcagttagcataaatcatagacctaagatcacataagtaacaaatggctgagctggaattcaggttgtaccctagaataatgaggaggatcccgagtaccacctgggtatgtctgagtttattcaaggtcttgggatgtcacggaatgggggacgccattctctatggtcctctgttgcagagttctccctgaaacggtccagcagggtaaatggcttcaatggctctgaccccaacctggccctgtgcctcttgcaggacctgggggctgggcctggagcccaggcagggacagctgaggctgtctgaacccactgaggctggtggctctctgctcctaaggtgccagcctgccagccagcccctcccctcacacacttcttttttttttttgacacggagtctcgctctttcacccaggctggagctggagtgcagtggcactatctcagctcgctgcaagctccacctcccaggttcacgccattctcctgcctcagcctcccgagtagctgggactgcaggcgcccgccaccacgcccggctaattttttgtgtttttagtagagacggggtttcaccgtgttggccaggatggtctcgatctcctgacctcgtgatccacccgcctcggcctcccaaagtgctgggattacaggcgtgagccaccgcgcccggccctgaacacacttcctgcctttggggttggcagttcattctttctggttttgacaggag

SEQ ID NO: 84679 - DNA, 1098 bp, Homo sapiens
ggggggggtggggggagtagagaagggtgatgccttgagccccaaagccttactctggaggctgtgtggtacccaacattcaacctctgacctcagcatccccttgggtccaggtcattccctgtatcttcttctccacccgcctcctcctccatccatgttccttcctctcctccccccaggagctgtccttgtgatggttcattctgctttggtttctcaacatcaaaggggcaaagccggatcccctgggcataggtcctgtgccaggtgccgccgctccatctgctccttcccctgcagaggccagcgtcgttgggtgaaggtcagggcccatggctgtgtggcatgtgcgtgcacgtgcgtctgcatgaatgggggcacacatctgttcggagcgcagatgcagatcagctcctgacccggaggcaggattagtggccctctcttagctgtgtgcttgcaaacagccgtcataacaatgcctcagattcacgcgtgcttatgttcctgagtgtttctggctctttgcaaaacccagttcttgtttccctatttcccgaagcctggaatcgtatggaaccctgtctctagctttctctgcagcagaagactcctctgagctgatcatttccaagtcttccataccccaccctcttcctcccacgcctggagcaaaaaagcaaaattgcctgaggccaccttgaaaattcctgaccagaggaatgccagaaaagggaattaggccaaggcctcttagggggttctgttgggcagccctgattcaggcagattggcacctgagctgtctaccctcctgctgctgccctggcctctgggcggctcctggggtggcctggatggtgggtgggagggggcactgatgtggccgcagtgtgaggagtccctgcctccctcttcggaacagcttagtggagagctgtagcaggaggcttcccggggaggtgctgtgcagtcatgtttgggctgttagccatcaactttcctcttgacaagagcctaaattaaaacaaatacccgagctgtcatttgcctggcagcaaggttttgtggctcccagaggaagttcctctgctt

SEQ ID NO: 84680 - DNA, 1029 bp, Homo sapiens
ccggggctccctgcctggcccccgcatgggaacatatttttgtcatcagcggtgacctctgggtgatcaaggaagcagagactcctggggccttcctgtcgtgtgcagtggagctgagctgctaacatgagaagggaggaaatgtggagatacccagttttggttctagggcccgtccccttttttctgtcctggccaagaaccaaggcttctaccttgattggtagaagcaagagttggtcgttggagaggccgtgagtagcacgtgcttgggaattaggagcagggcaaatagccttgaaaatgggatgtaccttcttcccactcagcccctcgtcattaacccagtgctcctggcggtgcacccaaccatgaaatcccctttaagtccagtgatgaggcaggagcaggcaggtcaccctggggttggagagccgcagacagtctgagtgcacaggctggagggagggctgggagggtggagagcactggccccagggactgtctggggaatgcttagaaggggcctggaggaggcagcgtgatagatgggggttcagtgccttggggagcactggctggtccccacccggtccacatttagctgaatcaggaaggtctgtctgccacagctccccgctcctctgacagattggggttgatcgctggggttagagcacttcagggtagcatcacctttggcaaagcccggaggagaaggactctttaactccttccttcccagcgcgtgacgttggatctccccaactcctcagtgccagggatgcggaggtttctgttcccacccaaatcactgtggtgctcaaaggctcacacacttgtctctgtggccaaggttagcatctggccgtggtgttaacatctactggaagccatccaacaaaggcatcaagggaatctcgaagtgactgccctttcctgagacacgttgtctgagacagacgtctggagatggaagagggttgacagggtttcccagagggtggtctctaaccccatggacccgca

SEQ ID NO: 84681 - DNA, 1053 bp, Homo sapiens
aaggagattggagccactgaactgaatctctgggttttggagacttagagaatccattggactcttctgctggcgtctttctgaatgctgatggggacttggtggtaagtaaatgagtagggggctccaggccctgctgtcgagccctcggacggaccctttgggaaaactctgctgttgacctgtgggtggtgtcatctgagccatgtcaggtgagggccacgtgagctggggcttggcgagagaccctcctaaaacggtggctcggggagtgcataatctaagccagcggctctgcccaggatgctgcccttgctgtggcccctggccatgggaacggggcttcaactcggcccctgggaagtgtgtgggggcgtgtggggagtgtcacagctgcaaggacctgatgtcactgtgctttatcctgcagtgatgcctagggaggcagtgagggggtgaatgcagctccccggggagcaggtccacatcttgccagggcagcaggtcttcccatgactcaagctgacacaaaagtttggtgcagaaatgactaactgggaagggcttccagttcacctctgttgcctgtagatctcactggctgctggaaaagccgggaggctgagcagagggcaggtgagaagagggcaaaagacagactcataggctgagacttcacccttacaggtgacactgtggaggcctggggaattttcttctttccccagactggagggctgaggatgaatcttagaatagtaaatgctggccgcacatggtggctcacgcctgtaatcccagcactttgggaggtggaggcgggcggatcacctgaggttgggagttcgagaccagcctggccaacatggcgaaaccccatttctactaaaaatacaaaaaattggccaggtgtggtggcgggctcctgtaatcctagctactcgggaggctgaggcaggagaatcgcttgaacccaggaggcagaggttgcagtgagccgagatcctgccactgcactccagccaggcaataagagtgaaactccatctcaaa

SEQ ID NO: 84682 - DNA, 2044 bp, Homo sapiens
agtggagagatttctgctcactgcaacctctgcctcctgggctcaagcaattctcctgcctcagcctcctgagtagctgggactatgggcgtctgccaccacgcctggctaatttttgtattttttagtagagacggggtttcaccatattggacaggctggtctcaaactcctgacctcatgatccgtccgccttggcctcccaaagtgctgggattataggcgtgagccaccacgctcggccaggaatctctgtttttaacaagctcgggagatttttcagcagccagtccagcaccccagagtttggcaggctttgccaagtgcttgatatgaggtggtaaatgtctggcacctttaaaatatagggccctttccgtccatctggccctacaggttgatgttaaaaggatgcaaaaatacggttctaaatgtccttaagaggctaaggttggtctaagcaaagcatggaggaaaaagcccttttgagtttgtgtgtgagtagataggagttgccagttggttgataaagtgataaagtaatccttttgtgttaggagccaggaagcagagagagaggaaacagcccaaagtgatttttggcttgagagcaaacacaatagcagaaagctgagtgacacctggacgatagtgcagagaagctgagtgacacctggacgatagtgcagacaagctgagtgatacgcggacaatagcatggagaaactgagtgacacctggacgatagtgcagagaagctgagtgacacctggacgatagtgcagacaagctgagtgatacgcggacaacagcatggagaaactgagtgacacctggacgatagtgcagagaagctgagtgataacgtggacgatagtgcggagaagctgggtagcagagatggggtttcaccatgttggccaggctggtcttgaactcttgacctcaggtgattcacccacctcggcctcccaaagagttgggattacaggtgtgagccacggcgcccggcttaggtcagaactttctacgcaggtaaaaagtgacagcccccacagtaccaacacagctgggctgagcttccgcctctctagattctgttactttctacctctactttctccctgtctctctaagagatcagccgtcactaatttagtgctttactaatttaggtgtctttgccatgaaagatatgtgttttctttttttaatttgttggaggttctgaaggcactttggcatatgtatctgttttcttcagcagcaaagatcatcgtggagttaagatggcagctttgttgtgattcgtaaatttgctgaatttgtaaataactggggatacctgctggactttgataaatgcaactttttccagtgcttaaaagaattgctgcagaaaatttagagtgattatacctccaaactgctcaatgaaaaaggtcaacaaaacagtataattatctatgtatatgtgtaactcgtatgtgtgtggggtgtccacgtcaccaagtattagaaagttaagagagaaggatgtggacaataaaacaccacccacttcaaagcaggtgcagagagtaaggcattgtatgtctgattttatgaccacgagaggtcagttctgggctaccataaactctatctggaagaaagggattcaggcaccattcaagcaaactttggctgagcatggtggctcactgggaggccgagacaggtgaatcaccttagtccaggagttcgagaccagcctggccaacatggcaaaaccctgtctctattaaaaatacaaaaattagctaggcgtggtggcgcatgcctgtaatcccagctacttgggaggctgaggcaggaaaatggcttgaacccaggaggtggaggttgcggtgagccgagatcacaccactgcactccagcctgaaggacagagtaagacggtctcaaaaaaaaaaagaaagaaacaaacaggttaaaagagaaggatgtgaacaataaaacaccacccacttcaacgcagctgcagagagtaaaacactgtatg

SEQ ID NO: 84683 - DNA, 1052 bp, Homo sapiens
tcgtgacctcaggtgatctgcctgactcggactcccaaagtgctgggattacaggtgtaagccactgtccctggcctattttattttaagacagggtcttactctgttgcccaagctggagtgcagtggcatgaacacagctcactgcagcctccacctcctaggctcaagcgatcctcccacctcagcctcccatgtagctggaactataggcacatgccacgagccggctaatttttaattttttgtagagacggggtctcactatgttccccaggctcgtctagaactcccgggctcaagtgatcctcgctccttggcctccacaagtgctgagattacagatatgagccaccacacttggccctgagactttttatttttaatctttatgggaaatgaatttcctactaagtagtcatgttacctgaacctgattcatctgtaacctgatgggttttctgcccttcccatcagtgactaatgagattgttgctctaggaagaattccttgtgttcagtggatgtctgagtaacttaatttgaaggattgaattttcagcctcagctgtgatagagtaattttttcccatccctattgtgaagagatattaagaagccatttgaggccgggcgcggtggctcacgtacgcctgtaatcccagcactttgggaggccgaggtgggtggatcacttgaggtcaggagttcgagaccagcctggccaacatggtgaaaccccgtctctactaaaaatacaaaaattatccgggcagagtggcacatacctgtaatcccagctacttgggaggctgaggcaggagaattgcttgaacccgggaggcagaggttgcagtgagccgagatcacgactctgcactccagcttggtgacagggtgaaactccgtctcagaaaaaaagatgggatcctccatggtgctgttatcgttactcttcctcgatggtgtctttattgttgctgttataagtccaggaattttcagttggctaaaccaggctactgcttatatttgaatctctccaggtaata

SEQ ID NO: 84684 - DNA, 1282 bp, Homo sapiens
ttaagctcgggcgactctatgaaaatgaactggcggcggcggcagggccggcgcccgggcctttgcgctttgcgctccgtggccctgacatcccccagcccctccctccggcctggcccccgccagatcccttggcgccaccgggtgctgtcacccttctgtctgtcacccctctctgcacacaccccaggggcttcccatctcccggaaatccccgatccttctgagctccgctttcctaaccgcggaaggccgaaccttccactccattttctgaacttagtctcctcttctccaggctgctctgtgtgttggggccacgtgcaaacttcagggaagggccacggccctcaccagccccctctgcggactcgttttcttcttagaaggcggcgcccggcctcttggctttctaggagtctgggagcaagagggcaaggggaggcttaggcccatctcgttttccggctggcctggtgcccagagaccatgtctagtccagcgtcttcactggataaaagaggaaaccgaagctcagaaagattaagtgctcgttggggtgagctgagaccttcaccgggtctcctgtcatctctctcccctcgcatctgctctcttttctgaggacagggcctgatcttagtcatctttgaacccccttctggtagtatgcacggtgctttgcagcagtcaaagctcaacgcataatggctgaataaatgattgcctggaattgagcgtccaccgagctctttctaggtcagggagtgggaatggggctaaggaggagaggtcaggtggggatgggggtggcgtgggagccctttgctgtgtctgtgaactgtcacggtctcctcagccacgcggaaagcagcacactggtggtgtccggttgggtcaagctgcaaccaggaatttaagatgccttcctgctcagtgaaggaggaaaaaaaatcattgatgctgggattgttccaaaatctccattattagattttatctggatgagtttgcatttgaatgaaaaactgtccactttgctaaaagcacagttggaaggtccatcaagtcatctgttttgatcaattacacttattccttagcaaagattggctgtgtttcccacaggcaatgctcttgccgcccatgctggtaacatttttatatgtctctttaacttaagggaagagcctgaagatttcaccctagtgccaagttccaaatgcccttggtggaggctacccaactggccccagctgcttcagagctggctgcaatcctg

SEQ ID NO: 84685 - DNA, 2383 bp, Homo sapiens
ctgtgtagtaattgtaagtggtttttttaaaaaagtacaagtgaatgtaacttttacctgttacatcatttttaagggaaaagcctgcatgcttctttattttggctgacttgtttaatgcatactaataggtagatgaccctccaaccaataggtggctttctgttgcatgtcatagtgcagttgaaactccttagggtaatcaccctctttaaaggcaaaagacaaatagcatgagtgaagtggtccaaatgccattctttaataacctcagtggtctgatttactttgagcatgctgtgtttcactctgaagtaaaatctgattatagtttggtgtatctggccaagatacaaaagctgaaatatttataacagcagaaccccacaataaaatacgatagaacttcttggcaacagtttattgctcagttaactattttgaagcatttctgataattagcttgtgggtaaattagattttgcaaaaagtttgcaaaatactcttgattcttgaagaggtgaggttattgagaaagagtattttgacccaagatttatgtgaaagcttgaatgtcattttagtaagatggtttccttggctgtctacgtcaagagcttatttagcgtaaaaacattgagttgtactgcgcatcagtttttttcattctgttgaccaataaatactttcaggaccataatcccttcttggcttaggcatctcaggtgtcaaggatgatagaagtcctttgcctgcgtttaataccaattgtagcaagtagaagagtctttatgcttggaatgacacctttgtttgtggctgccatagcctaatgtagtcaatacgaaataattgactttttttcttttttaacaggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtacaaggtgtaattatggatcattttctagcatagtatttcatacaaccaaataaggctgaatgtcttataataattcttagaggtaaaaactgtgtgccctcttcctccagaggctagtggcagtagtggagaattactcaatcctttcttagtaatccatacacacattatagacagcaggatagcagtctccctttccagaaacactgtataagaagcttctttccataaacagtttatacatcaatgtgtatagatacctagttactgtagatcttttta

SEQ ID NO: 84686 - DNA, 1035 bp, Homo sapiens
tgaaagtggcagtttactaggatgtgactttgcatttagtttaaggattatttagatttttttgttttttaaagagacggtatttatgtcttttaattttagaatatgttaatgtctgtcccagcatgttggaacataatttctttaaagggagggatcattgctttttctcaagtgattttagtctcttcaccctgtggtaagaggattgtttcatatacgaatccataggtaggaaatacatgttctccctgcctgttcccctctctccaaaatgtagatacactgggcaaagaaacatagccaaggaatcctttttcccctaatatctgtatgtctttcaagaggatattacttccttctcagagtagaagggaggaggagtagacagattgttgcttagagtgaagtttacacgaagtaagaccaaagtccggctcctgtatcattgttttcctttgtcctgctctgttggtttatttttcttgtaatgttgctttcatatgattgttctccctccctttttccttgcaatatagattcctaaaggaaaacccaactcttcctttcctaaaaactctactttgtaagtcacgttcatggcacagtgaattccgctttcagttttggttcttcactaatcatgcctgcgtatgatcgtcctgttgcttacagactctgcctgttccaccttccagggcgctgacctaagccttttccggcctgctcctcctgcctactgtggttggatgtgatgtatatgacagtgacatttttatgccaaagttacttggaacttctggcacatctcatggttgcttacaagcgagttgtgttctagtgtttgtgttaatgatactttggcagtgatttgctgttagagtgaatgttcctatcatgtttcctacgtttgaatacgttattgtcctttggagaacagttgggtgcccatcagttctttcatccctaagcaatttttttttgcctttgcatattttttttctgtcttatgaattaaagatcttcatgtatttt

SEQ ID NO: 84687 - DNA, 1220 bp, Homo sapiens
tctactaaaaatacaaaaaattagccgggtgtggtggcgggcgcctgtagtcccagccattcgggaggctgaggcaggagaatggcatgaacctgagaggcgaagcttgcagtgagccgagatcacgccactgcactccagcctgggcgacagagccagactccgtcttaaaaacaaacaaacaaaactttttgaaataagtgaactattgcctagaacttggaggtatattttttggtgatggtttaggatggaagttgttctatgtattttattagtcgatatgtatattatagcatatcagtagcaggcttaaagcatagtaagaagtagtgttccacatacctttaagttaatttttattgtatttgctttttctttgcattatcattgtgactattacaaactggaataactgaagaaaagattgctgtctagcatgtcatttctaattctgattttggacttaatttttataacacttctattgaaatacctttaggttggcaaaagcagcttttgatgatgcaattgcagaactggatacgctgagtgaagaaagctataaggactctacacttatcatgcagttgttacgtgataatctgacactatggacttcagacatgcagggtgacggtaagcaagcacggagtgaaacaggcacctctttcagttgcaggatttgtttgtactctctttagacattccttggcttgtcgttatatcaagctagaatttagattcaccgcctgccctctatgaaattgtaattgctgcctttataggaaatggtgctacagtacggagttccattttgggaacttagtttagctcttcctttacactgtttcaaaggttgaggacaggaggagtggagagcaagcagtttattttatcttcattcaattcaattttagggggctgaagttaagtgtatttaaatccagatggtatcagtaggtatttatgaagtttttctctttgttgaaatattttatctaaaagggaactggtttcccatttccctctgggattctgtagagaaattgaatgttggcccttgggtctcttttttttttttttgagacggagtcttgctgcgacacccaggctggagtgcggtggctcaatctcggcttactgcaaactctgcctcccgggttcaagcgattctcctgcctcagcttcccagggtagctggggttgcaggcacccgt

SEQ ID NO: 84688 - DNA, 1941 bp, Homo sapiens
cctggtgaatgttgttaaggatgtgagtgctgaaggcaaactgcctgggtttaaattttgattctgtcccttgcagcctgcctgggttcaaatcctagctctgcttattaaattcttatttaattgttgatcttagagcaatgtctttacgttgctaccttgtgaaagaaggtaattcatgtaattgaccagcatttaccaagaagcatcagtgttcagttttagtcattggtaattctgtagctgtactgtggtactgtgaagggggtgtgggggctggcgtgtgtgcgtgcctgcatgtgtgtgtgtaacaataggcagcatgcagaagggaaaagatactttttataacctagaggcagcttttctctgcttttgtgtcaagaaggaagaagggagtttggagagggatacaaattctttttaatactaagctctctacctcaaaaccagagatagaatatgtaataatttgtagaatttctagacttaatctgatttaaaaaaaatttttttttttttaggttgagactgagctaaagttaatctgttgtgacattctggatgtactggacaaacacctcattccagcagctaacactggcgagtccaaggttttctattataaaatgtaggttctatactagaagggaaaatgtaagattgaaagttggtccttttagaaccataactttgttctatgtaggttttcaacttttatttaagaataattgttcaatgttagaaggatagttaatattgtaatgaaaaggtggttgggctattatgaaaatgtattagcttttgcttatttatattcttttgtttttgtgagacctatcccattcccctcccccaaacggcatacatttcacagtgcttagtgttatatatagacattttattttatgattaataaactgtcatgccattccttggaaccacttgcttgtttaattctggtctatcaggtgataattttattaatttttagaggctcctcagttaatttcctgggatttttgcttatatttagtaatatgaaatgtctaaggaaaaaaatgaaacgaagccagttattcctgagagtgtttaaaattattgaagtacacctaattgttacatatatttttgtcacattttatataatatagaacaattttagcttattttcctttaaaaatcgttcctagtttaaattttttttttttttttaattttggttttgttttaggaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggtaagttgtggggaagaacagcagcgctcagcgtgaaagttaaggggggcgctgtttgggttttccgtgttgtttcttgggcctgtctttgtagacttggctgcatagtaattcttttggctcttactgaaactactttggatagtattaaaacagacctgtctcaacccactagcatagcagtcagcataattattttgatgtgggatatttttgttgctggtagattgaaatctaacatgttaaaatgagtagaggaaggaaatgagaggaattagaattattttaatttttgttatattagttttcagtctttttttaaatttgagaccatgtctcactctgtctcccaggctagagtgcagtggcgccatctcagatcactgcagccttcacctcctgggttcaagtgattctcctgtctcagcctcctgagtaactggagttacaggggcctgccaccatgcccaactaattttttttgtatttttagtagagac

SEQ ID NO: 84689 - DNA, 1790 bp, Homo sapiens
caccttctgggttcaagcgattctcctgtctcagtctctagagtacctgggactacaggcgtgcatcaccacgcccagctaatttttgtatttttagtagagacagtgtttcaccatgttggccaggatagtctttatctcttgacctggtgatgtgccacctcggcctgccaaagtgctgggatttacaggcatgagccactgtgcccagcctctgtttttattttttagagacagggtctcgaactcctgagctcgagtgattctcctgcctcagctctcaaagtgctaggggtatgagccacttactcctggccctaaaatgcagattcttgagtctcatcaccaaagattgaaacgtgggtaatgttggagagccacatggtaatatggcatcaaaaataagtttttattaatgtatttattcagttactatttcttgtgctgtttgtggcgctttgcattcacacgccgttgtgtttccctatgcttgcggtagatgccaaggcttttctgggcccctttctttgctcgccacctagtggtaacaagtaggaatcatcagaagttttaccaatgaaggagcttcatacgaggaaggatagaaaacatccaaagtctgttggtggccaaccatatactccgtatatttttgctgtatgaacaaattccccttccttttgtatttttggaaatactatttatttgtgagacaatacattttagaacctgtaaattcttaatctttctcttaaactgacagctcatttttttttgctggaaaatagttaggtgtgcctaattaccttatttaatgagaggtgctttcagaccacactaaattatattagatagtatatgaagtctttctcactccacctaactaccttctggagtctttgtattggctcttagtttggtttcctttacatgtttttggctttttactcatattagttttgatgattatgaaattatttttgttaaaatgtttttttcgcagtagcttgacagaaaaaaactactttgaaaggaatatgttaagaaaacttcaaatttgtaaggtctgacttttccttttcccatacagaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggtgagattgttgtgccatcatccccccttatccacagtttgagttacctgtaggacggtacacttaagattttgagagaaaaggagactacattcatataacttgtattacagtatgttataatgtttctgatattgatctttgtgcctggtttataagttaaacttacccgtggctatgcatgaggacaaaacatagtctgtatcaggtttggtattttccatggtttcatcacatccactggcaggtctcaatggatccctcttggataagggggaactattgtattttcaagcaaaatgatgactgttttttaaaaaaatatggtgggttggccaggcgcggtggctcaggcctgtaatcccagcactttgggaggctgaggtgggcggatcacgaggtcaggagatcgagaccatcctggctaacatggtgaaaccccgtctctactaaaaatacaaaacattagctgggcgtggtggcgggagcctgtggtccca

SEQ ID NO: 84690 - DNA, 1012 bp, Homo sapiens
tgatccacccgccttggcctctcaaagtgctgggattacaggcgtgagccgccgtgcctggcctgtactgaatttcttttatagtaaacgagtagtattgctcctgaaatggtctgagtcaggctttttagacatgctttttagtacagaactgatgcttcccagattatttgtcagtgtgatagagaaggtgcgtgataatcgttttagaaaaaattttgctccatctttatatttctgaatagtaacaagagagttgtcatgtgactagcaagatattgggaccttttagaaatcagtaaggcagaatgttgattgtcatgaattatctgtgaattgactatgtttagtgattgtcaagcttttgcctaattttattcattccttggaggttgtccaagctgaatcagattatttgaaagccacacaattcctgagcattctcatatgtcagccttctgcagaaatgtcctcagttatttcatggggtcagaagtatccaattgaagactgcttctcacatgtaaatctaggcatacattttctgtgatgactcctttttaagaaaatatccgcaaggtaaatttcttagtaagtagcaccttgtaagtttctctccaacaaacttgcatactatcccctccaaaccataaaaacaatttgagacttttattttgagacggagtctcacctctgttgcccaggctggagtgcagtgacgcgatcttggctcactgcaacctccgcctctcgggttcaagcaattctcctgcctcagcctcccgagtagctgggattacaggcacccgccaccatgcccagctaatttttgtatttttagtagagacggggtttcaccatgttggccaggctggtctcgaactcctgacctcaggtgatccacctgcctcggcctcccaaagtgctgggattacaggcatgagccactgcttccagccaggaagtctttacatagtaagacatttgagtttgatccagagggatgatgttt

SEQ ID NO: 84691 - DNA, 1615 bp, Homo sapiens
catttatggctcactgcagctttgaccccctgggcacctcagcatgccaagtagctggggctacagaagtataccaccacttctggctaatttttgtagagacaggattttaccatgttgcccaggtcttgaactcgagctcaagattcacctgcctcggcctcccaaagttttgcgattacaggcgtgagccaccatggctggcaaaaaaatttttttggtagaggcctggtcccagcggattgcccaggctgatgttgaactcctgagctcatgtgatcttcccaccaggtagctggtaccgccatgaccagctaattaaaactttttttttgtggagacgggatcccactgtgttgtccaggtaactcctgggttcaagcgatcctcccactgtggcctccccaaagtgcagggattataggcatgaaccactgcgcccggccagcttgatatatttaggtattgatatatccaaattgacgaattggttgccaacagaacctcatggttctctgactaaatgttaatgctagtcatggccctaagaacaatttcagatgttcatttaaatttattaaattgtagcaaataataatgaaagtcaccataatttaacatccacatgagtatatcttgaaaagacagactaattcatcagctacaacagcaggcataaactgggattgtcctgggcaacaaacttgccttgtggtcaccctacttaatggccatttgttactagattttgtcatttagactcatacaacagtttcctaaacgttgtccagctttttatcacagagatagcttagatctacgtctctaggaggttgaatttttttttttcaaatgaagttagcctttggcagaatataagtcaaaggaaaagtgaaaatttcctcctcctagctccctcccccacaaatgggaacgtgctagttaaggatgtggtagttgctgaaaatagagcttgctggcattccaaatcctctgatggtgtcaacacctagtgtgttggttttcttatggctaccttgagccagttctgtgtttaaaaatataatagacctaggtgttggtagcagtgtcctaagctcagagctttccctacatacattttatttttttatttttacaagtgtctttcataccaaatacccacataaaaatttaaaggctcacccatatcttgttacaactgttatgtttagaatgccaaactgtgtagttcagaccatatgaccatgatcctggcttatctcttctgaaatttttatcttgaatttattgcccttccaacaatctaccatagtagctggacggatctgttgttggtgggcttgatttgtgatcagatcaggattttatcgagctaaagcaatatgaaatgtgtttaactcttcattcatatctaaagtttgaaggagatgcattactgtaagagttatgacagtatttcatcatttggcagatgtggtaaatctgccatcacagaatgcacaggaatcactgggttccttatctttcaaatggggattagtgatgtctctcttgcctactaatttgcagggtggttatgaaattttgggcttttgtaaactgtaaagtgtaa

SEQ ID NO: 84692 - DNA, 3693 bp, Homo sapiens
caccactgcactccagcctggggaacaagagggaaactccgtctcaaaaagaaaaaagaaaaaagaaaaaagaaaagaaaaccagggcgcggtagtgacagcctcagatttcgggaaagaagacctgccatgacagaaaccgttacagcctccgtcgttcttttccgcaggtcgggcctcgggccccggtctgacccaggtctctcgctggcttttttcaggagcagtcccggccggccccgcctcagcccttctcgttccccgggggccgctccctttcggcagtcgcagttcccgcctctgggctccggcgcccgctgagccgacagaggagaggcgtctcgtgcgctcgttccagccgcttcgggcgccgagttccaggacccgccccccgcgccagttgccagggagcggttgccatagagctgagcagttgtccgcgtgcgcaggcggaagtcccggattgaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacggtgagttgggggggcaacggggggctggaattctcggaccctctgccgccgcccacagaggccgggaacaggagacaaaatggcggcatcgtctgcgagcctggcccgggggcttgggttcgggaagcaggaaatggcctgggagctcccggggcgatgggaggctctatgccctggaatgtgaccccttcgccgtccttaactgcaaacaactcgcgggccgggaggccggggcgacggggtggaggagttggttgtaaaatggcggctggggggagggcgagtcccggggcgggggagggggaggagatggcgggtgctgtctccgaacgagccaccctcatgggagcttctgggacggccttgggatgtggagaacaattgggtggggtgacgggggaagcagcacccgccacatgggagagagcgaagaccgggagctgtagcgcgggcgcctttcagggaaatatggcgggtgggggcggtggcttttccccggaggccccgtgtggggcggcggccgtggagtctcacaaaggaggacctttgagagcgatgggcttcctcaggcctgaggtgggggacagtcgtggatgatggtggggggagaggggtgagtgggaatcactgcagttcgtcttcgggcggtggcaggctcccatgctgcgatcgggtttctttcccgtaggccggcacctcgtagtgaggggtttcggggcttttcctcctcgtcgtcttctggggaggcccagaaaatcctcactccctccctttcctcagacttaaaacaggagatctcgaagttcctgtaacctttctctggctccatcacccgtgggttctgatggatagaaccaggaggccacgactctgagagttcgagcctttgtagagcccgagcctccgtccccccgtttgtaaaaacgatgactttacagtttgtgcgcaccgtgatgacaaatgggaagacctgttgaaataaagttatttccaatagtgttcagtaactgtattttggttgactctgcaggctcggaatgctggtctgtacttcgtgggggatcttaacctattccaggcgctcggctgaggctgggttttttgagttatgaaggttgaagatcctgttgctttctttttttccgttttaaataaatgggtttatgtagaaatattagtaggtcctctttgttcgttgttcttttgcccctaatgggttctccagtcctttttcagaacttcatcgaatgtccattgtgtctgtccagtcattgtcaggaagtttattcttaatcctctctcccagtccaccttttggaccaccttttgaaatacccacacatttataattgtgcgatactgtagtattaaacgaaaggtcatgtctgtgggtcctgtggttttaatgcttttgcgtggtagggtggggtgagacatggttggaatcaagtatctttgattcttagatttttttcctaattaaaatacctatatttcaaaatgttagggcccttgctttcctcgaaatgcggatttagtcatgtgaataacctcagggttagtcccccttatcatcagaaataagattcagggatttgaaaataagacaaggcctctagaactcatatttaggaaatatagtgaactaaatttcgtcttgtaaattcttaaattgctatttgtattcaacaaggttcctgttggggggggggataagatggggaagtacagctcaaggtctgctttgtctttatttcagtgtttaaaaatcaaagagatatgaatgtgcttgtattggaagtctcctcctccgccccctcatctccagatgttcccctcttaatctgttagtgttcttgggaggaaacaaattgtacttgaatgctttctattttgtgggtattggggctttttaagtaaacttgctgtgataactagaaaggatgtgaggaaaggtctttttctttttgaaagctcctttaaaaaactgatttgaaagcttgtgattgtagtttccaaataaagtacaggttagtgataattatatttttgatgtgagtggtgaggatttctgaccagagcccttattggttattgaacatgggactctgatacagccacattattacagttgttaatgttaggtgtccccttcaggatctaaaggggtaaggaaataggatctacaaggtgaggagctattgctgtgacttggggcataaggtagggactcagtggaaaggagaggaggaggaggagacagaaaccaggaatttctacctgtgtcctctacctgtgtccattcctttattgagtgcggtatttttttgtttctggtggcaaagttttcccggagttctggtcaccaaacagaacttagcaggtgtcgggggtggaagaaggtaagacagtgtattggcaggatttctttgttgggtacttgtacccaaatgctgggtttccagctgcccttttatctctctgttactgcagcaggcttattttattttgcttgctgtgttgaattagtgcctaaacttctttgtatcctcatttaattctatcctggggcgttggaatcaatttatatggattatttaacagtacgggaggaagagctaacctgtgttcaggaaaatgacaattttgggtcacaggaaatatttaagtttggggctgggagttgaagattaaatctagcatctcatcactttaacaagccagtagtctattcgaatcgtttttacctcctttgaaaccatattaagcaagtccattatttcttagcatttctcaaacagctcttactgtcccgtatatgaaatagtacaagaaagtggggaagaaaggccgggcggggtggctcacgcctgtaatcccagcaccttgggaggtcgaggcgggtggatcacctgaggtcgggagttcaagaccagcctggccaacatggtgaaaccctgtctctacaaaaataaaaaaattatccgggcatagctactgaggaggttgaggtggaagaatcacttgaacccgggaggtgaaggttgtagtgaacca

SEQ ID NO: 84693 - DNA, 3397 bp, Homo sapiens
aagctgagggtagtgagtacaaagaaagggaatagtagctaactcactgaagttgggattgctcatgcagagacagctgagatttccaataattatcactttccttttttaatcaaaaagtatcattatctggaatcccttttactttctgtattctctgtttttccacactgctaaaaacacttttccttctgcctgcattaaccacaagtaatcagtctggtggctggggctggggaggcagcaaatggccatttctgtaatatccctagagcagtcacatgggcagggtgtgcctaaccagagaatggagttgttcagcttgcattcctacctggaaataaagtgctctccttattctcctcctgcaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaatctttgaatatttttcacaaaagaactaaatctttttttttttttgagacagagtttcgctctt

SEQ ID NO: 84694 - DNA, 1065 bp, Homo sapiens
tgctcagccggcattgtcacgacacaggctgggttagctgcttggttttctctttttttgcagacagggtcttgttgcccaggctagggggcagccttgacctcccaggaggctcaggtgacctcctacctcagcctcccaagtaactgggaccacaggcgcacaccagcacgcttggccacgcttggccacacttggctttttaaatttttttgtagagacaagatctcactcttttgccagggctgctctcaaaatcatgggctcaagccatccccccacctcagtttcccaaagtgctgggattacaggcatgagccactgcaccaagcctgctgctatttttttctcaacctctgtgtcttatgtgtctctctatccccttctttctgtccctccttttctcagcatcctatgacccatacagtgacttcaggcctctgtaatttttagagagttcttcaggaaacaacagaggggccaataggcaagctgttccatctgtaagtgaggtcaggctgggcctggaagaggccctgcggctggacttacgttggctttggccagtagatgtgcctgcgtacatttttagggaacccagtacaagcccagatgcataatttgaaagttcctgatactgtatgaaatgcataaatggtgtggaggctcatgcctgtaattagctgggcatggtggcgtgcacctgtagtctcagctactcgggaggctaaggttggaggatcccatgagcccaagagttacaggctgcagtgagccatgatggtgtcagtgctctccagcctgagtgacagagtgagaccctgtctcaaaaacaaaagataaaaagatggccaggcgtggtggctcacacctgtaatcatagcactttgggaggccgaggcgggcggatcacgaggtcaggagatcgagaccatcttggctaacatggtgaaaccccatctctactaaacaaaatacaaaaaattagctgggcgtggtggcgggcggctgtagtcccagctactagggaggctgaggcaggagaatggcgtgaacccgggaggc

SEQ ID NO: 84695 - DNA, 1010 bp, Homo sapiens
gcggtggctcacgcctgtaatctcagcactttggaaggctgaggcaggcagatcacctgagatcaggagtttgagaccagcctgaccgatatgatgaaaccctgtctgtactaaaaatacaaaaattagccaggcgtggtggtgggcgcctgtaattccagctactcgggaggctaagacaggagaatcacttgaacccgggaggcagagatttcagtgagctgagatcgtgccatagcacttcagcctgggcaacaagagtgaaactccatctcaaaaaaaaaaaaaaaaaaaaaaaaaagccaggcgtggtggtgtgcacctgtggtctcagctgcttgggaggctgaggtaggaaaactgcttgagcctaggaggttggaagagaaggctcctgtgctgcctctctgtacttgctcttccctggttttgtgtgtatgaatttgtgtgtgcttcctgccctgagctcactgaaagcaagtctggatcaaggcatgttagcagtcagtgatgtgctgctggttggtagtagggacctagaaaagcagtcacctgggtttgcgccagcaaagaaaaccagttctgtgatgtcccctgtgtagtgaattccaaacattgataccatttgggttctgattttgttctcattatctctggaacgcattgatcagctgggtaatcttttgttcctgtaccaattctagatctgattgcaccaggatcgattagccttgaaaacgacacagagctagggaatagccagtgtttgttacgttccttgggagcaaagaaactgtagtaaccacattcagtcttctttatgaatgactccatgatacagccgggacttgcttcctaaaaaagtgaagatgaaaggatgcttgttatattttagtcaacttttctaggtgttttgtggattgtggttctttaggatatagtcttaagtccaccattctacttgatagcaaactctgtttaaatacctcaatcttatattgtctttgttc

SEQ ID NO: 84696 - DNA, 1929 bp, Homo sapiens
caaaaaaaaaaaaacatgcaacagaaccttgaggcttacactgctctgtaaatggggtagcgacagaacatatttggagaatgcagtgaaagcccccgtcgttgatcaagtatgagagcacgtcctgatcagcctagtctcctggcctcctcatccttccctggggctgtagtgatgggcatctttcttcccaggggatgtttcagcttccaaatgtgatgttggtgtgctgtgaagagaaggggttattttttctagagttttttttgctgattaaatcttgactaaatgtgtatgaggcatgcatgaaagctccatttcggccaggcacagtggtgggctcctgtagtcccagctactcaggagtttgtggtgagaggatcacttgagccccggaggtcaagaccagcctgggtaacatagtgagatcccaactctaaaaaaaataaaaataaaatctgcatttcatttccagtgtagtacatcattaaataacagcctgctctgttttttccaggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtacataacgtgcacaatgtagaaagaagagatctgctgcagggtctcctctcggtcctcttagagctttgtagcaatgctgactacagcattgggatgttgtagatggcaagccgctaagcactgatgttggcattgaatgttgggttttctcttcttcatagaaaacctgtttgggaatgagtaagcttaaaactgtataactgaatgttcttaattgatctactaaacacacttggactactttaataacaccacctgaattcacaggaattaacctcaaatgtttttcctcatctacatcctcatctgtttcttgctttctgtttgtcgttgtctaaaagaaggtgggttcagatggatttgagtgtaataagtggtctctatcaaagcacttaaatggaattttcccgcaaaaacttgtttttgcttcaggggacttgaagttccttaccactaatgttcattgagtagaatccgggaggaaataggcctagtagaggtttgaagagatgcacacccagaagtcctcattccgaggagtggcaggtgcacgggtctttctaaatcattcaaaaagccagttcttcctcaggaattaatttttgcctttactgatgaaatatctttggcagcccacttccttctggccagccattacatggtgttaattcctttattcctctcttccacgctcacaccttgctctcctacctccttcctttcttcttccttcctccctctctcccttcctttcttttcagaagaattgatggttcagtgtaaaagctagtacagactgggcacagtggctcacacttgtaatcctagtgctctgggaggctaaggcaggaagaccacttgagaccaggtgtt

SEQ ID NO: 84697 - DNA, 1038 bp, Homo sapiens
accttggaagtgttcacagatggtcgtagttgctcatggcgattctgttgtatctcaggacacagtgcgttattccaactgtctttagcaggaacatagatccaggtgaaggtgaaagccgggtgggaggttgtcttcctaagacgtgccgctttctccttgttcaccagccacactgtgcttgctgtgttatctccaacaatgctgtgaacttctctgagcttctccagtctaggaaggcattgtgcttagcttctttccatcacttcagagttaggcttattaagataatatctggctgggcgcggtggctcatgcctgtcatcccagtactttgggaggccgaggcaggcagatcacaaggtcaagagatcaagaccatcctggccaacatggtgaaaccccatctcttctaaaaatataaaaattagcaacacttaactgagcactgacctgccaaccactgtcccaaaaggacaactaatagaacaccttggcatgtagttgggtaaaccttagcaagggagcttttctccacccagctgtgatcagaaccatttctaagccatgggtgcccaggtggcctccttaccactctgccctagagttttcttgaccaggcagtgctaagtaggtccctatgcgctcacactgaccctgtcctaaacagtttctccataggcctgaaagatcacccagaattagcctaatggtgataggcaaggtagccatgaatctccttgactaccagacttgaataggaattattctccatcagtgatcctcctcaataaagagaatctccagaatatagcacctccgtgctctgctacagtcataaccaaaatcccctctccagtcctgccctcggaacttttgcgatcatcttctattggtgcatgaggagtgtttgccatagaggacagtcctggcactcgcacccctttcagtgtcttaaattggagagacagccagtattcctgagtctgggctgttcactgttttaagctgacagctgtgaattccacaggtggactt

SEQ ID NO: 84698 - DNA, 1077 bp, Homo sapiens
agaccccattctccataaaaaggaaaaaacaaggacgaaaagaaaagtctgagtaccggggcccccgtctgctcccctcaccacttggccgtctctctccgcccccacaggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatccca

SEQ ID NO: 84699 - DNA, 1022 bp, Homo sapiens
ctgacccctcctcctgcctggccccccagggagatgtggtgctgcagagtgaccacgtgattgagacgctgaccaagacagccctcagtgccaaccgcgtgaacagcatcaacatcaaccagggcaggtgaggcgcgggcggcccccggggacagggcgggggtggcgagggggctgtgtgggcacccagggacagggtgggggtccaccttagggttgggggtctgcctccatggaaaaaccctcacccaccccgttcccccagcatcacgtttgcagggggccccggcagggatggcaccattgacttcacacccggctcggagctgctcatcaccaaggccaagaacgggcacctggctgtggtgagtggggcctgctttcccgcttatggcctggctgtgatagccaagccttccttggctgtgcttggcagagcccaggcacctcaccatgggccttcatccagaggccatcataccacctcttccatcccttggcccacccatgagggccagagagagcccctcagtgcagaaagttgtaaaggtggcagcacggtggctcatgcctataatcccagcactttgggaggctgaggcgggtggatcaccagaggccaggagtttgaaaccagcctggccaacatggcaaaacccatctactaaaaaaatgcaaaaggctgggtgcagtggctcacacctttaatcccagcactttgggaggccgaggtgtgtggatcacccgagatcaggagttcgagaccagcctggccaacatcgtgaaaccccatctctactaataacacaaaaattagccgggcgtggtggtgcacgcctgtaataccagctactagtgggggctgaggcgggagaattgcttgaacccaggaggtggagattgcagtgagctgatatcatgccactgcactccaggcctggggaacagagtgagatgtcatctcaaaaaaaaaaaaaaaggccaggcacagtggctcacgcctgtaatcccagcactttggg

SEQ ID NO: 84700 - DNA, 1018 bp, Homo sapiens
ctgcaacctctgcctcccaggttcaagcgattctcctttgtcagcctcctgagtagctgggactacaggcgcccaccaccacgcctggctaatttttgtatttttggtagagatggggtttcaccatattgaccaagctggtctcgaagtactgactttgtgatctacccacctcggcctccccaactgctgggattacagccgtgagccactgtgcccggcctggggtgcacctgggcagctggttcctgctcctgaggccctttcagcaggcagagggcttggctcaggccggcagccatctgcagcttcctccctgtcacccccaggcacaagctggctgaccagcggaccaggaaatctctgggccgaggggaattccgccttctgcactatgcgggggaggtgacctacagcgtgaccggtgaggatcctggggctgtgtccccacaggggcctgcggggaggctctgtctcacctcacgtcggttctcccctcccagggtttctggacaaaaacaatgaccttctcttccggaaccttaaggaggtgaggaggacgtggggaggccggggtgggggtggggatagcccacagctctgcacctgtgtccaggagcctgtcctgcctgtccctgtgccccaccctgaccccggctctgcccacacagaccatgtgtagctcaaagaatcccattatgagccagtgctttgaccggagcgagctcagtgacaagaagcggccagagacggtgaggaggtggcgggaccgggcgcaggggtgcatgcgcctgagtgtgcatgagggcctgtgtgagcctgggagctggcagcgtgcgtgtgaacgcgtgtgagcccgtgcacatctgcaggtgtctgtagggggctgccttaggtgcctctttgcctactttttttttttttttttttttttgagacagggtctcgctctgttgcccaggctggagtgcagtggcgcaatctgggctcactgcaacctccacctccctggttcaag

SEQ ID NO: 84701 - DNA, 1038 bp, Homo sapiens
ggggactgtctctgtgtttctcacctcctgtgctcaggggcgtcgtccagcttttcccctctcctggtcctgtgtccccactgagccactgtgggctcttctccttccttacagctttgagcagttctgcatcaattactgcaacgagaagctgcagcagctcttcatcgagctcacgctcaagtcggagcaggaggagtacgaggcagagggcatcgcggtgtgtgctagcctgggggcactctccgtgggccacggggagcctgggtatcggggcccctgggagagggtgccaggaccccacggtgatcccttccttcccttctgcccctcagtgggagcccgtccagtatttcaacaacaaaatcatctgtgatctggtggaggagaagtttaagggcatcatctcgattttggtgagtcctctgcgcctccaaggcctggtgctggaggctgggtgggaggatgtcccccttctccgttctctccaggctggtccacggagggccagagtttggggctgagtagagacagggcagagctgtgaatggaggatggagggaggtgccgccccagttggaagctctctgtggagactccctgtgatctgcccctcccctgtgtctgtgcctcccagcacggtgaccccaatcctctgtgcgctctgacctgtcccccatacgtccttccccctgtgccacaccccccaggatgaggagtgtctgcgccccggggaggccacagacctgaccttcctggagaagctggaggatactgtcaagcaccatccacacttcctgacgtgagtggggctgcggggctgctgggggcaagggctcacttgcagcagagcctgcggagtgcaggagtccctccgccatcacaaaacaccagccacaaggaggtgaccagggacggtgctgagttaaggacccctcacatgtgtccagaaactaagaagcttagccaggcatgctgacacgcctggagtcccatctatgcagaaggctggggcaagagcatcacttgagccctgga

SEQ ID NO: 84702 - DNA, 1056 bp, Homo sapiens
gcttggggatgtggccagcatagctattcctctggcaagtatcaggcagcccagaagttcacctccaagtcgaacgtgccggagacaggcttgtggtcgctgatgccgtacgtcatgtggctgctgtagcccctcagagacaaggagaagtgtgacgccggcggtatgggagtgtcggggccagcacagggctgccgcttcagcctccacaggatgcgatcggtccatgcaggcttgcgttttttctcactgcaggggcagggggcataaagaggaagaatggggaaagaagaaagggttggctaagagcagaaatgagcccacatgagcttgctggagcccctaactccagcaactactggcagccacagacccccggggccagagccggagggagcaaggcagcaggcaggaaggtgcctaacagaatccaaagtatgccagcacttgtcagacttagccaggaccctctgtatgtctagctcatgtttttatggatcaaattgtgactcagaaacattccatttcaaagctttgcttctttcttgagcaaaagcagcagtggatcaaagcagctgaggtttgagattctgaggctggacacacctgagcttgtatttggctgccctgcatactagaagtatgcctcaggaaagggaagggaagcatttaggaaatgcttaccagaggatgcctgtgatcagtactgttaccacacctttttttaaatttaattttatttttttaaagagacagggtcttgctctgtcatgcaggctggagtgcagtggtgacatcacagcttactgtagcctcaaactactgggctcaggcgatcccacctcagcctcctgagtggctgggacggtaagtgcgtggcactatgcctggctaatttttaaacatttttttgtaaagacagtatgtttcccagcctagttttgaactgctggcctcaaaggatcttcccatctcagcttcccaaagtgttgggattagaaggcatggaccactgtgcctgggtgtatcatgctctctttacaggtggagaaactg

SEQ ID NO: 84703 - DNA, 1529 bp, Homo sapiens
agcgagactccgtctcaaaaaaaaaagaatgctgaaaccaaaaaataatagctttcagataatccccacagcatctatgagatggattcctactttatcaatgagaaaatacactgagaaactgcctcaatgtcaaatactaagaatcagagccagggtttgaacccagatctaacttcaaagccagtatccttagcttatcttctcttcccgccacccgcacgcctaggcgcagaatcgaaaacctcagcccccagaatgtatcatttggcagctgagaagaagaatggaaaggcttgaaactctgagattcaaactgggatatcgtagaccctggagcaggacactgcatgtagctgagggctctctagagtccctagcacggagcttggaagggatgcacttggcctgtgtggtttaatgagcgacctttgccctctctctcctgcaggtctcccatgtccgtatgcaggggatcctcttactggtctttgccaagtatcagcatttgccctatatccagattctgtctactaaatccacccccactggcctgtttgggtactgggtaaggactgagctattgtctgagtcgtgagctgggaagggctgggaactgtggagctgggcaaaagaaaaaggaagtgaaaggaatcttggtcctctgtccagcccaatgcatgtttgttcttttgcctcagagtgggcttgctatccctgaggccaggcgaggcgagctgggctctgtgcatggagagatcaccctgggaagcttagttactgtccctaggagaccctgcaggaagtgagactgtctgccctcaggtccaggatgtggaaagaggggtgtgtccaacccgagtagcttcccactcttctgttgacctgttctaccaggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgagtgagcctgggtctggcagaccgttccccgccctctgccccacgctaacccccactaacccccacgagtgagcctgggtctgcagaccgctccccgccctctgccccacgctgacccccacgagtgagcctgggtctgcagactgttccccgccctctgccccacgctgaccgccacgagtgagcctgggtctgcagactgttccccgccctctgccccacgctgacccccacgagtgagcctgggtctgcagaccgttccccgccctctgccccacgctgaccgccacgagtgagcctgggtctgcagaccgttccccgccctctgccccacgctgacccccacgagtgagcctgggtctgcagactgttccccgccctctgccccagctgaccgccacgagtgagcctgggtctgcagactgttccccgccctctgccccacgctaacccaagc

SEQ ID NO: 84704 - DNA, 1047 bp, Homo sapiens
ctgcaggcctccttgcttctcggctgactggcaaaggattggtaggatggaattgagccaaggaaattagctcaacttgtggcagagacacagccctttctacccatgtggcctactgagattgggaggccagactgagggcctggcacccaaaatgaatgcccttctttccccagccaagaatcagggtggatgggtgagctccgtgcatttgccagctatagactgagaagggctgacccccttccactgctccagggcccccagccacctcctgctagtcctttcttcgctcctcctacttcatttcctccaactagaactttccctagaactctcctgcttttcccacagccccaccctttctcccagtctaactctgtcctgccccgaccccaccctccccgcccccacttccctgctgctccttcacaaagcgagccagtgtctttgtggtggaacccagtggcctaaagctgctttgtgggtggggattaagcctgaaacttttcctgagtctttatcagtccccttgcttcaatcctgaccctgggagtcagcccctcatggtccagcccgtcctccatccctgttggcacgtgtgcttgggtgtaggagagagaagactggggaggaagtaggcttgaggacacacctgtagcaacctctggcccacctgaagttctgatgcctcccttacccagtgctgggtttgaggttccccctgcttcgactccgctatgccagggctcgtggcctgcaggatcaagtttcataattcctggaaggccccagtacacgctccccacccggggatttcctccttggcctccacacttcattctccggaaacggctcctcgggtgccggtggtagacagcctgaacctgagagggagagctactggctgcggcccattcccaccccaccttttgcagctgcagatagtagggatcttggcagtcctagccctttgatgttgttttacaatacaggtagccctactggttccttagcctccctaaatcttagttcctcaactacaaa

SEQ ID NO: 84705 - DNA, 2239 bp, Homo sapiens
ctaaccctacgggcaaggagggccagggtctcaccaggagtgacggcaggccctgcttactctccctgccccatgttcccaaagcagcctcggggaggctggagggtggaatgaggcggactgctgtgatgccagcttctcagtcactgctctgggcctcagtgctctcccccactcccttccccacccacccactggcttccctcctcctcttgaaattatccattcaggacgatttacagtgtttctgttttctcctcttgcttccttaatactttcatttttcttctagttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccac

SEQ ID NO: 84706 - DNA, 1051 bp, Homo sapiens
tctgtaacaagacatctggttccaaagggacctcaatgaaggtcagcgctaaccatgctgggggtctgagtctgtccacccttgccccaggagggccacagggaagcatccatcaggatgtcacaggtgcaatcctgtgagacactcccttattgcacttagaaatgagtaaggcaaacaaactgacaaaaacaggatacattctcccacccacttcttgcttcccggacaaagatttggtctcccattagcagatgcacccaggctagtgtgggctgggatcacggcacacttaggccaacgtgcttcacaaggtttggggaatgtcaggtgacactacagctctctctcattctcccactaagaggcaaactcaggctctgtcaagttgcaggaagctatgaacactgggcagcgtctgttcccctggagcctggacttcctcaccagcctactttggtcgggttctgtactatgatcactacttgctttgggttttccagggcagaactcaacatgggggtaggacgagctaagttcttgatccccaaattcctttccggcaactggagacgagggaacatgttctgctggaaaaagctttttgcatgctcatattgtgcagcatgaaagatcaggactcttgcttcctaaccagcctcaaagacagaggacagggacctaagaaagcacagagaaaagaggattattgctgagtggcagcaccagccccaaagggaagaggaggagcagggacttacagagctcctcggggtcagacagttggtatctagggggtgactcaattctaggggccacactggacaattccctccaagtggagagttgactggggcgattttgtagactgcagagagattcagagcgggcaacaggagggccaagaagccacaggtgtttctaagagtagtaactagagattcagtgattgggacagggttactcgtatttgttaaattttcttaaatagagactggctgagccttgggtacctccatagtgctagagtgccctaacgatgggttactgg

SEQ ID NO: 84707 - DNA, 1135 bp, Homo sapiens
gagacccaactctgtcgtgatctctgtgacttttttttttttttcgaaacggagtcttgctgttgtttcctagactggagtgcagtggtgcaatctcggctccctgcagcttctgcctcctgggttcaggcgattctcctgcctcagcctcccgagtagctgggattacaggcacccgccaccatgcctggataatttttgtatttttagtagagacgggtttcaccactgttggccagactggtctcgatcttgtgacctcaagtgatccgcccgcctcggcctcccaaagtgctgagatgacaggcgtgagccaccatgcctggcccgatctctgtgactttggttaagtcacctaacctctttgaacctcatctgtaaaatgagggtgattctacagagctctcaggctggggtgaggattgaatgggataatacatgcctagtgtgtcgtgggctcccagtcaagttaactgttattacaaggcagaggctggaatctcctagctgcccatgatccagtaatgcccatctccagtaatgggagatggttactctcaactgtgaacctagtgactttcatgtattttttttccttcttccagaatgagtacatgaaagaagactttctgattaaaattgaaacctggcacaaaccagatcttggcacgcaggagaatgtgagtagtagttcccaaaagccccaggggtgaggtcttgagtctctgccttgtagcctctccagggctaccatggggtcctctctgtggtcctcttttgcctggccgggaaggcagtggcctctgcctagacctatcttaccagcatgggattgctatgtctctgatttgcaaaatgtgatctccggaactttttatggggccttctcgtactgcttggattggtgcagttcctggtacatgggagctatatctttaaaagaccaaaattacagttttctatagagcacaatttgcagtaactcccaaaaaataaaatacacctatcctttagcatttccatgcccaagaatttagacagttattttcacatgtgtgaaataacatatatacaaggagactcattgcagtcttctttgtgtagccaaagatcaaaaacaatgtaagaccatcct

SEQ ID NO: 84708 - DNA, 1037 bp, Homo sapiens
ctgacggcttccctttgccttcaggacgaagtccgtgctgtctgacataacttataggaccttttagccagcctgggcaacatagcaagaccctgtctctaccagaaaatacaaaaatgagccaggcatagtggtgtgcacctgtagtcccagctacttgggaggctgaggtgggaggatcacctgagcccaggaagtcaaggctgccagtgagccatgatcacaccactgcactccagcctgggccacagagtgagaccctgtctcaaaaaaaaaacaaaaaaatcttttaggatccagcttcaggtgtctccttgaattccccaccttgtacctgcaccggttactctgaacttgtccctcttttctccagcttttcccaccccactcccatctgtctcttagcttagccccactcattgtcccatgtgttggttcatcctgactttcctcgcagagcctgcccggtgcactgcatgtcccccactgtgttctcacagcactccgccacccagggccctgtgcccaccgcattatggcatgaacttacagtgttgtgcttggccttgtctagttacacgccccagtagaccggaaactccttgagggtgggagccacatctgtttggtttctctgtgtgtccccctgcctggacctagaaatactcgcctgaatggggatggcagtgagttcgtgaatcacagaggccgccccaagtgctccaggttagctctctgctctagtttgctcttctttcttaggcctgaggcactaaagctgatgaggttgccagagcttgccaaagactggacagattatctgttagaaaccaaggacggctgggcgcggtggctcacgcctgtaatccccgcactttaggaggctgaggcaggcagattgcccgaggtcaggagttcgagaccagcctggcctacatgacaaaaccccatctctaccaaaaatacaaaaattagctgggcgtggtggcgcatgcctgtagtcccagctacttaggaggctgaggaaggaggattgc

SEQ ID NO: 84709 - DNA, 1030 bp, Homo sapiens
tcttagaacctgccctctgattcctgcagctgaagagaaaccaaatgaaggcgattagtctctgcctggggtcccccttcccaagtggtaccactagctgggaacctcgccccctccaccaggccctctccccagcctgtcctttaggattgctgagtcagtggttagatgttcttacggctcttctctgaaacggagttactgctccttcttaggcacccctggctcagccaagccctgacccacctgacgggttttcatgtgtgcctagctgggtggtggacttggagaggcacagggacagcttggggctccaggggggcattgaggcagcactgatgcagcttaggattagcaaggtcaaggtgactggctttcacccatatgttcctctgtatggatttcactgagcctcgattgctgccccttttcatggcattttgttctgggattttgctttgaaagttagggctctttcagccttgtggtgagcagtgaattgtcctcgtcctctgcttcactttccagattttgcccagaaatttccctgcagtgcttaggaagctgcctggtagagcaggtttctaagtttgaggcgaagcagctctggaagctgcctctgtccttgctgttggaggcagtgatttaagtagcagttgcctagagatacatcctttctgttttaatctcaaagagagaaaaacccagtccctgtaatcccagctacttcggaggctgaggcaggaggcaggaggcaggagaatcacttgaacccaggaggcggaggttgcagtgacctgagatcgcaccactgtgcgatctctgtctaaaaaaaaaaaaaaaaaaaaaaaaaaatagagaaacacccttgtcttccccccgggggtgccaggagttgggcatagagctcgaggaaaccctttgtccccctccaccccccagcatgttgggtaatcccatagcttttttcctttttctcatactccctaagcagccatgcctgattagcaccggcagcggtaggaaagac

SEQ ID NO: 84710 - DNA, 1031 bp, Homo sapiens
ggggcctgtacgctgccgtgtaagtcctggaagccgcaggtggcctggtgggcgagggtgtgggaatggccggggggaggttgctggtgggactgagactctgaggcagggtcagcctgtcccagaagggctcatcttcctgcttcaggggacaggtaccagggtttctgctgggtgtttcagggaaaggccatacctcgtgggaagcaggtcagtgggcagacagttgggtgctcacaagccttggcattcaacacgaagtcagttcccccagccagggtcaggcacctgtgcagctcattatggcctcaggggccactacagccgagtcctggggctggccctggctgctcactgggaaggatgggtaggttctggctgcctgaagctaaatgcggaagttccagttgccctcatcacgggcagcaacatgggtgactgagtccagaatacaccagacgggcccatccagagcctcagtgcgcccagctctggccatagctttctccagccctggctaaaatgaaacctgtatctttttccaagaagccccagaaacataaaaggaaccacagtggttccttcttctctggctcaggccttgacccaaaaactgaaactcaaacatcatcatccacagtctctgatgtgggaccagctcatgtgttgctgggattcctttcccacctctgggccagcagagcctgacatgtgctaagatttagcccggaactctctcccaattcccgcaacagcccctggggtaatcccagctccgcttgccctccgcctgcccctccccaggcctggaggaagctgtggctgtcctggcagggtctgagggaggggggcgggatctgtggtgctgagtttccgcgattactcaatgcttctctggacgagggcactgcagagccaagcccagcctccacactcctctctgggcctgtttcccaaaccgcaggtccccgctggcaccacgctttccactcggctcagccagacacccacaggccctgggcacagctgag

SEQ ID NO: 84711 - DNA, 1093 bp, Homo sapiens
tgaccccggcaaggaaaataagaaaggtgcatatcggctgggtgtggcggctcacgcctgtgatcccagcactttgggaggcagaggtgagaggatcacctgaggtcaggagttcgagaccagcctgggcaacatgatgaaaccccatctttactaaaaatacaaacactagccgggcgcggtggcaggtgcctgtaatcccagctactcgggaggctgaggcaggagaattgcttgaacccgggaggcggaggttgcagtgagccgagatcgtgctactgcactccagcctgggcaacagagtgagactccgcctcaaaaaaaaaaagaaaaagaaaatatcagggggagaaggtggcatctgttctatgtttgagaaggcagctggacttcccattgaaggaggcgccgcagtctccccacatggacagaggagaaccaggctattggggtgagaccagtgcttgtgcttcccaagtggtctgggttctgcctccatactggctgcagtctgtccccacggacatagctgccgtgagaaggttctcaccagcctggggccccacagccaaggctgggccctgaggtctgccgttctagggtggcggatgctctcgaatgggactctcagcctgggcttcgttgctcttcaagggacacacaaagctcctgaaactgtggataaaccttggtgtgcattttctggggaggtctttattggatttttcaaagggtccatggcccccacaaaagttaagaacctctacattttcactccaggggacttgggccaaatggccatccaagcctgctgcggggtagcctgagccctcgagaggccgccagccagccctggcattcccagtggggggactctgaatgggcacctgcccttctgatctttgggaatccctgtcatgaccctgaggtcagggtttccttccctcttcacacagagaatgtcaccaatggcacagtgggcggcacagcagagccggggcacgaggaggtgagctggatgaacggctggctcagctgccaggcccaggacgagatgctaaatttggccttcactgtgggctcctttctgctc

SEQ ID NO: 84712 - DNA, 1044 bp, Homo sapiens
aagcagaaaaaaagtcatcgtccccagagaaagcttttagtgtctcacccagaccagagaactgttgtgggcaggtgtttttttgtgtgttttttttttaacccaccatgatgtcggaaggtcagattctaggtgttttttgtttgttttttgttttttgtttttttttaatagaatgtccacggatttaattgattgtatggttttggcagaattgggtctggtcctttcattcctgcctcaacctcagcttcctcctctgtctaagtgggaggagtcccagagattgtgccagcgcagtgctgagttggtgttttaagccctgggcagacttgacaggtaactccactaaaccaaagtgaaggtgaagggtcaggattgtgggttgaacatcaacttcttatcccgaacttttgctcctgcctccaattttggtttttcttattatctggcaaacatgctgagcccacgttctgggcgggaaggctgctgattccacacagcttatctctctggtcacactgctccttgattcttggagtctgcatcaccagttttctttcaggccagaaatccccgcatttggctcgtctgggagtgcctggcgaagttagggtgaaggtttctgcttcagtctaacattttcaaacttggtgcatggctgaattgcagagaagcagataggccatttttgaatttattgaattagacttgtgaaagcctgagcagtgtccggctgattgagatgcaaatttgtcagcttcgtgtcactctaggacgatgctttagtttgttctctaaagaaaatttgcctgaacctgttgaaaggttcttagaactctttcttacgactccagccagaatctcgccacagacaccgtgttgggttccagcctggtgaggtggcagaaggaaggaaacagctcatttctcggctgccccgcagtttgttcttccttgcctgctgggagacgtggcaggctgggtttggggacctgggtgcgggaagttggcaatgggttttgcacaacgtcctccaggtgt

SEQ ID NO: 84713 - DNA, 2112 bp, Homo sapiens
ctccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcaggtgggcctgggctccttgggaggaagtatggtggggcagggattgcaggccagggcccagaacagtggcctgagctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggcca

SEQ ID NO: 84714 - DNA, 1420 bp, Homo sapiens
cctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgctt

SEQ ID NO: 84715 - DNA, 1168 bp, Homo sapiens
aggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtggg

SEQ ID NO: 84716 - DNA, 1068 bp, Homo sapiens
ctggctgggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggctgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggtatgaacctcgggaagagaagatcgctggaggaggagcgggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaat

SEQ ID NO: 84717 - DNA, 1421 bp, Homo sapiens
cacgcctgtagtcccagctactcagaaggttgaggtgggagaattacttgaacccgggaggcggagcttgcagtgaaccgagattgcgccactgcactccagcctgggcgacagagtgagactccatctcaaagaaaaataataataataataaataaataaataatccgtgtattttccattagctccatactttaacgtagtcatacttttttactttacctaagtgagaggaagtggcccattcctcctatgggtcactgattctcttctccagcctgtatgtacacatgagcagagtgttgtcagcctggcgaacagtctttcttcctctgtagagttggcagcttgtcttgtttctggggctgtcattctcgtcttaacttttcttgacccttttatcctcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaaggtgagtgttagcagcagtgtataggtgcgggactctgtacatggctgtgggagagtaatgggctaagtgtgtacacatgctgggaagaaggcaggatggggatgtgttgtgtaggccatgctaacgaatgccgtcctcctctagacctttgaagggaacttgacaaccaagcccatcaacggagccatcttcatcttcaacccacgcacagggcagctgttcctcaagataatccacacgtccgtgtgggcgggacagaagcgtttggggcaggtgagcaggtttaaagatgaagaggctgtagaaccatgttgcctcttattcttggggtggacttggtaatatttactggtttattagatgaaaggctgagaacatctcatttgaacttatccccaaaataccttgggaagtattctgtgggaggtccaagagtgtatgaggtgcttcgttcccttccagctggtctgtttcctgaatttctaaccttgaacagggctatcaaaaatcatttttccaaaggcaacgcatactctttttttttttttttttttttagccggagtctcgctgtgtggcccaggctggagcacagtggctcaatctcggttcactgcaagctccgcctcccgggttcacgccattctcctgccttagcctcccgagtagctgggactacaggcgcccgccaccacgcctggctaattttttttgtattttttagtagagacagggtttcaacgtgttagccaggatggtctcgatctcctgact

SEQ ID NO: 84718 - DNA, 1180 bp, Homo sapiens
ctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctgccaccacacccggctaattcttgtatttttagtagaaacagggttttgccatgttggccaggctggtctccaactcccgggctcaagcagtcctcccaccttggcctcccaaagtgctgggattataggcatgagccatcgcgcccagcctcattgtgttttgctttctatttccctagtgactaatgatgttgaactcaaatctttctttagtagtagggataaaactaactgcatcaagtagtctccaccctccccgcccctggctcatctgtaatttacttttttttctactacctttagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggt

SEQ ID NO: 84719 - DNA, 1051 bp, Homo sapiens
agttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgagtggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacagggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaatctgaggaattttgaactacgtatatttaaggttttgcaaaatttaaaaagttacctcgg

SEQ ID NO: 84720 - DNA, 11346 bp, Homo sapiens
cccctgtgaactctactggttgtcttttttcctgctttatccctcgtcctcggtagacagtgatggttaaatgaatgaatgcatgaacaaatgactgtccaggagctagtactgcattgcatgtacacattgatgacaacagacatcgtacaatgcgcaatcttggcaaatttattcaaaccctttagacttcgctctctcacagtgcgacgccgggagcccatcacacgctgaggtctgtcagaggccccagaaacagcctcggaaatggaggaggcggggcttcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaaggtgaggcgagagtgtggagcggcgcgcgggccggaggcggggcgggtgtgcgcgcgcgcaggcgggtggggaccctccccgtttgggcagctcctgaggtgtcagctcccttgttatttccagttaatttttcatcaagtcattttaagcgcgtattatttgcaagcgctgatccagcgggggtacagtagtgacggagacaaaattcctgtccttacggggtttaaattacagcgggagagacagagaataacaaaaccttgaagctctgtaataaaaatgtcaggccgggcgcggtggctcacggttgtaatcccagcactttgggaggcccaggcgggcggatcacctgaggtcaggagttcgagaccagcctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctctcaaaaaaaaaaaaaaaagtcagatagtgatcaatgtgatgaaaggaaaaacagagtaaaatggtaagggaattggcaaggggtgcttcttcctgctggtgcctgcttctccctcacactcactgacaggagcttaccctagggcaagaggtgaagaggattagggggagggtgtgcaggcctttaaactgaggtgcctttccagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttggggtaaggaacatcctgaaataatttcatttggaatttggcccttttcccttctccctgtcccacagtcttggattgatgctttgacagctcatcttggtggatataagagaaaggagaaaaccagtaggagtctctgataatttctacatcttccacttttgcagtctgtttcccctctcttcccgatctgggactggtgctttaatttgtcctgttgatgatattataagatgtccctggccaggcgcggtggctcatgcctgtaatcccagcactttgggaggccgaggcgggtggatcatgaggtcaggagatcgagaccatcctggctaacacggtgaaaccccgtctctactaaaaatacacaaaattagctgggcgtggtggcaggtgtctgtagtcccagctacttgggaggctgaggcaggagaatggcgtgaacctgggaggcggaacttgtagtgagccgagatcacaccactgcactctggcctgggcgaaagtacgagactccgtctcaaaaaaaaaaaaaaaatgaaaaataagatgtccctatggttgagctggttgaagtccagagtgggatactgtgcatagtggcagcctgtcgctcctcagggacctgaattctgtgtttggggtatttaatttcagaggtttccctactcctgttttttctgtggctctaaactgggctagtacaggtacagatgtcttagcagattcctgttctatttggacacaaaaatgtttgccatgtaatgaactggaagttttgtttatttcaaaaaatacttagagaactgtgctggctgctggggatatagtagcgagcagagggtaacaatctccgcctttctgcagtgtgcggtctagtggcctgacagacatgagacaactggtgatagtgaagtatggtgaatactttattatgatttatgggaagatgcggagggaataggatgtgagagagccgcaaagctgtctccagagggatagccgttgatttagaggagctgataccagcattgtgggattatgacgtttaagaagagtggtgcaaggtgaagttggagagggagaggcagggtttctggttaggaagggcctgtgggctaagtttgggagtttggattgtaaggtaggactgtggaacatgaacatgtggcttctctgcatgggacaggtagcagaacacctcgtcatttctgatagccttctctttttctaatgtgccagtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtgagaaaggctgaaatatggtgggtggtggtggtggtggtggttgggaggcagtgggtagaaatggttgtgtgatgtcttgccttccaggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtgagtgatagatggagatactacacctgggaggagttctggaaatgcagaaggagtcctgggagatcagtaggtggtatgggtttgtctagctgcttacttgaggtgggcctttcattttttacctaggtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacagtgagttggagagattagggattttagacattttgagttgaatgaaacgtaatcttgatccttaaagtcctgatataacttccaaattagtctgtttacaccaggtgcagtggctcacgctgtaatctcagcactttgggaagctgaggcaggaggattgcttgagcccagaagtttgagaccaatctgggcaaaatggcaaaaccctatctttaccaaaaaatgtagctgggcgtggtgacactcacagcttcgtgtagtctcagttacttgggaagctgagctgtgggaggattgtttgagcccaggaggtcacggctgcagtgaacgatgatcatgccattgcattccagcttgggtgataagagtgagaccctgtctcaaaaaaaaaaaagtctgcttattcttgatgttgtaccctagggatgaagactggaatgaattcaatgatattaacaagattatcatccggcagcctatccgcactgagtacaagattgcttttccttacttgtacaacaatcttccacaccatgtccacctcacctggtaagagacctggaacacaacatttggaaaggagaaggctgctgtttaggttgggccagggcgggaaaactttggctgactcttcctttcattttaggtaccatactcccaatgttgtattcatcaaaactgaggatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggagatgtgttttccgtcttgctaagtgttccccttgagctataagcgaatatgagaattcagcatttgctttaaaacatgtcattggtataatcctgttttctgtgattatccttttggactttacggttcttttcttgggtgctctagataatctgtcccggtctgtctctattgtgtttgtttgttttagcctttatattgagatgtagttaacataccatacaagttatccatttaaagtgtgtaatttgatggtttttagcttattctcagagttgtcccaactgtcacgacatgcaatttgagaatatttttattacttgagaaagaaacccttagcagttactcgccatttctccccaacttccttacgcaaccactaatctactttctgtctatagatttggctattctacacatttcatatgatagaatgaaatagaatcgtacactatgtagtcttcagtgactggcttcttaagcttaccataatgtttttgatgctcatctgtgttccgttgtgtccaagcccagtgtttggagcttgggtgggagatgattgcaatgttgacctcctgtgatgttggggctccattgggaggctttctggtggtcagccagttgaggtgtgagaagtgacgcttgctttcctggtggccctgtcttgttctttgctgtcttggtttcctttgtgctggcacttcagggctgcttttgtcagacagcccagtttccatagcagatacaggctttgtgcttggccccagagaatttccctcatcttaagtctgtgcctagttcagcaggagctaaacccttagagggattcctttttcagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttttccaggtatcgggagcattgtcctgccgggcagcctgtgaaagtgagggtctcctaccagaagctgcttaagtactatgtgctgaatgccctgaagcatcggccccctaaggctcaaaagaagaggtaaggtgccccaggggccctgcgcagacttctgttccagagatatcagtaggctgactcttactctccatgttcccacctcaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcacgttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggaggaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgcttgggatcgtagggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagccgggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggcgtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggtagaactttcatgagatcgccctgtgaggaacggggcaggaatttagttctacgtcaaaaatctcatctgggtagcatgattggtttactctcttgatgcgtggtagtaaagggaagtagtgttcgtgttaaactgaggaaaagcccatagtcaaagcaatccaaatgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctacttgggaggctgaggcaggagaatcacttgaacccgggaagtggaggttgcagtgagctgagattgcgccagtgcactctcagcctgggtgactgagcacaactccgcctcgggagtggaaaaaagtagaatttgctgaggggagaacaaaagaggttaactctggagaatcctggggcatggctcacattcttaagaattgtagttctttctttctaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttcctggattcctagccttgcagggtactgaggcatgtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgggattgcgccgctgcgctccagcctggggaaagagcgagactgtctcaaaaaataaataaataaaaataaaatggaatgaagcccggggagggtgggggtaggatggggtggggtctccgtctattgagctggaggac

SEQ ID NO: 84721 - DNA, 1328 bp, Homo sapiens
tctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggag

SEQ ID NO: 84722 - DNA, 1046 bp, Homo sapiens
atctttcttaccctctgagtatagaaattccaaggcaagaccgccttggcccctcagcctggcgtgggccatgcccttggactgagtgtcagcacggacccgccctccccagctcacatcccccgagcctgccacgcccccagccccctccctgggccatgctgcagggcccggcttttcctgctgattcatgcgttggaactgtgggggcggggcttggaacttggaacaaagttcagacatggaggggccggcagacagcctggaattcataccagatgtacccggaatgcgcaagcggaatgcctggcatctgagagtcctggggaagctgcccagccaccctgcccatacctccctcccctccagcctgtggtcccctgcccgcccctcacagccccggccaccctgccgatacctccctcctctccagcctgtggtcccctgtccgcccctcacagccccgggggcctctgctgaccttctttcaaacgctaggcctcctcccttcctcactcttccccaatccaggcccccagaactctccttccagctgaactccctgggaacaagtcagttgggctgatcactgaactcacatttctggacctgaggtaccacacttctagtacctgcgtgctggtggggtgtgtccagggtcccgggccccaccctgtctgaatgctgaggaggctgggcccccaggggccgctagggcaggggagggtgagagcaggactgggtttctctagactccagttctggaaagaagagcaagggaagtctgtttacagccacctcttgctgctcagcgaggttaacagcttccgcgggcccagatcagagctgcagccctgcattagaatctcagaggtctactggggcaggaccctgatggccagcgagtgggtcagcgttgcagcaacatgccctgctcagatctttcccattttccctccctttcccttaggagcctgttcctctcacgccctcacctggctgagccgcagtagttcttcagtggcaagctttatgtcctgacccag

SEQ ID NO: 84723 - DNA, 1021 bp, Homo sapiens
ccctttctccacagttctcccctgtgagcgccatggagcccttgggccggcaggtactggggagtgaggagcctgtgatggggggaaggtcccgggggtctcactggtggcttgggcagggtggggggcctgtgggaagggtcggtctccatctgcttgctcctttccgcagctaactagcgggccgaaccaggagcaggtgtccccacttaccctcctcaagttgggcaaccaggtacaaccaggtggggctggggaagagtgggcggggctagagggaggagggcccatcggcaggggtcggggggtgggggcgcgtgctgaggctgaggctctggagtccagaggccagaagggagagagggtggggaggaccgaaggtgggcgccaggccccagaatgccagtgccctccgtctgacgctccctcttccctggggctgggacaaggccctgctgtcctcaggcacaggggctgtgacaaggccttcaacacagaacctggagctgaccccttgacctccctgacccctgatctgtccctgcaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcagtactccaatggttctccgcgggcggttcctccaccagggtcacgtggctgtttggtaaaaatgcagattcctaggccggggcggtggctcacgcctgtaatcccaacactttgggaggctgaggcgggtggatcacgaggtcaggagttcaagaccagcctggccaacatggtgaaactctctctactaaaaatacaaaaaatttagctgtgcgtg

SEQ ID NO: 84724 - DNA, 1063 bp, Homo sapiens
gaaacacatgtattggcttgagttgatccgcctcacgtggaggcaagatcacaaaagcttctgtgtttcttgatgtgggcaattgtcagaaaataaggcctgaccttggcccagcagggagggtatctacctctccctgagccctcccccgcctgctaggacgagagcggggcttggatactgccctttggacaggatggcatcattgtctgtggctgcagccagccagcggtcgcctgctcagcccatgagcaaccactgtggacagggtattgcgtgtgtgctgaggggcgtccatgcagacccccacgcttgccctctcactgcccttgtagggttttcaatcatctctcctcttcccttatccagatggcttgaagtggaggattcagacttgccgttaatactctgggtccctgtgtctagctcggggccacctttggacccatgtcccttccctgccaggctccctcacctcacctcagcctacccacattgtgacaatcatctaccacctgatctggggtttgggcttagattctgtaggcaccaagactaaagtcgctccttcaagtccatttgaattgtgactttagtttccttaaatactatgccaggataatggccagggatggtggctcacgcctgtactcctggcactttgggatgctggtggatcacctgagatcaggattccaggccagcctggccaacacggtgaaaccccatctctactaaaacataaaaattaaccaggtgtggtggcgggcacctgtaatcccagctactcaggagactgaggcaggagaattgcttgaacccgggaggtggaagttgcactgagctgagatcgcgccactgcactttagcctgggcgacaagagtgaaactctgtctcaaaaacaaaaaaaactatgccgggatgagcctgtctcctcccttaatttcttacttgggccagaggaactagaactaacaacttctcttctagccttgcctcctgtgtacctcactgaatttttggtctctaataaaccagtctgcagaggctcaggggaggcag

SEQ ID NO: 84725 - DNA, 1107 bp, Homo sapiens
cgtctcaaaaaaaaaaaaaaaagtgggtcataggtttcggcttataggtcacaagtgtttaaacctggccatgaggccaggcgcagtggcgcatgcctgtaatcccagccatttgggaggctaaggcaggaaaatcgcttgaaccggggaggtggaggttgcagtgagctgagatcgcgccactgaactctagcctgggtgacacagtaagactctgtctcaaataaaaaaaaaacagctgatctctcttctgcgctgtctctccacagagagctcatgcgtgatcagggagtaaaactcattcccgttttaggccaaacacagaaaaattaggaaggacagccccaaggggccagaaccaccaccctacacaaagccgtgaggagacagtccctgtgcatctctgcgagtccctgaactcaaacccaagacttcctgtctcctgccagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggtgagtgctcagatgcaggaagccccaggcagacctggagaggccccctgtggcctctgcgtaaacgtggctgagtttattgacatttcagttcagcgaggggtgaagtagcaccaggggcctggcctgggggtcccagctgtgtaagcaggagctcaggggctgcacacacacgattccccagctccccgaaaggggctgggcaccactgacatggcgcttggcctcagggttcgcttattgacacagtgacttcaaggcacattcttgcattccttaaccaagctggtgctagcctaggttcctgggatgtaactgcaaacaagcaggtgtgggcttgccctcaccgaggacacagctgggttcacaggggaactaataccagctcactacagaatagtctttttttttttttttttttctttctgagacggagtctcgctttgtcgccaaggctgg

SEQ ID NO: 84726 - DNA, 1056 bp, Homo sapiens
gagaagctgtccgtgccttatccaacacaggtaactaagagttcttatgaacggtgacttcctgcagtgtttagataaaaccaggctagaagtagaggaccaccaaattcctcaagagctgtttctcttcatatgatatttcgcatagctcaaaataggaggaggaacgaagtaacagaagttagggataaagctcttttattgtatgcattgaaaccttacaggggcagccttcgtgtcctgtggaatctgctgtccctcgggttttcttctagggtattggaatattaaactgggatattaggggcccctggggtccagaatcttgccaatgaagagaagggcccctgtgtctgtgtccctcagtacgaagatgaaaggctggttaaggtgatagtccagcgggaaggtgaggtgggcaggctgcagccctgggctgggggtggttcccgccccatcctcgttccactcaaagccagcccggtgttccacctgagtcagcttgatgggtttgcctgtgatcttgctaaagtctggtgaatcaaacaaggattgcagctctgtagagatggagagagatttccgttaaaaccctgccttccccaacaccccaaccaagggatccctttgcaagcaagctgggatggcgcagcactgttgactttctctgaggcctgaagaggtctgagctgaccgagggtggagtgacttgcccaggagcatttagcaagttaggtcaagatgagaaaacaggtcagacagactcgtcttgagaggcagtgttgtgagcgcctgtcagggaggtctgctcgtgaggctgaggaatgagtctgatgagagaaggcagttcagccttcccttctggcacgatgaggattaaggactcatccacggcccccctacaagcctgtggagcccttgcgttctgcttagcacagtggaaggcccaaagaccctgccccaccccatccacccaccaagagcgaaagggtcttcagacatactcatctcctgcagggacttggtgacttcgccttcataactcagcttcagctt

SEQ ID NO: 84727 - DNA, 1049 bp, Homo sapiens
gaagggaaggctgaactgccttctctcatcagactcattcctcagcctcacgagcagacctccctgacaggcgctcacaacactgcctctcaagacgagtctgtctgacctgttttctcatcttgacctaacttgctaaatgctcctgggcaagtcactccaccctcggtcagctcagacctcttcaggcctcagagaaagtcaacagtgctgcgccatcccagcttgcttgcaaagggatcccttggttggggtgttggggaaggcagggttttaacggaaatctctctccatctctacagagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgttacttcgttcctcctcctattttgagctatgcgaaatatcatatgaagagaaacagctcttgaggaatttggtggtcctctacttctagcctggttttatctaaacactgcaggaagtcaccgttcataagaactcttagttacctgtgttggataaggcacggacagcttctctgctctgggggtatttctgtactaggatcagtgatcctcccgggaggccatttcctgcccccataatcagggaagcctgctcgtaaacaacacatggacagataggagaggccatttgtaacttaaggaaatggacccgatacgtaaagattctgaacatattctttgtaaggaggtatgcctattt

SEQ ID NO: 84728 - DNA, 1037 bp, Homo sapiens
tcatcgctgacatccgtgagctgtgtgcagttccagaagttgagtgtcatttattttaattccagggcctagtgatgtaacttcctagaagggcggttcttccctcctcagagctagtctctgctagagagcagtggggcgtgagcccagctgataggagtgtcttgcttttgtctgagacttgcggagctccccattgcccttgaaaaccctgccttagagcttgacatcatgggatttttatttaccctgctttatgaaagttgacctttagcttagatttcagggtcaagagaaatcatggccgtacgtgaaaggtagagttggtcgagttgggaagttaatgttgaaaatacagtgtaaatgtggggaggcctcccctagcgcctttctccactgacagagaaaacagaagaaaacagcagctttattggaacagacattgtgcgttggtgacaacccagggaggccagggggaatttccacattcagcccagctgattcagaggatttgagacctggattctcattcctaggactgggcttctgtctatagtgagacgtctttcctctgcattgacagagcgagctgttcagcggctgtcggggtgccagcgtgacgccgagagcttcctgtgggcagagcacgccgtggtgggagagatcgcggatggcctggcccgggcctgtgctgccttaggtacagcatgagccttcacgttctgcgtcgggaacagtctgctgtgggcacttcgccgtggccccggccttgtctgcctggttaccccccgctctgtaaactgagggtgctccccctctcgttccatttcctccccctgaaaatatgcatccacagttgacagtggttcttttctggaacaagatttttctcttctcacaggagactggcaaaagtcagccacccatctacagaggagtctctacgtggtggaggttcgccacgggccgtccagtgttgaaatgggccatgagctcttcaaattggcccagatctttttcaacgggtgagtcccttt

SEQ ID NO: 84729 - DNA, 1086 bp, Homo sapiens
caaaaaaaaaaaaaaaaaaaaaaagaaattctgctgatcatttgagcccaggagttcaagaccagcctgggcaacatggcaaaaccccacctctactaaaagtacaaacattagccaggcctggtggcacacatcctcccaattagtgccagctactcaggaggctgaggtgggagaatcatctgagcctgggaagtcaaggctgcagtgagtggagatggcaccacggcactccagcctgggtgacagagtgagaccctgtctcaaaaaattctggtccctgtgtctctgagactatgagatttctttcctctaatcacattgcacaatgtacatatcctcatgtgtgtgaaatgttttgcgggcccactttcttgttttgagggcaatggtttagagctttccttgaaataacacatttctgcttactttgtttcctcctttcttcatgcagacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaaggtaaaacactcccagctcaagcaatttattatttatttttctctgagacagaatcttgctgtgttacccaggctggagtacagtggtataatctcagctcactgcaacattcgcctcctgggttcaagcgatcctcccaccttagtctcctgagtagctgggattacaggcatgtggcaccacgcccagctaatttttgtatttttagtagagatgggttttcgccatgttggccaggctggtctcaaactactgacctcaggtgttgcgcccgcctcagcctcccaaagtgctgggattacaggcatgagccaccatgccctgcccagcccagcaatgtaacaatgcgtgtttcttcaggagatggacccatattgctaaattgtatagccagtgttatctttgtctataatttattgaatggatttgaaaaagaaacctggcggaattctgctgtggttatagtctgaaacaaaaggtagttttt

SEQ ID NO: 84730 - DNA, 2047 bp, Homo sapiens
ctctgttgcccatgctggagtgcagtggcacattctcggctcactgcaacctctgcctcccgggttcaagcgattctcctgtcttagcctccctagaagctgggattacaggtgcccaccaccacaccctgctaatttttgtatttttagtagagacagggtttcgccatgtaggccaggctggtcttgaactcctggcctcgagatccacccaccttggcctcccagtatgctgggatcacaggcttgagccactgtgcctggcctaatactttgtgtaaattccatgaggcctgcaatcatgtctgggttattttactctgcattgtatccccaatacctggagaagtgctggcaagttttaggtgctgaataaatgcttgctagttgcatgaatgaatgaggcagtgggaagaaagggacaggtgaatggggaagaaaggcagcttgggggaaaaacaggaacaggaagaactattgttggactcaagtgaatatttaaataaattaggaatgtgtgaatgctgaaaccggggaagtgattttaaattgtagctttcatttactttatagctgctaccttgtgtctttaagacaaattaagaatgtttctaggccaggcgcagtggctcacgcctgtaatcccagcattttgggaagccaaggcaggcagatcacctgagattgggagtttgagaccagcttggccaacatggagaaactctgtctctattagaaatacaaaattagccaggtgtgggggcgcatgcctggaatcccagctacttgggaggctgaggcaggagaatctcttgaacccgggagatagaggttccggtaagccaagatcgcaccattgcactccagcaacaagagcaaaactccatctcaaaagaaaaaaagaaaagaatggttcttcacttttaaaaagactgatcatgggccaggcgcagtggctcatgcctgtaatctaagcactttaggaggccaaggcaggtggatcacttgaggtcaggagttcgagatcagcctggccaacatggggaaaccctggtctactaaaaatacaaaattagctgggtgtgttggcgtgtgcctgtaatccctgctgcttgagagcctgaggcaggataattgcttgaacccgtgaggcagaggttgcagtgagccgagattgcaccagtgcattccagactgggcgacagagtgagactgtctcaaaaaaaaataaagaatgatcatggagatatttaaataatttgataagtttttttattttttagagatggggtctcactctgttgcccatgctagtctcaaactcctgggcttaagcgatcctctcgcctcagcttcccaaagtgctgtgattatagatgtgagccactgcacctggccatgtttttatattcaaaattttataaacctatttccagcgtaggtgaagtattttgttcataaatgaagaatgaaagtttcacatgtgtttgtggtgatggaatgagttggagaacctttgctgactttcattatcagctaaagcaggtatcattttcgttcaaaagacacaggccacaaagggtacgcaaataccacacacatgtgaaggcgtttgggcaagagtcacatgataaaataagagatgatgcatagaactcttgtggtcaacagaatacatagcatttgtatcttaattatataacgaaaggggaagggaactaatgtttttgactatttctaatgtgacagatgctttagtagtcagtacttaagtaaccctagaagatagctattatactcccattttacagaggaaggaagtacagagaggttgaataatgtgtccatggggtgaagatttgaacacatgtgcccttgagtattacatttgttgctttatatacttactagggattttttttttaaagggtctcactctgttgcccaggctggggtgcagaagcacaatctcagctcactgcaaccttcacctcccaggttcaagtgattcttttgcctctgtctctcgattacagacgtgcgccac

SEQ ID NO: 84731 - DNA, 1622 bp, Homo sapiens
ttgcagctgtcagagagcattctaacaatagactggaggtagtggaaagctgccacttggcttaattaattttccctaactggtgttctgtgttttctctgattaatttccctaaggatgatattgacatcgactgagtgcgaggggtcagctgccctatactttccttttctggggttttatttctgtgttggaagctgtaaaggggagaaaggagagaatttttaaatgattttggccactttaacaaattcacacatttaagagtagcagcaaatgtttaacaggcagcaaaatacacagtttttcactctgcagagtctgactagttttaatttcaggagcatatgtaaggcatttttctttgctagcacaggtatgagtagctctcagaggcttaagactgcaggattttggaggctaaagaaatctctgtggttttcagctttcatgttggcgacacagttgaaccctctcgtggaggaagaacaattgtccagcaactgtgtatgccagattcacagatttattgtgaacactctgaaagacggaaggtatgtgctgtgtttttttctgtcttattgtatcgtagaatgggaacaaatttaggaataaaaaaggcaatagtgagttttcagctaagaatctgcagcttttcagttaagaactcaggtagctaacacatggcacccaaggaggagaaacatggaaacaagttggaaatttcagagcagaagattaaagtagaatgcagaaatcttgttatttctaatttcttcagaagcagcatttttaggatttcccccaaaagaatcttatctcttttgtttgtttttggtagaaacggggttttgccatgttgcccaggctggtctcgaactcctgagatcaggcaatctgcccacctcagcctcccaaagtgctgggattacaggtgcgagccatcatgcccggcctcaaaagtatcttttaatgaaaagaggtactttattttacagcagaaaatgataattattttgtaatgctgctttgtgtgtgtgtgtgtgtgtgtgtgtgtgtgtgtacaatcttgaatcttttatattaaatgctatatttagccaatatagaatacattgaaccacatgtggtggctcatgcctgtaatcccagcgctttgtggtgctaaggtgggaggattgcttgaggccaggagtttgagaccagcctgggtgacatagccaggccctgtctctacaaaaaaaaaaaagttaaattagtgaggtgtggcggcacacgctacagtcctagctacatgggaggctgaagtgggaggattccctaaccccaggagtttgagactgcagtgagctgtgattgcaccgccgcacttcagcctgggcagcacagcaagaggccatctctaaaaaaataaatttaaaaaaagaatgtgttgtacacggacaagttactgcatgctagagatacagtgatgaacagaactgttactctcattgctaaaacatgactgatttcaggcaaggtgcagtggctcacacctgtcatgccaacactttgggagaccaggtagggaggatcacttgagcccaggagtttgcaaccagcctggacaatatggtgag

SEQ ID NO: 84732 - DNA, 1032 bp, Homo sapiens
ccaaaaacagcagtcagaccatttaaagtctaaaacgtgatgaatttgggtagattattgcttaaatattgccctaggcctgtttcttcagctcccttgccactaacctcattcaggcctctgtcattttgtctcttctcttggtctccctgcctccagtcatgttcccattaaattccttctttttaaaatgcagacattgtgatatgctcatcaagtatgtattgagcaacaactgtgggccatttgcttcattaagcactgagggatacctgtctttattgacagtacagtctagtaggagcgagagagaataataaaataatcactaatgaacatataattaagacggagcagagtgttctgaaggaaagaaatcaaggctgtaggaaagactagaacaaagcaacctgatctcaactagagattaaggaagtgtctcttgaagtgatgtttgagacgagagctaaaaaatgagtattagatgaggcaaaatgagaaggaacacaacaccgcaatctcagagcatcacggacaaaggccttgtggcaagagggactgtcccatgtggtggaactgaaagaaaacaggaaggccagagggcagagggcagagggcaggcagcggcacgggaggggggttagcaaggccaggccaggcaagccatggcccaggtttttctttgtggcctaaggtcattgggaagttatcacaacgttttaattagagttaaaaagcaaaagaactgtaagttcttaaaaatgggtcattattacattttttaaaatatctattgtcataattggttttcactgggaaaaagtcattgttgagataagtatgtgtttctgaaaacagttcatctctttttatgccatatattcttgtgtttagtaatctaaattcttaccatgtcggttggctccttgaagatacggtgcgtagcgagaacactgcattttaattaaggaactagttgggaactgaaaaccctgcaatcacttgataatgatgcggcgaaagatgaagaga

SEQ ID NO: 84733 - DNA, 1055 bp, Homo sapiens
gagttgagatcgcgccactgccctccagcttgggcaacacagcgagaccccgtctcaggaaaagaaaaaagaaattgtctgatatttatagaattttcaaagtgtgagaaataaaacttcagacataattcgtgcttcatactatattgaattagatgattttaaagtctcccgtatttaccactgtatttttgtctgcgtatataagttccatgcacctatactatggctaacaatattttactttgactaaaatttgttacacaatacttaattattagtgttacttattattgaaagacattagttgaaatttctttcagcctgatttcatccattttctgccaagaggcaattgtaaattattggattgactcttctacatattgtttgtagttgttaagaaagtacttactggtagaagttgaattttttgttgcccttattctccattgtctgtttagcgaatttttctctgcgatggctcacttaaccattataatgataaaaatgataggtgtgagtgcaaataatttgaggtgctaagagtctgctctgaaatatcctgtttcggccgggcatggtggcttatgcctgtaatcccagcactttgggagattgaggtgggcgggtcacctgaggtcaggagtttgagaccagcctggccaacatggtgaaaccctgtctctactaaaaatcacaaaaattagctgggtgtggtggccagcgcctgtaatcctagctactcgggaggctgaggcaggagaatctcttgaaatcgggaggcggaggttgcagtgagccgagatggcgccgttgcactccagcctgggtaacaagagcgagactacgtctcaaaaaaaaaaaaaaatcctattttccccctaggtcaaagccagtgatatgtaaagctagcatagagcaaaagagtctgagaaccatgatgttgacctgtcttattagaatggtttgatttgcaggtgacacaaagcagaagatgtgtcagaagttaagtctctgcattactgctttggggtgtaatttaatttttagaa

SEQ ID NO: 84734 - DNA, 1629 bp, Homo sapiens
ctctaatggcacaaccacctctcatttagttgtgccagttaagagtaatattggcagaagtaaattaaatcagtgtgtaatgtgcccgtttgagttaggaccttggaaaacgcagcaggaatgcgaactcagcagttggagaaggcagagacagggtggcaggtgggaagccctcccagccgtgggtaccatttttgttctcagggcactctaggaaagttttttgagttgcctttgtgtgctgcaagtacccttggtgagctgcccacatgaggttgacttctgccttttagagccaatcactaaggcaaagtcaaattccataaatctgttatttcacaaaatgaggcatattttacagttttaacattcttcagctccatcaacatttgtgtaaagagtgatggcaaatacatgctcttatggtggcatttcttattttctgcttgagacacgctcatttccccccctttacttttaatcttcctgtttccttgacacacctgcttccgaaccccattgtcatctctccccgctgtgacagttcaccagcacttcatggtactggagactctttcaacttgccttttccaccaactgtcagttgcaaaataaggttgctttgtttgggagggagagggtggaatcctttctgaatgtctcctgttcctttgaagcaggagcacttcagagacaactgaactgcttttaggtttttcttaccacccagctttttcttctgattgatcctgccgtgaacacacggttctgttgatgacatcgatttgttgctatggaaatagtggtaatgtcacagattcaacccagtgactttactgcaggttgttgcaggagaaatgggcaaggctttaggggagaacctcattaacactgaaggctatcaattctaagcaggtgaaaggtagatggagccaaccttttgtgtaatgaaaacaaaaagtgaacccctagcaaattcaccgagtgccatggaatgcctcagcacgaattctaatccatgggagtctttgacaaaataaaaaatttacactttcccagagcattccttctacccaagtttaaatctcttaacccaaatcctttgcactaaaacggggtttcccttttgatcttcaggactcgggcagccgcaagtagctcctccagcgccagcagccagcccagcagcaagcagcaggccccagccgcagaatggaagctcgggaatgggtgagatgcctcacggggcgtgcgctgaccaggggtgtcagacttcggaatcatgttttgaagttgaatctgggactaaagggagttttccaaatgccattcattacagggttgtgtcttggaaagaataattctgattcatattttagagtatgtgattgaaaaaataattaaagattgtctttttttttttttttttttttggaagtagggtcttgctctgtcagcggggctggagtgcagtggaagcatcacagctcgttgcagccttaacctcccaagtagctggtactatgggcgcatgccaccatgcctggctaatttttttgtagaaatggtgtcttactatgttgccctggctggtctcaaactgccctggcctcaagcagtcctccgtcc

SEQ ID NO: 84735 - DNA, 1059 bp, Homo sapiens
tagctggattaaaatacaggttggaaaacggaatatgcgtaagacgagaaaggctgtaggaagatgatttcttacttgatcttttccaaggaagaccccatacactaatatgatcgatttggtttgtaggtggaccatttgtgctcgtgttaccaacaaaagtcagatccgtacctggagcaactcccgaggggaagggaagcttttctccctagaactggttgacgaaagtgtgagtgtttgtcatgctggggagtgagggcagtgggctcgccgggaaacagaaggctcagctctgcggagggcagtgggctcgctgggaaacagaaggctcagctctgcggagggcagtgggctcgccgagaaacagaaggctcagctctgcgggcctatgaggtgaagaataatagtaggccagagagaagcatgattgttattgtgcttttccctctgtcatagtcttttgatgctgtctggagtagagggttaaggtcataaataaaatctttgatcttaaatgacagcgtttgtagcagtagaaagtagttttctaaatatataagtagcctcctgggcaggagaagctggaaacagtctgatttgctggcaggtgtactggaagcactgggaggtgatgcctgcttgtgagcgccgtggagctttgggacacagcagaaggcacacagttgtgacctcgatatgggagtggttttgtgggaaatgggttctgactgtgcagattctctatttgctttatttaaactaaacaaaaccatgacgatgagacaaaattcctatgccatggaagtacgacagtcttgatagctgttaatcagtccattcgttttgctaataattcctgaaattgccgggtgtggtggctcacgcctgtaatcccaacactttgggaggccagggtgcacagatcacttgaggtcaggagttcgagaccagcctggccaacatagtgaaaccccgtttatactaaaaatacaaaaattagctgggtatggtggcaggtgcctgtagtcccagctacttgggaggctgaggcaggag

SEQ ID NO: 84736 - DNA, 1437 bp, Homo sapiens
aataataataattcctaaaatgtacttcagcattcttttcaaagtgctgcagatttcctgtttgttcagactcccaaatagggagaaaaaaatagatgttttttttggaagttgatataacacccaaaatgtttgtgtgatggcagaatcaatattagaacctaatttttttttagaaattattgctctaatgtatggtggttggctaaaatttcttgtccacttgtaaattttggctgacagaaaagcaaaagtgaaaatcagatcacaagcaacttgcaaacatgacttactctgacatttttggcaatggctccgaatgtgaagtggtttgtcactgagagggcactgtggagggagccggtgaatcaccccgtggcagcaccttcctcgtgggctctgggcgtgtccctcagtattcaactttttttgtttttattgtcagaataaattaaactcgtcattgccgttttgttctgttctgtttctcagttgaggctaatgcagcatgattatgggatcggctagctgaaattctcattcttcagcggggccagtgacttcagtgtgtgactgtaaaatgcgggttcctgggatgtccgtagccctctctggaccctgtttgtgcaagggccactgctctcaagatgtcactttggtgctagggtggcctgtgttctatcccagtgtcacttgggtgctggggtggcctgtgttcaatcccgcagccctaacctgcccacgtgcttctgcagggtgaaatccgagctacagctttcaatgagcaagtggacaagttctttcctcttattgaagtgaacaaggtatggccgtgctgactttagaactgacaccgcctgggggtggagtgcggatgaaaagacgctggcccaggggaggggtgtgtggtggcagactaggggtttctgtccgatttgatggtagtctcaggttctgtggcttggcctccttcgcaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtaggtaagctcgtgtatgagaaggaagagcagggatgactagctttctttgcagtgtacggggtggtgtcaggcttcagtgcttgccgttcatcatttgctggcgtcggaatgggagtcttgaccacctcctgctaacacgtgcatgtgttttagacatcatcgggatctgcaagagctatgaagacgccactaaaatcacagtgaggtctaacaacagagaagttgccaagaggaatatctacttgatggacacatccgggaaggtggt

SEQ ID NO: 84737 - DNA, 1519 bp, Homo sapiens
acatgctttctttctctgtcaagtctttggtgccgatcacatcttctagtgtgtattcactagactctgatcaagtgtggtgagaacaatgggctttttgttaggattagattgttattcccaaagcactcaagggatgaggagagcctgttaaaatctcctcactgtatctagctttttaggacattcaaactctgtcttaaaagagtacttcaaactgagacacaggatgcaagaattgatgtggtcagggaaaacactttcacccaagcttcaataattcccatagctgtagtctatgggggggaagtgtgtcagtttccagctgtgtcttaggatttaagcagctaaagaatgagctcattttacatactcctcctttgttttgagtcatttaaaccaatggcactggtgtttgaccagtttcatgaagcatcttctggaatgttcatgtcactgagccatcctcatgagtagtacggtccacacgtatctgccgaactgcagggcccgttcatagtctgaccagaactagccacagatttgcttttttcttattgcttgattttcttttaggctctggagttcgactccaggttaattgcattcccacattaaaatcgcattcccacattaaaattgcattcccacattaatgtcttcatcttttacttgtcaataatcatgatcccagtcaacataaaaagcacggctgtccccagaataaaataacttggcattgatcaaagacaagctcagtgcatacatgatacctggacaaggattagagatgtttagatcttggctataacaatgcagagtttttattgtaagaagggccgccttgactcctgacgagtgatctttggtggcaaatgtctccttggagcttttgaaaccgtgaacttgtgtagctagtagtggtgaaacagatggatgggccttgctgtgcccctgtgagggatttagccgcttacctgacaggagaaggcagctgtctgcagctcagggtaacatccattctgttagatggtctctgtttaaggaacctgttctttgtgtggttacccaccttgggatggtatttggcctttcatctccggccagctcctctccgccaccactgtgttcccgagccactttctccttggccccttttccttcatatcaattgatgtgtgatcaagaagtacaatcagttttcataataatttaatacaaattaatttagcttcgatattagcaaaagtaaaatttcactaagaaggtaaatctacaagaaaaaagataatgccttctgataagttgctctggtttataaaatcttttgggccaggcacggtggctcataccttaattccagcactttgggaggccgaggtggacaattgcttgaggccaggagttcaagaccagcctggccaacatggtgaaacctcgtctctacaaaaaatacaaaaatcagccgggcctgtagtcccagctactcggtgcgtgcctgtagtcccagctactcggg

SEQ ID NO: 84738 - DNA, 1291 bp, Homo sapiens
ggcgacaaggtacccagcattcctaaccaccttcacaaagggctgtaaagtgtgcagaaggatggatttagaaacttggtttccagcaccagctgtcagagccgtaattcttacccggggctgtgacctgagcgtggcatgggggttgagaatcactggcagagggaagcagccaggtgtgctcatgggaatatgtgttacccctcaggggactggaggcaggagagtctgaagaactcttagagtcaattcctagagggatcttggagcaggggtgacagtcaagctttgtggtataatatcacctgctttcgggtccacgtttctttcctgtgatccttcctgcaaatttaagcgcccacatatcaaaaagatgttttttgagatgagcgttagtccgcctcaggtcagacatgaggcagtttcacgggtgctgttcctggctgtagaatagtgtattaacctcataggctgagagctgccggcattcccggacaaggattggccctgacatttgacttttagttgcagctttttcctttcagtgtttgtatttaatgaccctcctcccatcttgatctaagcctgtgttctgccagcagtttagtatttagatcatttatttctcctttacgcctgctcttttattttcatcatatacagtgtaggtttcattcctcctgtctcatttcactgtatacccttatccatcattgtcaacagcagctcttaagtgctcttatagaacatctcaagaattaaacactggacagatcctcgttgtcctgtcatgggacacccactctttcggttctctgtaatcccagctacccaggaggctgaggcaggtggattacatgagcccaggagttcgactgagcaacatggaagaccccttctcttgaaacaaaaactttattgctgaaaaatgctgacaatcatctgagtcgtaatcttcttgctggtgggggtttgtttcagggttgatggctgagcagtcacggcgatggttgctgaacatcggcgtgtctttggcagtttcttaaaataagacagcagtgaagtgtgccacattggttgactcttcctttcacaaaagctttctccatagccggcgatgctgtttgacagcattttacccacaggagaactttttcaaactggagtctctccctctcaggtcctgtcactgctttatcagccaagcttatgcaaattctaaatcctttgtcgtcatttcaacaatgctcacagcgttctcaccacaagagatttcatctcaagaaagcac

SEQ ID NO: 84739 - DNA, 1020 bp, Homo sapiens
ggttgatcgttgctgcactgggtgtttgtggtccgcattctgtatttcctagatctgtggcctttggagggtcagaggatcgggaggaacaaatctttgtctttcatacagtgttcaagcaaacaggaaaacaatttcacttttaattaacttagtgtaatttaggattaactcttttattgtgaaggaattatctgcctcagaacttggcttattagaacttggcttattaccttcatgggttttgtactcggcacatgtgatttctaaaactacagaatgaatgattccctgtgatcatgtgtaatcttgaggatgtagaaacacttaccacctaaacgtaagggcaggctttgagctgcctctcggtccgatcctgggcgggctcgcgactccgtgcctcatgctgttcttttctcccgaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaagtagcctcggtagatgagaaccacggttgtgttcacggaggccctcccgtgtgccaggcactgtggtcacaacagtagagacaaagcattcctggtaggaagcccgcagatgagtaggtgtggaagagcttatccatccgctttttcatgccagaaagtggtgttgagataccccagctgattcagtctttcatgcacgtcatacagccatagcgtcagtgacacttgcctgctaactgctatgaagataaattaatttgaaaacggcatttatagacagcactaattgtacttacacagccaatgcccgtatttagtcactttcatgtggataatctattctctagctttagtatagctgacttcagaggaatgtgacggtgtgctgatgtgagattgttgcttttttgcatt

SEQ ID NO: 84740 - DNA, 1629 bp, Homo sapiens
tcctaggaactacagagtgggcaattgaaaatgcagagaactcccccgattcactcaaaacccttcatccaaagccagctgcacctcgacaggaactaatctgatgggcctctctctgtcacccaggctggagtgcagtggctcgatctcagctcgctgcaacctccgcctcccgggttcaagtgattctcccgcctcagcctcctgagtagctgggattacaggcacccgccaccatgcctggctaatttttgtatttttcgtagagacggagtttcaccatgttggccaggctggtttcaaactcctggcctcaagtgttccacccgccttggcctcccaaagtgctgggatgacaggcatgagcccactgcacctggccctctctggaaattattttaataagtggaaaaagaacattaacctctccccatcttctcagtgtgtctttttattatttctttgctgaaataatgtagaattgtgttttttaggtaaatattgcagattttcaagagaatcagtgggtgacttgtttccaggagtctgctgaagctatccttggacaaaatgctgcttatcttggggaattaaaagacaaggtcagccacatattttattataacttctataacttttaatggttctcattctataacactgaccccacacatttttttttttttgagatggagtcttgccctgtttcctaggctggagtgcagtggcgcgatctcagctcaccgcagtctccgcctcccgggttcaagtgattctcctgccccagcctcctgagtagctgggatgacaggcacccgccacgatgcccggctagtttttgtatttttagtagagacggggttttaccatgttggccaggctggtctcgaactcctgacctcatgatctgcccgcttcagccacccgaaatgctgggattacaggtgtgagccaccacaccttgcccaacactggccctctttttgctgtttaatattttttagtttgtttctttttggtattgtttgtatacagtttctcagcctgataattatttaagagctcatctgatgttatctaatcttgtccatttgggatgtgcttaacagtgaaataatgtatataaaagtactttaaaaccaaagcactttctaaatcgaagccacccgtttctcctgttcctattagcacatcagagctagtgtgcctgagatgacttaggtcgggaggtgtccctgaaacaacctgaattattacaggcatgcttttttaacatagtaaataccttccagaaaagttgagtcagatcctggttaaaatgcacgtatgtcaagttcctgggtctgtcctataaaacaataataataaatgcacatataaggtgcctgccatttcagcccatcagatgcaattcttatgcggtgactttcttccgtaaggtaactttgtccatttcatttttataagtttgcattttcacatattaggtttatttaatgtacagaatagattgctaataatgctgaatttaggaaaggtagttgctcaggtaaaacataaggaagaccaataaaagctatgttttctgggccacataaatgggcacctttctgtagatggcttttcccc

SEQ ID NO: 84741 - DNA, 1050 bp, Homo sapiens
catacataaccaaatttgcctttgtaaccatttttacgtgtacagtttagtggcgttaggtacattcacattactgtgcccctgtcaccaccatccttttccagtacttttttaaataggcaaattcatagagacagacgacagccttgtgttttccaaggatggagggaaggggagaatggagacacactgttcatgggtggcgatttgaaactctgcacattaagcaatagctccttttccaaaaccctcttctccctggccctgacaactgccattctaccttctatgaatgtgattagtgttttaattttcaataagattctacttaaaacagtttcatgtaatgttacctgtagatgagtcattcctaagtaatttgaaactacccaggagatgcattttcagaagtctttttaaaagtcttatcagtatttgcaagttgtccagtggtttccatgtgtcaagttttatgtttgtttttgcagaatgaacaggcatttgaagaagttttccagaatgccaacttccgatctttcatattcagagtcagggtcaaagtggagacctacaacgtaagtaagggcctgggcagcagggttggtggtggggaggtgctgtttgtcacctacggcagtgtcgtgacactccctggcagggagttactgtactcactgccagaccccggtgctgactttgcccaacacaggtgctgttatgatccccattttcagatgaggaaggagagagagcttaagtgtcttgtcgaaacaatggcgggggggtggggaatacaatatggatttttttgtttgtttattttttttatttttattttttttcagttaaatcctaggattttttcgtctgtgttctgacaaaaaaattataacgcatgcagtagagtcatatctttgacaaatttagattgtagaaaagtatattaagtatatgagccgggcgtggtggtgtgtgcctgtggtcccagctacttgggagactgaggcagcagttcaaggccagcctgggtaacatagtgaaaccccgttt

SEQ ID NO: 84742 - DNA, 1017 bp, Homo sapiens
agtcagtatatgaaacaaaggccacgtgtggttaaaactaccttgaaaattcctgaaattgcccataataccatatagtatttatttatttatttatttatttatttatttatttatttatttgagacagagtctctgtcacccaggctggagtgcagtgggacgatcttggctcaccacaacctccgcctcccgggttcaagtgattctcctgccttagcccctcgagtagctgggattacaggcgcccgccaccatgcccggctaatttttgtatttttagtagagacggagttttcaccatgttggccaggctggtctcgaactcctgacctcagatgatccacccgcctcagcctcccaaagtgccaggattacaggcatgagccaccgcgcccagcttagttatagttataatcaaacagtattgagcatggtctgccaggtaactgttctacatcctttacgtggaacatctcacttgagcctagtaaccctatatgtagaaactgtggttaccctattttgccactgaaggaattacatacagagagacacgggcattcagagaacaagtcacttgcctaagttgtatgctagcaagtggtcgagctaacgtccaacccaggcagcctgacttcagagctttgcttttgatcatgcttacgagtatcacgggatttagtaccgaccaagcacacagcagtgtgacagccccgagctcgcctgtgcagccttcctgggtatcactccgttctgcccggaaaggcaccattcaggccgtgagtgtaaacgtacgagtgggcagggggagtggtagaaacgcccctgctgattgcagggtttactcacgtatttaccttaacgcccgttcttctgcgactactataaacattaaatgagataggggatcagatgtcaccgtgaaacaatgtcagggagtggggtggggctgggggggatttttggggccattcagccccatcgtgtctggacagggaaggtgaagtgaagaga

SEQ ID NO: 84743 - DNA, 1017 bp, Homo sapiens
gcttctgggtgtttgggagcttgggtaaagaatcagaagggcctgtgctggagaaaggacctgttcactcgcccagccccagacattcaggaggaggctgtcactcactggaatgactgaactctgaacccgtgcgtctgttccctcccgctgggctcactgaaaccactgaagcaaaaggggtttcactgctccacaccacactttcactgctcacaaactacttctccctttttgaaggacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgactt

SEQ ID NO: 84744 - DNA, 1042 bp, Homo sapiens
tgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctctcgcgtgctgttccttttttgaactgcagggtcaaaaatgttcccctcccccacttctgtttcctgagtgggctgtcttcaaaaagtataaatactattgatcgtggtatttaatacactaatgaaacccatggttattgactacataattaatatactgtccaaaagtgaagtttggccgcccagtatgtaaaggtttatattgactcatgtttctttggcaatatgccgcccaaggttttatttatagaggatgaaacaggttgtttggtctccttttcttctt

SEQ ID NO: 84745 - DNA, 1025 bp, Homo sapiens
tttggggaactctaaagctcgaaaggggacagtggggctgggcacggtggctcatgcctgtaatctcagcactttgggaggccaaggaggatggatcacctgaggtcaggagttcgagaccagcctggccaacatggtgaaaccccatctctgctaaaaatacaaaaattagctgggtgtgatgacacgtgcctgtaatcccagctgctcgagaggctaagccacaagaatcccttgaacccgggaggcggaggttgcggtgagccgagatcacaccactgcactccagcctgggtgacagagccagatctatctcaaaaaaaaaaaaaaaaaaaaaaaaggaaaggggacagtgggcctcctgcaaggagcagagcagaggaaagaggacacctgcttacctcctgccctcctccagggactcctgcacctcctgatgtcctcacatgtgcagcgagggggacagttgtctctcccatctcacagggcggaagtgaggatcaaatgcagtaatttgtgagaaagaaaaaacataaaacagtccataaatgtgcaaggaatcataattattatattttctcctctgggtgaaccagagtttggatgtatgaagctcacatacgaggaaaatcaaccgggtccgatccatgagctgctcttttcaaatctcagtgatgtgcctctggaagagactttggtgaaggtttgcatctgtttggggatgtccatcattttgattgttctgtacacgtccgctgaaatgtaatacttgacatttctcgagaacccgttgtattttttttttaaaccttgtaactgaactatatgttcagggaaatggaaataaaacatgattgcttagtttagatatgaaagtggagtttctgctttatcctcaccctcctttgaggacactcattctttccccactttccggcccccaggcgtagaaaataggctgttcctttgcacatgagggaggcagcgtggggagaaagacaacgtgaggactgtggtcaggcaga

SEQ ID NO: 84746 - DNA, 1003 bp, Homo sapiens
cttccctgtttactcagcccaaagccacggggccaggctgctcccagacccactgggcaggccctgtagggacagtggcagtaggcggttagccctgtagggacagtggcagtaggaggttagccctgtagggacagtggcagtaggcaggccctgtagggacagtggcagtaggcgggccctgtagggacagtggcagtaggcgggccctgtagggacagtggcagtaggcagtcagccctgtagggacagtggcagtaggaggttagccctgtagggacagtggcagtaggcaggccctgtagggacagtggcagtaggcgggccctgtagagacagtggcagtaggcagtcagccctgtagggacagtggcagtaggcagttagccctgtagggacagtggcagtaggcaggccctgtagggacagtggcagtaggcgggccctgtagggacagtggcagtaggcaggccctgtagggacagtggcagtaggcggttagccctgtagggacagtggcagtaggaggttagccctgtagggacagtggcagtaggcaggccctgtagggacagtggcagtaggcgggccctgtagggacagtggcagtaggaggttagccctgttgcagagaacctgccaccaccatccctatctggcgctctccctgcccttggttctttcccttcttctctctctacccccttctctttttttttctcactcagcttctctgctgaattctgcattgacatcagcacttccaaaaacaacaacaaaggaaagtaggtcaccggcgtaccggatcggagctgggccccggtgccagctgagtccggggctgcggcccatctcatggagagccgggggcgccccaaactctgcgccacagcctcacacatgcagcttggttcctgccctgtgttcttagcgggaaggggtaggtatgcgtgcatggcctgtatgttggcatgctggctcacggacggggcagcgttggggt

SEQ ID NO: 84747 - DNA, 1389 bp, Homo sapiens
ccggggcctggtgaacctggaccgtcttttgctgcacgagaaccagctgcagtgggtccaccacaaggcgttccacgacctccgcaggctgaccaccctcttcctcttcaacaacagcctctcggagctgcagggtgagtgcctggccccgctgggggccctggagttcctccgcctcaacggcaacccctgggactgtggttgtcgcgcgcgctccctgtgggaatggctgcagaggttccggggctccagctccgctgtcccctgtgtgtcccctgggctgcggcacggccaggacctgaagctgctgagggccgaggacttccggaactgcacgggaccagcgtccccgcaccagatcaagtcacacacgctcaccaccaccgacagggccgcccgcaaggaacaccactcaccccacggccccaccaggagcaagggccacccgcacggcccccggcccggccacaggaagccggggaagaactgcaccaaccccaggaaccgcaatcagatctctaaggcgggcgccgggaaacaggcccccgagctgccagactatgccccagactaccagcacaagttcagttttgacatcatgcctacggcccggcccaagaggaagggcaagtgtgcccgcaggacccccatccgtgcccccagcggggtgcagcaggcctcctcggccagttccctgggggcctccctcctggcctggacactggggctggcggtcactctccgctgaggacccagggcgtcagcacccagcactgccacatgtccaccaaggaacagaatttattttcttctttttttaacaagtggaagatctgctgggtttcaggaaaaggctggtagagccttcggctgctgtctggacgtctggaccctgccatgtggattataaacccaaagtgtacagccctaggcgggagggggtggcgcttctcagccggctgtcccagccagccccgcagagcgcccacggacagtgtccactctggcaaggtgggaaaaggcactccaagtgcatcctccactggcaacagtgggacaattgcccccgacggcggcaccggggctctgtggaatcccgatcgttccgagaggtctggagggccccgtggttcctggagaaagcaggacgcagagaagaacaaatgaggctcacccacgaggctgggtggccagcagtctgggcacacacgagcaggtggcatcttggctcttgcctgaggccagtcaccctgccctgaattctatcctactccaccttcagcccctccctcgggggtagcgcctctcattcctgatgtctcaggcaaccctggcagacccaggtccaactgctggggtccaagaaccaattaccaaaggaaagatcat

SEQ ID NO: 84748 - DNA, 1089 bp, Homo sapiens
agtcagagtcagttacagctccgtaaatagagcaattccacttccaggaattgatctactgctacccttgtatctgtgggcagaaatgcgcatgtgggagcatgcaagttcagaaactggaaacaacctacttgtccatcaggaggggatccactgggtagatgacaacacccccgtgcgatgggattttccgctgcgaggaatgggtgactctgtgtgcactgagatggggtggatgccaagctaccttgcaaagtgaaaaagcagtggtaatacatggcgctaccatttgggttctaaaaagacatgcttgtatgtgatagaaattttctggaaatacacaaaagaaactgttaacagtaggatacctctgaagaaagaaactggggcctggaggtctgggagaggaaaggagacttactttttattgtatacccttttgtgttctttgaagtttttttttgtttttttttttttttttactatgtgcatgtattatcttttcgattaaaaagaaagttgggggaggttcaaaaaaaaacaaactcacaggctttatctggcttctcagtccaccttttcttccgtttccagcccggtcctaccaccctgattctcaggccttttctcagctcctctccctccctacaagcctatgcctacccttccccggggcatccattaccgcctcttacaggtacttaaaacctatctttttgccttgaaatacaaataactctaatctggagagaaggctgagctccattgcacttatagaacagacagaaatcagctggcactgagatgctcgataaatgtttgctgaatcgaatggaatctgcgactcggttggttacactgagcaaggtactaattggccaaggtcaggcatccaaattgcacatgggttggtgctctctgcgcctagagagggactcgttccctggatgctctcattttctccattgtggctatgcagggggagcactacacatgcaggaaagggtgggtgcagggctgtgtgcacaccgtctcctctcttggagacacagctcagagagactttaagaggtagagcgaaacaacagt

SEQ ID NO: 84749 - DNA, 1049 bp, Homo sapiens
ccaggcctggctgactccagcatcttcactcagactcattgtcctctgccttctgtgaagttaggtagtggcaggaccttctcccaaattgtgggtttgataagctcgcaagctggtgggaaggggatggagcaggccccttggcattttctgacctgagaattgagaatatcaggggatgaggccgaggatattcaggacttgggcagtactcgccctgcttttgcccgaggagggaccaagtgtgtccctggctgggagagctggtaggtcctctgtaacacggtgggctcagcacaggggagacatggctgtgcccccaaggcatctagttgctggccccctgtccctggactccctcctcactatccccataagggatggagtgaaagccgctttgtcctccccagctcttgcccatcacttccccctcaagctcccagcgcctgtgaattccacctgggcacactcttctcagaggcagcaaaatgagatcttactccagagactggggaaagcaatccacagattgggacccggagcggcgaggttcgagtgcacgtgtcctgaggaacggggtggttcagcgtagccgggggtggggactggggggctttgtttttctaccagttctgctgtgcttgcttaaaacttgatgagttcttcttgggaaattgcttcagatttcacagcattttcctcttaatagccttggcagtggtgaatccttgacctttgagggtgggtttgattttttggaaaaggccaaaagtaatttgaagctgtgtgttgtgaatacaggggctgagcaatttgcagaatgtgatttgtttttgttatcggaattttttttttttttgagattcaaaacgcgatggcaccctaaccaactgagccagttttctcacgaggaagttccagaattgtttcaagtaatggcagtgctttgcaatgggggacttgggttcaaagatgaccactctgatggaagggtaggggaagggaacggatgctttattgaaccgttactatgtgccagacactttaca

SEQ ID NO: 84750 - DNA, 2003 bp, Homo sapiens
tgtagcgtgccttcttgtggcagagcaaggcctcccggagccgctgctgctgttcctcctgcatcactgtcctctatcactgcagccatggacgaggcctctcggtggcaggctctggggggactctgggcacccaaatgaaaatgccacagtcctcttctcggtgggcttgcctccctggcctttctcctcaccgtagatccctcttgccttccctgttttaggagccataacaaaagagtctgtgggtgtcacccgcccgtctgccagcctgcaggatcaggtatcggaggccttcaggactctcgtaggctgccttggcatctctgcaccacacttatgcctggcccccattcggcaggcagatccaatccctgggaggataagggtgtgttctggaagctggcagtgccccctggtgaagccctcagaagcctggggcgagagctgtcacctcccccacagagaaagctggaatcgattcctctctcaccactcccttggaaagaacagcaacacaagggaaggcctgttattggtggagggtttgtcctgagagagcagcaggtacataaaaaaatagctggggcaacacgccggcctcggacccagcctgtgcagcccaaaacgggggcacagatccgtcccgccccacccttgctgctgagttgggtctgggcccctcctggtagccggggtatggaggaccctggctgctgcccctgcctcctcgccgggacctgactttccctctgccccccactgggaactggccagagtgtttttactaacaagctagccatgtcacaatctcaacagagagagacgggcgtggggaggaagagagagggagacagagacagagaaaagaaaggaaggaaggaagggagggagggaggagggaagagacagagagaggaaataaagaaagacaggccgggcgcggtggctcacgcctgtaatcccagcactttgggaggccgaggtgggcggatcacgaggtcaggagattgagaccatcctggctaacacggtgaaaccccatctgtactaaaaatacaaaaaattagccaggcgaggtggcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaattaaaattaaaaattaaaaaaaagagaaagagagaaagaaaaaagaaaggagggagggagggaaggaaggaagaaagggaaagaaagagaaagaaggaaggaaggaagacagtccttgcagaaataccgctgcagtgtctgccaggacctaagatctcgtactatctattttttaataattgagggtaataaatatgtatttctttctcctcatcatcccccaacctccgatgcttgtcagctccctgcgtctctcctctgatcagaccaagtcttccccaagcaaaaaaaaaaaatcctttaagcaaaaaggattaaaaccttgaaagtaggtctgcctgagctccccccactccctcccctcccctcccccagggctgaagtgaagaggcccctcaggggagccggggacggggggagctgatgctgcaaaccccaagtggggaccttagcaggggagaatcccgcagtcaccccttcccgcagcccatcgagtcctgggggaggcagcctagcccggcccagctctccactggccattgaggaggggctgctcgagaacaaggctgccctagtccccagcagtacaggacataggaaggaggcctttggtctcagaaagacccagttctaccttgcagcatggctctgtgctttaggggcctgtgtgaccttggaacaagcacttgagtctcagtttcttcatctggaaaatgggaatataaatagtgcctaccttacagaggatcaaataaggccgggcgcggtggctcatgcc

SEQ ID NO: 84751 - DNA, 1549 bp, Homo sapiens
ccttcctagggtctgacctggcttcccttcccaggtgggtgcaggtggcatgtccacgtctctccattgactggggcacagccttccccaagccgctgctgacaccctatgaggtaacaccaagctctgggagagagtgggctttggacgtggttctcaaaggtgaggtctggagtggagtggggtgggtgggcagcacttcgttatgttcgtagattccggagtctgtctcgatttctccagcggagtcacttcctagctgtgtagccttaggcaaggccctgaaccacacagttcccttctgtggcaggggacagtgtgcccttcacaggccgtcgtgaggactgaattcagtaatccaggggcagaaaaacactggcagatgttattgtccctccctcccctcccctaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctaaccaaagtctgcgacctcaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccttggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcggtgagacaagccccgctccggaaacgcactcagtttcctccatcttgtttcgtccccctcgacacccttcagcatcccccaccctgcgtccacccgcattcctcccacccagtccacacccttcatttctcgcgacccataccctctttgctcaaactgcagcctgtcctcccaggcttccgccttcaccgtcttcctccgctgtctcctgttcaggccaatccactcatttcccccctctcatttcccccagacttttgcctcgattccctttttctctctgtcatctcgaaccctcctgccctttctcatttctttccttcctggagcctcccatgccctaatcccatcctttttcctcatatcgctgtagggtcctgccctcc

SEQ ID NO: 84752 - DNA, 1068 bp, Homo sapiens
attataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggattttgagcatctttttcctggtacacacagaaaaacattttataatggaagtcggtttcttggccatctacatagttttctgggcagcgccaagcagggaggtgtctccagttgtgagtcctcggacaggctgctgcatgggtgcacatactcacgttattggtggaagttttaagtcccaaactgaagggaaggaggcctaggtggcacaatcagggaggaatatacatctgagaagttttgggaagacatcacctggcaaggctgcctgaaccacagtaatttagtcttcctctatccagatcactgagagttgtgtgctggtcttctctcaaaccctggatgtgttacctgcttctccctaagtgctctaacctcgctgaactatgagcctgaagggtgggtcgatgccagaccttaggtggaggccaaagacagtacagaataaacagcttcttcctaaattgaccccatcttgagggtttctgagattgatgccattctttagtgactacagccaaggcctaagcaatccagctggttttccccttggggcgtgtagttgttcttggatactttgaggattgctcactctttttttttttttttttgagacaggctcactctgtcacccaggctggagagcagtggccaagatcctggctcactgcaacctcagcctcctgggttcaagcagttctgtctcagcctcctgagtaggtggcgttacaggcatgcgccaccacgcctggctaatttctatatttttttgtagagatagggttttgccacgttgcccaggctggtctcaaaactctttagctcaaacaatccacctgcctcagcctcccaaagtgctaggattataggcctgagccactgcacctacctag

SEQ ID NO: 84753 - DNA, 1045 bp, Homo sapiens
tcccctctgcccaccacagccccttgcctcccttcacactctccttcctcctgtcgtcttctctcgccaccaccaaccccacaagcctctccctcccaaatcctccaaactcctccccaggctgaaagccagttctcagcctccctgcctggagctggcaagcctgagcttcctagaggggtacctcctgagagaaaggtaggcgggattgctgaaggccttgttgggaagtgtggttccaggactgctgggccccaccccagcctcagaactttctttctcagaacggacacattttggctttggtcctactagtcctcccacccccgacttcaccccaaacagcctacaggaacccattgccatccgggggaccgcccctatcagaatgacatcagcaatggctggtgtaatcaaagcccatttgtcagtgtgaattcttagcagattaacttgtcagattcacagagaaaccgtcactaaatgtttatgtgtaaacgatgttgaattttaaaatcatgtggattatggcggatggggcctgacaagatgacagtctctggtttctaacaaagtgaagttaccagtgtcaaaacagaggatgtttattgtgaaaaatgtcaaagtatccacagaaacccctgcagacccctgccagcaatgtcgggccttggttagctgacctaaggcctgggacgctcctggtttgaggcccagggcaggaatagtggggctgctacagacgcagccagtcagctgggagccccacacagccctgcataccaccaccccagccacacttatctgcagaggggcctggcccaggcagctgagtagtctctgagtatcccctcacccgaggccaccttcctttcccctctgcccacagccccttgcctcccttcacactctccttcctcctgtcctcttctctcgccaccaccaaccccacaaacctctccctcccgaatcctccaaactcctccccaggctgaaagccagttctcagcctccctgcctggagctggcaagcctgagactgctc

SEQ ID NO: 84754 - DNA, 1032 bp, Homo sapiens
cctgagggaccctttcacgtgagtcctgtaaccaaggaatgcaatagagggaccagatttcttcctctaaatacagcagctccagaagattcctttaagttcctcccaagaggagggcagggcccaggagaagagacagaaagggagtagagccctgtgaaatctcgagacacttcttgcccccacaagctcccctccggccctagtttcattggaagactcctgtgggggaaggatggattctggtctgggaaggtgttggctgggaaagtgaatggacagaggcctaggatgaaagctgattgctgaggctgataccttgtggggctctatctcatcagtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctggtgagaccctgtggcaggaagggaaagcccacagccagcttccagaacaaggtctccaggaaggaagggctgaaggaggcccatcagcctgggcagctgagggccagccaccatggaggcccaggtgggggagttccttctcccctaagtcactcgtagcacagtcagatcaggccaggcagggccagcgcatgcatgggagggatcggggaggtggccctgcccagggcccccgaggcagaggatccctcctcctcctccacatggcgcccccttctgcccagtggtgcttctcacacacgtcttcctccagggtaacaacgatgatctcatcctgtcctgctgcctccactactgcaaagacaaggctaaggacttcatgcccgccagcaaaggtacagctttgcctccgccttgggatcttccatccccactgccctacctcatcctacccatcctcagcccctgagaagggctcc

SEQ ID NO: 84755 - DNA, 1029 bp, Homo sapiens
ctgaaaattctccttttgggagtctggagcaggggtgctgggagaggagtggagagtggcagcgaggggccccagaaagctctatgctgtgaaagcactccactcttccctctgctggttctagaccaaacttagaagatatgtcatatattctgttttgtatcaggaccttactcaaataaatgtaaggcacctgtcactggtccctggggttgtctgctgccccagagataacctaaggagagataacctcagaagatcttgatcctcagcctgccctgggccctcacttaccacctgacatgcccttgtgccctccgcaccccgtcattcattctgacccccttgcctggtagctttgacacagttcccctgtgcccctcagccggcaagcaacatctcgtctccatcttccctttcagaaaatgctgtttttcttctctccctctcaccctgtaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggtactatgcgggaagagcccgctgtggcagagggaaggccccctccccattctgctcgtggcttcagcttttcctcctgcttatttatgagcacagagaacagcgtctgtgttaatgtgaccagccagcttctcgagagtgtgctctgatggtgccccttcctgccagtccaccccggtgcctccatcctactccactacgagttccagatgcttcttttaatgctgcattgaggagaagggaggaaaagaaagaaaggagttgaataatgtgcagctctcgaggcttaggaaagggagaggggggtggtcaggatcaagtttatagatgtgtggagcccaatgcagcacaggcctgaactccagcctccagcacacgtacaggaagagctga

SEQ ID NO: 84756 - DNA, 1029 bp, Homo sapiens
ctgcgattacaggcatgagccactgcacccggcctgtattatcttttaaacctcacaaacaacttgagcaaacaaaggctcagagaggttaagtaacttgtctaaggataaacagccaggaagtggcagttagtacttgaactcacgtctgtgtaactatgaagcccaggctcttgtccaacctcctgtattgccttgtcttgcctcttgccagaatggccctgttttttatactttatttacctcattacttcctgtgtgtgcttcacaactcccctgttcccctggttctcccttcagtgtgaacatcgtctccttcctagtagccaaatatacgtgtaccttttgggatcttcagtaaccctgtcttgggatagtctccccaccagcaccaggtcttgccatctgaccatttgccagttcccacctccccttctctaagagacttcagcacacacctggtggttacaggtggggacagcaggcatctgtgcaatgctggctgattgataatggccctcattgcctcctctaagaagaaaacacagctgttgggaccagacacatggaatggtgtggttgctgtgggtggaccaatgatgttagcatttcatcttgtgacccaatgacccttcagctagcacaggccaaccataggactacggagggttggatctggacaccgggattagaaatgactgagaaaggccgggcgcggtggatcacttgaggtcaggcgttcgagaccagcctggccaacatggcgaaaccccgtctctactgaaaatacataaattagccaggcatggtagtgcgcacctgtaatcccagctactcaggaggctgaggcaggagaatcgcttcaacccgggaggcggaggttgcagtgagctgagatcatgccagtgcaactccagcttgggtgactgagcaagactctgtctcaaaaaaaaaaaaagaaaaaggggccaggcgcagtggctcacgcctgtaatcccagcactttggttggccaaggcgggcggatca

SEQ ID NO: 84757 - DNA, 1035 bp, Homo sapiens
acaaaccgagactctgtctcaaaaaaaaaaaaaaaattcctgcctagagagaagatcccagaatttctttcactctttctttcctgtcagcagggacacggaggtttcctgtctgccttgtcatcagctttgaaacattttcctcctgcattcccccatatatgtagtggcctgtaagctttgcccccttcatgttcccagcatcctccttccctctctcataatcggctgggtctggttaattttgcccttgtgacaggacagcctttcccttgtcctcggagttattcctgtgggacataagacctctctggtcatggtctccctctctttcccttccttcttgccctttcctctctaactatagcctttgtaaatagactcctctgaggtcaccgaggaatggtagtatgtgcctttgctgctataggactctcttttcccccagtaagcagagttcccttgagagacccccctcccttcctttattaaaaggcacgttggtggcttatctgcttgaactctggcataacagggcatggaacaatggcatgtgcagagtgctttggccaaagggaaattaactttgagccagagacagcagtttgaagaaacttcccttagtaagaaaagagacaagaagaaaagtgatggggtggaaagggaaaattctatggcagagaaggtctccctgagaactcaatcagaaatcagtatctcctccttaagcctggtttttccactgagaagtaaactattattctctcttctcctccttcataccttctccaagatcaagcgttgccagataagtaacacaccctgttgcttgcaaagtaaaagttacttggattgacagatttgtggagcctttgggtgccaagtatcaggagggagctttgatttccattttcctgtcttcatgatggactttactctttacattcagtagaaaagttcaaggctgtggtgcagacaactttcagaggttacccacatataggtcttaaaacttaacatctggcagttactagt

SEQ ID NO: 84758 - DNA, 1145 bp, Homo sapiens
tctcaaactcctaaccctcaggtgatccacccaccttggcctcccaaagttctggaattaaagggatgagccaccacacctggctcagaatttttttattattattattatctgagacagagtctcgctttgtggcccaggctggagtgcagtgacacaatctcggctcactacaacctctgcctcccagattcaagcaattcttctgcctcagcctcctgggtagctgggactgcaggtgtgcacctgcaggtttgcaggcgtgggcctggttaatttttgtatttttagtagagacagggtttcactatgttggccaggctggtctcgaacacctgacctcaagttacccgcccgcctcggcctttcaaaggcctgggattacaggcgtgagtcactgcgcctggcaagatttttaaaaatgaaagtttcaatatgtgttttcatagtggacgctggggattggagagtggctaagaagactccaaagaggtccagttacaactcagtcacacatcagattcccatgtctccttctggatcatcctgtagtttctatagctgttttctgtaattcatgcaaattctctgtaatccttcatttccgttttctacccacttagctgttgccattattttgaggcattggatgtaaaaaacaaaacaaaacaaaaaaaaacctgttagatttatcttgtaggctaaggctcagaaattgggcaaggttcaggtagcttttcagaaggcgaggcaggtgtgcttagttacactattccaagattctcccagaaatagaactctaaagtgaggacttgggtgcccttgaaggagaacaacaaaataccattttggaaataaaattctgctgtcctgggtgttccagcccctcccatgctggcctcctttcggcaccattcctttctgcagtcccaccccgcttggccctggcacgcagtcccatgaacatgccacctgccttctctctctctctggccccatccattggctgttcagtttattttttccacatcctcaccctcttccagctccaagttaaataaccctcacagatggcttgttccatcagagctgtttaagaacacagagcagtgaactagtgcccagaggagctgccccagcccaag

SEQ ID NO: 84759 - DNA, 1040 bp, Homo sapiens
ttctgtgaggctctacgagctcctctgataaggaaactggcactgaaggtgggcgtagcggccttcagatgtaccaggcagctcttgccgtaacacctatagcctacacatcgaaatggaattggagccgcttaattttcacagtaaatacatatatagcactctttgtttctggccttcaaatttgttgatgaccctcctgatattgattcctctggggtgggagctctttctgggcagcgtgcagactggagcacatgtatatactttgcacattattttgcccaactttttgtcatttgagaccctgcttggctggggagactgttgttgctgacctctcccaggcctgttggacttgatgatgactgatggacttgagcacctcatcagggtctttcttccgtctgctttcctttgctgcttccgccagatctttccatcagtccccccaacacagagtgctttattgttgatgatccttagtatttggcatgaaatgtgcttcacaaatgatgttgattatctttaaaataccgtgtgtgtgcgtgtgcgtgtgtcatagtatatcaccacttacataaatgtatctataaaaggcatagagagagctcgtagttaatcacatatgtcagtaaatgcagaactatctctgaagaacataccagaaactcgcaacagggcctaaaaatcaaaggtgggaaggttttgtttttaaaattcggcctttgtattgctttttttcaccatgtgccatgtttctgaactccacgttactaagcagctttggcttcagtttggcctggtacttgattctgagatgccaccatatctcattgaactcctttggtactttgtcagcagcaagagtgactttagcttaagtaacagaattaagtgacagcttttagttctgtgttgtcttttttttttttttttttttttttgagatggaatctcactctgtcgcccatactggaatgcagtagtgcaatctctgctcactgcaacctctgcctccgggttcaagcaattctcat

SEQ ID NO: 84760 - DNA, 1521 bp, Homo sapiens
gcaagactctgtctcttaaaaaagaaaataaaaggctgggaacagtggctcacacctgtaatcccagcactttgggaagctgaggccagtagatcacttgagctcaggaggtcaagaccagcctggttaacatggtgaaaccccatctctaccaaaaatacaaaaattagtcaggcatggtgacgcatgtctgtggtcccagctactcaggaggctgaggcagggggattgcttgagcctgggaggcagaggttgcagtgagctgtgattgcgccactgcactctagcctgggtggcggagtgagagtctgtctcaaaaaaaaaaaaaaaaaaaagtttggagctcattacacctggcttttattgtttgctgttttgctttttaatatagctaaagtatgcagatttatttagctttaagttttgttctcaattccctagtggaaaaaaaaaagcaccaaaaaaattcaatttttacatttcaattcaaatgcaagaacttggaacagaccattgccttttatttatttatttatttatttatttatttatttatttatttattttttattttattttttttgagacagagtcttgctcagtcacccaggctggagtgcagtggcacgatctcggctcactgcaacctccgcctcccgggttcatgccattctcctgcctcagcctcccgagtagctgggactccagacgcccgccacgacgcctggctaattttttttttgtatttttagtagagacggggtttcaccatgttagccatgatggtctcgatctcctgacctcgtgatccacccgcctcagcctcccaaagtgctgggattacaggcgtgagccaccgcgcccggccgacttttttttttttaagagggaagcggtaataggaaatttaatcaggaagatttctaagcttcaattgtaaagatacctccttttcccaagagttaggcctaatgaagactatacctaccagtacggagggggaggggataaatcacaactaaagaccttggcacttctgtaagaaatttaaataacaggcagacatatagagatttgtaaatatgtacttgctgccagataaaccacagggaagatactgtatttgtggtccagggaagtttaaatatttgtggtcaaacttaaaattcaacgtaaaactctcatctgtgatggaaactttccagaaactgcatggagcgggtgtgcaagctgcataaactctcaaaggcctctcctctcaccaggctgagctggaaaagcctgttctccttccttcaaactgtgtagctaacaagcccttcgatcagagaaggaactccttgatgctccagccaccacccaagaaacccgctctaaggacctttcgggccaggcacagtagctcatgcctgtaatcccagcactttaagaggccaaggccggaggatcccttgaacctaggagttcaaggccagtctgggcaatatagggagaccccgtttctataaaaaattagccagg

SEQ ID NO: 84761 - DNA, 1687 bp, Homo sapiens
taaatggagggtggggtgagcagatagcactctcttcctgctctgttttcaggaagtgattataaaagcagctctaagtttgaatgaaatcaaaagaatgaattgtcaccttcccccaacaaaaaccagatgagcacaaacatatacacaaacacactcctcctctgcactccatccaagatccacaccctggctctgccgggcttcacttcggtgctatttcagagcaaagagcctttgttgtgccatctccattctcttccctgggagagagcttagtagtcttatgaatgagagctcgacttcccttttggcatactgtgggtttcacttccctgtcctctctccttccaagaagagtgtgggcagaagtgtataggtgggaggaataaccattgccaagatttaattcatcagttagggattggggtttcagaactggtaataaaattgtttgcagttaattgtcaatgaaaggagtttctgtgccgttaacacacttccattccttccttccagctgcctctttccgtcgtactgcctttttcctggtacctccatggggtttaagccatatggctcttaggaatatcgtttggagtctccagaagtggaagatttggctgtgcagcacacagcacccctgggtctactcctcccctcccctctcagcagctgtttgccactgaccgaggtggcgaccaagcctatgtgtgtggccagagtcagtgacaagcctcccacccaggcctggggaagcccttagccagcgcggttcctgaggcagccgccaacacgccagggtttcctcataccttcagggctgcggtggagcagccagcgttatgcggcagcattgtctagcgttgcttcacttgacttctctgtccccaccctctgtgtttaagggaatctggccatcatccagcagggaagaagctggcatttacagagagtggctttctgccacccctcatgtggtaggagccaggaccacctccatctctgcttcctacccatgtggcaaagaggaaggggcccctctgtgctcagtctcctgttgtggagtttcgagttgcctaagatgagaataaggctgtctgccaggttatctgcccagataaacatttattgtttacagggacatgtttcagctgctctggcacctcccactggtgagatcctctagtatcttgaggttttaagccagtatatggggccgacgtccagacacagaactactggagctggagaggctaagtggctcgcggcttctaacttagcttcgccattgccccccgccccgcttcccactgccagagctagatttacatctcttgttcttagttctgcctcctggatattgaagctgcatctacattttaaacctttctagcctttagaatttggggatttatatgcgatccagtgttaggacacagcaagctgaagacttcttttacatggcaaaaccagccctctgacactgtgttttccttaatagctaatgagacagctgtttagtgacggcaacagggattgatgcagattttctttttttaatctgactaggtccactgcttccagatattgtctttttatttttttagtgatgtgattgattttccaacattttattatacagcaaagttgaacattctccagtgagctcacttatacccagtac

SEQ ID NO: 84762 - DNA, 1093 bp, Homo sapiens
ttggtgtctcccagaagagaaaaatctggttccttggcatttattttacctaccccatttgggggctgtttcttctgccttttcttgcacaacttccccattgttagatgcctctgtagtcactcccaataccctggaaacatctcccttttttagggtttaacagacttcacctgtatagttactgtcttttaatatgactttcgtcctcttatgcttgaaacctagaagaggagctggcttgttctgctggccttgagccagatgtcataacttcaggcagtgccacgctacacatctccagcagtttggaatggagaacagagttagagataagatcagcagctttaggtgatggctttgtttcaaataaaccatgcatgacccaagcctccacttcaaatggggaatgaaattgctttatcctttgacagcttgctctatgaaatacatttatcttcacttaattgctttagatcccaagaggctacatacagtaatttctaggagataattatatcaaattttaaaaatatgtgactgtggacatgaatatgtaactgcagtggacagggagggagagaggtgggggaaaccaaaagtcctgctgaccttgctggtaagtttccattcttattcttagagtttccttgggtcatagaccacttactctctgaatctgctgattcatatgtggggtcctttgtaccccatgctgctagggttaaagcatctggtctactactcctgtagctggatagtgttttgctcagtctcctcctgaaactgggaggggtcaggctggtggctgacttccggttatatgtcttcatttagtctggctgggcacagtctgtctacactgtaggccacagccactgggggttctggttagtggcagctgagaaccagcaaacttgttgattttaaaacatgactatttagatgtcagggataaacttcctgtagatgggggacaggcttctttatcttggagtgtttgagtatccagttctcatttccctaacctttacatttgaaaaaatctaaagctttcactgtcattttcactaatcccagccactgcctacct

SEQ ID NO: 84763 - DNA, 1004 bp, Homo sapiens
tcataaagaaaccctctacctatcgcgtcatctccattttcccttcttcctagcccctgtcaaccactagtttactttcagtctctctagatttgcctcttctgcttctttcatatgaatgggatcatataattatggccttttgtatctggtgtcttctggtttgcttaatgttttaaggttcatccatgtcacagctcatatcagtacttcattcctttttatgcctgaatcatattccattatatggtaattccacatttgtttatccattcatcagtttcataaacatttaggttgtttgcattttttggctattatgaataatgttgatatgaacatttgtgtatgagtttttatgtggacatatgttttcatttctcttagatatatatacctagaagtagtattgtttggtcatatggtaaactgtgtttaactcttggaggaacttccacactagacagttttccaaagcagctgcaacattttacattctcactagcagcaaatgtatgagggttcaatttccccacatcttcactaacacttattattttttttattatagccatcctagtgtgtgtgaagtggtatctcagttgtgattttcacttgcatttctcaataactaatgatgttgaacagcttttcatgtgttcagtggctgttggtatttctttggaatactgttcaaatatttgcctacttttttttttttttttttttttttgagacagtgttttgctcttgttgcccaggctggagtgcaatggcgcaatcttggctcaccgcaacctccgcctcccaggttcaaccaattctcccgcctcagcctcccgagtagctggggttacaggcatgcgccaccacgcctggctaatttttttttttatttttagtagagacggggtttctccatgttggtcaggctggtctcgaactcctggcctcaggtgatccgcccacctcagcctcccaaagtgctgggattacaggcgtga

SEQ ID NO: 84764 - DNA, 1663 bp, Homo sapiens
agatcagctctatgaaagcactttgtaaagattttataaaaatacaatttaggccatgcgtggtggctcacacgtgtaatcccagctttttgggaggctgaggtgagtggctcacttcaggccaggaattgaagactagcctggtcaacatggtgaaacccaatttctactaaaaatacaaaacttagccgggcgtggcagcatgcgcctgtagtcctagctacctgggaggctgaagtgggcagatcacttgagcttaagagttcgagaatcacttgaacatgggaggtggaggttgcagtgagctgagatcacgccaccgcactgtagcctgagtggcagagtcttagtctcaaaaaaagaaaagacattatcatcttgagccatcaaattcactgttactgaaattctttgctaaacctgaaggcaaaacaaatttagtctttttgtcttagaccaaaggctgtatgtttctttggtaggtaaggggaacagagcacaggtgacctacttactcatatctgttcatctcccagtatggggttgcctcctctgaactagggcaagggtcaagtctctgacttggtttttccctgaaaatggtcacaaagtctgctcagcattgtttagggatgtggatgcattggccccatcacctgcccatctaaagtaagcatgttatgtaatctaacaaatatttaccacttagcatgtgccagacaccagagttcatgcttccacatgcttcactaggttttacttaagcatatttttgcattactattgttttttgagaattataacctcccacatatattattttagttcatttaatcatatcttctaggccctttttctcctgttgtttctttgtttcaacaaagagaaatatttaggaaaggagtcccttaagattttacttattttaaatatttttagttattcagatgctaatctgaataactgaaagacatggaatatatattgagatttagatagagcatcattcatctactcaggaacagttgcagacaggtagaatctacattgacccaaacttcagggtggattgtgctttccagaaactattccagttaccaacagtcacctaattgagttcagaatggatgaataagaatggattttcctctctgtggcttcttgttttttgttttttcttttttgtttttatttctggaggtacatcagcatcctctctgtggcttctgatgcaaaggtaagctatatgctttttttttttttttttttttttggggagatggagccttgctctgtcaccaaggctggagtgcagtggcgcgatctcggccatttcggcctcccaaagttttgggattacaggtgtgagccactgcgcccaccctacatgaggtttttagaactcaaggagcttaatagggtcttccatttttagttgtatggtaggattagatacactgaacaaccttctcaattaacacagctaaagtgctccctgtaggctgggcacagtggctcacgcctgtaatcccagcactttgggaggctgaggcaggtggattgcctgagctcaggagttgaagaccagcctgggggaaaccctgtctttactaagaggacaaaaaaaaaaaaaaaattagctgggtgtggtggcacacgcctg

SEQ ID NO: 84765 - DNA, 1043 bp, Homo sapiens
aggaagagagattagtcttattctttaagtaatgttcattctatttttttaattgtgatgaaatatacataagataaaatttaccattttaaccctttttttttttttttttttttttttgagggggaatctcgctctgtcacccagggtagagtgtagtggtgtgatctcggctcactgcagcctctgcctcctgggttcaagtgattctcctgcttcagcctcccgagtagctgggattacaggcatgtgccaccacgcccggctaatttttgtattttttgtagagacagggtttcgccatgttggccaggctggtctcgaactcctgacctcaagtgatccactctccccggcctcccaaagtgctgggattataggcgtgacccactttgcccagccattttaaccagttttttaaatgtacggttctacagcattaagtacattcaaactgttgtgtagccatcaccacaaccatctctagagctttttcatcttcaccaactcaaacactgtacccatgaaataataagtctccattcctccctccccacagcccctgacaaccatcattctatttactttctctctgaattttttttttttttgagacagagtcttactctgcctcccaggttggagagcagtggtgccatctcagctcactgcaacctcagttttctgggttcaggcaattctcctgcctcagccttctaagtagttgggattacaggtgcctgccaccacacctggctaatttttgtatttttagtagagacggagtcttggcatgttgtccaggttggtcttgagctcctggcctcaagtgatccgcccgccttggcctctcaaagtgttgggattacaagtatgagccatggtgcccagcttttctctataaatttgactactctgtgaacctcatataagtggaatcataaaatatttgtccttttgtgattggcttatttcactcagcataatgatttcacgttttatccgtgccgtagcacgtggcaaaagttcatttctttttaatg

SEQ ID NO: 84766 - DNA, 1050 bp, Homo sapiens
tgccactgactagacattagtagagtttctttttctttgtgcatgtgacatggatcactaacactgcatgtgatggtcagaggaggcctgccttagtgctggagatctgaccatttctccaggacagtggagcctggtgaaggctctctgacttctgatcccagttggagcaatgtgttcagagaagaatttctgagccttcgtgaatctcagttatttgcatgtctttttgtaagcaaacagcaacttgtaggcaggcttaaaactttctttttctgctcatgaaagtacagattttgctatagacaaatcaattgaatataaaactgtaatgtggaataatatttcaggctttaaaaatggagggatgggttaaaaagttctgcaataaatctgcaaatgtggaatctaagggaaatgatcccatctggaaaaccctgctagtggtgctatggctggtttgtggagcagtgcagactgtggagtgaaaaaagaccctgtagtcttgaaagatgacaagctccttaattgatgtccatttcagctggtgctgtgccagcttatgttggcctcggtccagcgttcctgtaatttgggagccaggtgtgaagcatttttgttccatcttgttccccagcatctacagaagcctcacccatcttacttgaggcggcagcacgccataggaaacagatgtacaggtagaggtggaaggaagtgtcacagctgggttacggattttttttttttttaatccttcacactcaagtgagatctgggtttgagagttgggggaaagggtatttcacagcctcggtgtaagatgtcactgtcaagtatcctaattagaccaatactcatttgtgatttttaaaaacatatcttattaccttagagtcatactttgtataggcagagatcttttgtgatttgcctttgcctgacttctgggaacagcaatataaagtgtaataggaagaacatctcaagatggccatcagagttgaacctggtcacttccatagcatcgagggccaggagacataacca

SEQ ID NO: 84767 - DNA, 1055 bp, Homo sapiens
tggtctcgaactcctgacctcaaatgatctgcccacctcagcttcccgaagtgctgggattacaggcgtgaaccacggcacccggcctgagctctatctaatctgagtgcccctgaaattgacatttgttcattattttaaaaaaaaaaaaaaaaaggtaaagaaaacagtaaaagagcagctcagctcagttttctgggtccccaagaaggtaccctaccaatgtggttttcacattttcaggtttttggctggtgaataagattgagcagaaatgcttcttcccctgataacaatacattcaaatgcaggatcaggagcgtgtggattaaaaccagacggtggatgattaatacttttgcttatagaggtagacatggcagcttcctccatttaaatgaaaagaccttttctctgcatttgtatgtgtgcatatgcttacatgcttgtgccctttatgtacaagctgcgtttctgtaccatttccttcctctcttgaagcacccaaaaagtgctagaaggactaagttgtgaagcagaggcgtggagatcagacactatggtaggagtgggatgtgttctcttcttcaggctcactgctttcatagctttctgggtactgctgtaacacacatctttttccatggaacctacttgctccttatggtcatgtaacctcattataagaggcatactttttcatttaatctgctatatctttggaggtggctatcctcatcattttattgttaatgacatgaagagaaactttattttcacatggatactttatgttttttcccttacccactgaaaacatgacagatttcttggttcattcgccgtggctcacgcctataatcccagcactttggaaagctgaggcgggcagatcacctgaggtcaggagcttgagaccagcctgaccaacatggtgaaaccctgtctctactaaaaatacaaaaagtagccgggcatggtggcgcacacctgtaatcccagtaatcccagctgctaggggtgctaaggcaggagaatcacttgaaccagcaagg

SEQ ID NO: 84768 - DNA, 1037 bp, Homo sapiens
attactcccttaaattcttacttgtggtttcttttcttttaaggaattactcaaacatttatgtgtcccactcctgtgactttggttagaaatgcacctgggccaggttctactggtggtgggaggagagcttgctgatggtttagggatttctaattcagcttcttgtcgccattgcaatacccagctggttctaagcatttgaaatacaggttacaaatcagccagcattccctgattgcttagtactagaattttgcagactttgtaatgagtgttctgaggtttttgcctgttttggttttattggtgaccaacacctcctgatgaagatcatttgcagactttactacaaagttaagcctaactttaagctgaaagcatgagagccaaacagtaagatccaaagctagacaggattggttttggcaaaaggaaagtccatgctttctgccttcttccctttggcctgctcagtcatactcatgttgggtggtacttagtaagcatgcttctaattgtggttcccttccacttacctttgtgataggggtaccaaaatctgtttaccctcatctttgctctcttccagaggaacaggagaggtagttgggtcagtgtgccagaaaagcagaagttgagtatgtggagttcatagctgcatgtatgagtgtttgtggggcagggaacttttaatggaaaacatttgtgttgcatcgaaaacagagcgaggcctggttagagtctgtctgctttgtctgtcagtctgttccctaccagcactagtcactgttctcctgggagtctcaggcatattgtggtttcttctgctcttgctagcccctaatcttgccagagtttttgtgtcatgggtggccccgtgtgcagtctggagtaagactgcaaggttggtgactaatggctttgaagaaggtacttcagcccacatacggactttgggaacctttttaggttaacccttaggaggagggagggtctctagcacaaacagtggaagaaacatgctgagatacata

SEQ ID NO: 84769 - DNA, 1053 bp, Homo sapiens
gaggcatgagaattgcttgagcctgggaggtggagttgcagtgagctgaaattgtgccactgtactccagcctgggtgacagagtgagactctgtctcaaaaaataaataaataaaatttttttaaaaaaaacctgcaaaagggccaggcatggtggctcacaccagtaatcccaatattctggaaggccaaagtgggaggagcacttgagaccaggatctctaaaccagcctgggtgacatagtgaggccttgtccctacaaacaagtttaaaaacagccaggtgtggtggcaagcgcctgtagtcccagctactcaggagcctgaggcaggagaactttttaagtgcaggggtttggtgctcattatgattgcgccactgcactgcagcctgggtctcagagcaagaccccgtctgaaaaaaaagaaagaaaaaggaaatttgaaaaatataaacatttcctccagcttctagtgttcattactaggaaatgtaaaacatatctccagtgctcatcagtggcagcaacgtgagcagctttattgctggtcgagattagtctcatgtttggtcctgccttgatgcttattctgcagatacttacgaaacacgtattgccaacacagcctgggagatccagacacataaggcaggtatcttcctagttcgagagacagtttgtgccatatataaagatgtgagtggcaccataagtgaatttgaagagttcttgagttttgttgagctggtaataccccggtgaaggcgtgcttcaagagcactgatttggcattaacgtaatcattgtatctttgaagcagaaaagttttcaccttatatgcctttgagtgcaaatactctctttgttctattcttttcttcagtaatttctgctgtcctgatacattagatctccattctttgtcctatatgtcactttttctgtcatcactttaatctgtttttgcttttcttctgcattctaggaaggtttctcaagtttgtcatcttgatatatttttatagcattgattctactctttactacttct

SEQ ID NO: 84770 - DNA, 1875 bp, Homo sapiens
actactgaactcaagtgatttacctgcctcagtctcccaaagtgctgggattataggtctgcgctaacatgcccagctgtatatactgtttgtaatctgcttttttcctaacatttttaatatattcttatatggaatcatttttatagttacccagaattcttttatattccaagatttctttaaccaatctttgctttattgaaccaagagaatgttcccaatttttttacagttatgaatagtgtatcaatttcttgtagcagaatttgagcatatattccctttggttaaattgctgtaagtagattaaggttctagacattgatatatcaaaaactcatactctttggatgcacttaatggctactacatcttgggaatcagagaacccttctttcccaagaggaatacttactttttgcctttccaacaaaaacgtagagtgaaattctgctcttctagtctcagaatgggaaaataatggggatttgtagtatgtgaggctgaggacagctaacaagttgttttatacatgtggaagatgttgagttagaagagagactggatgacatggcttgggccagaggatccccatacttttctttggtgatcacaaggtggtcttgattccagaggatgctttggggagttcgctattgaagctgtcttttagtgtgggacaggtgctgagtagaagagtcctaacgagcttcagactcttcctacgccccatcttcatcagctctctcagctctagtgtcagataccacgtatgtgttttggctcgaggagaacacagagccagcagaccagccctcagcctatgtagtgatccacaggctacctagggggcagtggcggctcagtgagactaaggtaggtctccacttcaacgactgtgaaataggtatgtcaaacctaacatgtccaaatccaaactcctgaatcctgccccacccgctgcccgccaacctggtcttcctttacccttccccatcttggtaaatggcagccttgatttttgggctgcttgtgtcaaaatgcttggggttattcttggcacttctttgtcacacttccatatctaatccatcagcaggtaatgtcttctttaccttcaaaacacacacagatacaattctgtcttcccactgcaccctggttcagttctctgaaatgccttctgactggttgctctggttccttcccccttctactcttcagtctatttttaaaatatcagtgagatcatgtcatttcttagttcaaaaccttctgatggttgctcctctcacttagaggccaaagttttcacagtggcctacgatgccctccattatgtgaccccaccttcatcccactcccaagctctctgacctcaggtcctcctactgtccttcaacccagtgtgctctagtcacattgacatccttgctgttcctcaaacaaaccaagcgctcatgcctcagggtctttgcagttgctcttttcttaaccggaaacactctgtactcggctgtgtgcctctcgcactcccttctatcaccttggtaaagagagcttccctggccacatcatataatcatataaagtggtactctgctttattattctccatccacggcaggggaaaataacatctcctgagtatctatcatgtatcagtccctgagctaggtacttctgtacagtatttcgttaagttctctaaataagcctgccatgtaagtattattacctccttttttttttttttaagagatgagtctcactttgtcacccaggctggagtaagtggcactatcataactcactgccacctcaaattcctgcgcacaagcaatcctcccgcctctgcgggacctctttctc

SEQ ID NO: 84771 - DNA, 1106 bp, Homo sapiens
agcattgtaggaggaaaacatgcatgactcttgctgtattgtgactagaccctccatggctgtggctggaggaggagaggctggtgctcagttgctgtctgtgtggcatgtacttggctggacagcagtggggaattctgggagcagccacaagcactgggtgtctagagtgtttgagtaagcgtctcaggcacactgtctggaaagatgacaggaccctgcattaggcaactgagtctccaaattctttttcctctctggtgaggattaaaaactccccctaatcaatttcaactttgcataaatccacatacacatacctcagattgctgccttgggcacagttttgtttcctagcatttttggggtatgatttcctggcagatgccagcctagacaacatttgctgcaagtacttccctgctcacaaatactgagaatacttttttttactggtccctctttagagctgctcttttcttaccttatttctcacagtgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggtcagccccaggccaaacatccctccccattcgcccctcctcttaattctccagacttttttattcttgggaagttttctgtgcaaatggaacatgattaagtcattgagaagggtgttaagggaaaatatcgaccttttagccgctgacatccagctctgtgtcctgaaaaaaaaaagccctctcgacttcctttggtgtgtgtgtgtgcttgctggcatgttgtatatacgatcatttcctcacttgtttaaatagtgcagcttgtgttggcagtgctctcactcagctccaaatggtttgcatcatgcttaaagcaccctcctttctcccccttcctccccgcccccctccgccacaaagctctgcactaggaaaacagccagggctttttcccttctctgag

SEQ ID NO: 84772 - DNA, 1046 bp, Homo sapiens
gtaacctctcctgtgagaaaagcaaaattttaggaacacagaaacccatggcccctctgagagcagggcttctcagttccctggacgtcagctgcctttctacagctatttgcagaactcacctcagcctgaagggttaatctgattccggagtcaatatcccccaaacaaccagccaggagtgtgtgttggtttgtttctgtgaaatgtgtttccccagtcacctgggctggcctgggctgcattgtatcggccagcagctgcactgcactcaaactgacagatacattaaaccttggaattctgaggcaataaaaagtaaattaactcttatttttttcctttcctggtggactaagtgaatgcatgtctgtagggaagcaagtgagccttggttctgagtgcatacttgtaactagtcactgctggtttgtcccaaactcggatctggctttccgactccagccagggctctgccgtcctggtgtgtggtgtgttctgtggggttgggccagtgggtcaccttgcaactgctgatccctgctctctaatcacatcacagctgctgagagactccctggccatcattctgggagccataagcaggctcattggacacagttgcgtattctctggctgctttgtgtctgcttggtgaacagtccaccctaactttagcgggatattgtggactctgggaatttccctaaaatatgcattgaaccagaacaaaccagaaggacctgcatgagtccacagcactctagagggtccatttagaatcaaaagttgtttgagattatttgggaaaccttctgggaagttatttcccaagcatttccaaaagattggcagctgtttacagatcctcatcgccacccgaatttgacttttggctccttggccctggccaaccttgaatccatagggcctaagggctgctgtcgggtgaaggctagaaggtgctcctggttgggatgaggaattaaagcaggaaaaagctaagcttttctccttctacagacaggaaatcctatgtgcaccca

SEQ ID NO: 84773 - DNA, 1692 bp, Homo sapiens
ggggcgttagcactgcagcctggcaccagggggttcctcttcctccaagtgctgagtgtggggcacacgtgatctctcccacggcaggagcccctgtcccctccccacgcctcccgtaggactccttgtgagaggaaggggtgttggcctaaggctccagtctgaccccagcagggtacagcagctgaccccagggagagtactttccagctctgagctgaggttatttgggtccagtgtgtgctaagctaagaagacgtgttggagtggttacagctaaaagtttggagaggcaggaaccgtgagaatccgcaccagggaggccgccgagggctccactcatgccgtggagatgtcaggatcccctaggggctgctctttcccaaacatacagtgctgatgggtttagcacaccatagtgatatgacagaggctatacatatgagggtggctttggagaactgaaatcaaataaggcgccgaccccgaacatattgggggcagtggatggttgaggtgctctgatacttgagaaatcctggaacgaggttactgtgacctattgctggccatagggttccagctgccctgcttagaacatggagaggtttatattcttgcagtagggcaggatgactaagcttcagaatttgatttgcccttttgggcaaaattgatttagggtgagtactctcccaaagtcccaagtcgacttgttggtataaatgagaaagatagaagggattaccttcatctaagtctggtctctttaggggtcacccagcaaacatctcttattcttagaggatggtgtcttgctgctcatatcttaactcctggaatggtggcctttgatacctttgtctcttctttgtatcatgtggcatctggatgacacattgttgctagaaatctccaggagccgcatagaattctccccatctccagcccagcccagggcctcttgagctacctagcactgaggtaccagaatcaaatccttcgcccaatgcaaacagagttggcatgacatcttggctttccaagaggcatgctaagccatttcaagcccgggtattattcttttaactctgccacacttattggattcaagtccatttctgctattagctgctgaattcctgcagttttctccagtggagtgagaagctctccagggcaacagtggtcttatgttagcctctgacccctgcgtggacagttgtaggctaggatataatggcccacagggaaaccgtttgaaaaggcagatattgcatgtcttaggcgtggttctcttgttacagccatttgtctttgtgtctgtaccacatgggtgtcctctttttcagcttctttgtgcctagcttctgtgccatcttggctgtatttccagatctcctcactccaggaaccagaagacccaacttgtttcccatctgtactgcttctctgatcttccatagctctgaaacacaatgcacggcttcttctcactcaactctttccgggtttgttctgcagctgtggagtttgaatgttagtgtttaaacaagctggtattacacaggaaatggccacctccacaggccccagcaggcttgtaacatggggtcattgtacttgatgttaatcaccagtcagcttgttcccccagtaaaatatgaaggagtgtgtgagtgcctcatcctc

SEQ ID NO: 84774 - DNA, 1054 bp, Homo sapiens
cctggcatggcagcgtgtggggaggctgaatgcatgcacatctctcttccattcactcatgccctgtcttctcaccacgtccctcccctcgccccctgtcttctcaccacgtccctgccctcgtccccgtcttctcactacacctcgccctcgtttccgtcttctcaccatgcctctgccctcaccctcatcccctgtcttctcaccatgagcctgccctcgccccctgtctctgtgtgtcagtctggcatctctcagagcatttgtgtatagcagagagcatttgtgtattgggggcgggggcaggtgttggagtctgtgtgtctgtctgggtgtatttacgtagatcagtttatgtgtttgtatacctttttctttttcttttttttaattgtggagatagatgtaacatttgccatcttaactatttctaagttcggtgacataaattacatttacagagtgttgtggaaccccatatggttacttcttttatctttgtctatatctgtgtctgggttgtgtccgactctgtgcttgtctaggtccatttgtctgtgtgtctgtaagtctgtgtgtgtcttagtgtctgtatctgagcgcaaagttctgtgtgtctgcctctgggcgcttgtctaggggtctttccgtgtgcctggtccatgtctgtctgtgtttacttgtccatgtgcatccatccaactgtggccacgtgtgttgttatctgtatgtgttcatgtgggatgtccgtatctatgtctgtatttgtgtctatacctgtttgtgtctgtatatccttgagtatatatatctctgtatgggattcatgtgtccccaagtaggtttctttcagtgtatgtctgtgttttcatgtctctgtgtccacatctatagctgtcttttttttttttttttttttttttttgagatggagtcccgctctgtctcccaggctggagtgcagtggcataatcttggctgcaacctctgtctcctgagttcaagctattctcctacctcagcctcccgagtagctgggattacaggcacctgc

SEQ ID NO: 84775 - DNA, 1050 bp, Homo sapiens
atgaagcatttgcacagtgtcccacagtttgggtttctctggtgtttccttgtgattaaattcaggtcatgcagttttggcaagaactctggtgccatcttggtactgtgctgaaggaaggctggaagggtgggctagaggccagagtagaggcttcagccaagccacaggtgaagcagaagcagttgtgtccaggggcagacccagtacactggttctctctttgtcctacttttcagaatcctcttaggtgctggcgcttgtcctcgcttctgggcctatctttcctgtggacttggtctcccttccctaagagcttgctgccgtcccagcgccccaggcctcactcgggggctacagcagacataggcccagttctcaccctttgcctctgcagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcagtgagttgacctgcccattgcttcagcaccactggcttgggcctgcccgtgttcctacagctcccctcttcatcctgctctgtttctttctgcccacagcctgcctgcctctctatttcttctttatttgaactttttttgaataccttccctatcctctgatgttttaggttattttttcctgttctccaggcctcttccccctcctctcacactctctttttcctctcactctccattttgttatttgttcttgctctcgttccctcatcctcactccatattgtgcatactcaccatctctgcagctgcctctggagtctggatttgtgtggatatgtgtgtgtgagactttgtatcttctcttattagtttttctgtgcatcttgcttttttttttttttttgaaacagggtatcactttgtcacccaggctggagtgcagtggcatgatctcagctcacccaggctggagtgcagtgac

SEQ ID NO: 84776 - DNA, 1032 bp, Homo sapiens
cccaccaaaaagatggctcctttcggtgacctggagccagaaggaagttagttagccaggctgaaaaagtgacgggaagagggtactgggattgggagccaggtttattttttagcgctaggggaaggaatttgtgaaaacaaaagccaacactgattaagtgcttattatgtgccaagcactgttctgcataaaattaactcattccatgaaagtaggttatttgtgtcatgtgtgttttcttaggaggagggacatggaggaagtaaggatgggactaaaggttggtgattcaagaagatcatttttagacgagatcgggcgcgttcagggtggtatggcagtagacagaagatcatttttaaatgtgtatttttccaatcttaactgatgactgtgctcctgttagttatacactagagagactgagttaattaaatctgagttcttgttacgatggctttacattatcagtaggcagctaaaggcagagaccatgcagctccagctcagactgcccttcctgaggtaaccgttcctgggaaagtgatgtagaattgacagaggtgacccttatcatcttatcaaacacatatccatatgccagacctcatggtaagtgcttcacatgcattttctacttggccttatgaccactctgagagagggaatatcactagccctagtcttcagtgaggaaaaggaagctcggtaacgtggccagtgatgtgcatcttgtccgcctggggcgctgagagtttcatttgcctgtccgcagactgcttctcggaggagtgccgctctgtgatccaggaacaagccgcagctctgggcttggccatgttttctctactggtccgccgctgcacctgcttacttaaggagtccgccaaaggtaagcaggaggagtccccagcctggtgggctttccagttgcctggccttgtccagacctcacagtgccatgctgttttctcggtgtcttctccctgtagtctccattcttcctcttacctacatgcccctcttcct

SEQ ID NO: 84777 - DNA, 1040 bp, Homo sapiens
atgctcttgccaggaaactggctgtgtgcaccaagggaactctgatagttccatcgctgccagatttttctgtgaccaaccaaactccatcccactggtactggtttccttcaaatctctccctgatggcaacactggaattgatcagaagcagtggttctgaaccaccatcccttggctcggcttagagggcccaggcaggtgggcctgcctcccatcccctgctcttccctctccgcccctcctgcctcactcccatttcctgcaggaggatgctttgccatcctggagctgtcaggcacagctttgctttggcagcaccgtcgcacacatactggtgggagaggggacgtgtttatcacttttcctggagattatctgtttaagcacttctctgacagttacaataacaagggcagtgtgttgtgtttcccagcagaaggacacttgctgttgaaagatgtatagcactaattagaaatacataacatccggccacatggcagccttctcccggccgctccatttcctgatttcatgcaactttgacgacagttggtttatgttttccatgaatatattctcagaaaaacgagaaagtctccctgttacataggagcaagaagaatatttctgtccgagccggtatttggccataggaataataggagctgtggtcacctgcccacatgtgggaaggagcagaaccaagttcagacctcaggtgactttcttattaagaaatatttccgtctgacttccttagccaaaacccttacccgaaacccttaagcaagtctctgcttttggaaagaaggggaaaggctgtttcacagtgttaatgagttcctcagctcctgtcatgctcctgctacctgacacaaagccagaggaacccaggcgaataccaaggcaaacaatgccttttcctcccccaccccacatcacttgttggcttggcccagcccaacactagggatatatatgggcattcatcagactagggccagtttcctagatctagccccaaagtgggtgga

SEQ ID NO: 84778 - DNA, 1010 bp, Homo sapiens
gagttttactctgttgcccaggctggagtgtagtggcatgatctcagctcactgcaacttttgcctcccaggctgaagcgatcttccttcctaagcctcctgattagctggggttataggcacgtgccactacgtctggctcatttttgtatttttaatagaggtgaggttttgccacgttgcctaggctggccaggaactcctgagcttaagtgattcgcctacctcgcatcccaaagtgttggaattataggcgtgagccaccatgcccagctggaagcattattattaaaaggtatgtcgattccacagcttctaggtcaggagactagctggcaccttagcacatttctagtcaccttcattcattgctgctttctcacttccttccttggcataactgctttatctagcttattattctcctgacctctactttaaaactagatgcaccacagtgggtggggttggatgaagtcattacgttcgcagtttggtttggacattgatcatggattctgaggccttgaggaaccattttgggatgagtttctggagcagagtcaaatgaatgtgcagatctggatattcacaaggtaaccaccaaaaaattgtgccttatcattggtcttatttttcagtactgacccctcaaagtttgtttgatgactctaatctttacattctggaagcttcctgaaaaagctaacttctcagaaggcctccaagaggtcctttttattctaggtacctttctgtctcacctatctcggaattgttttatttttggcgttgtttacaaacactgtcagacttttaaaaatccttagctgggcatggtggcacatgcctgtggtcccagttacttcagaggctgaggtgggaggattgcttgagcctgagaggtcaaggctgtggtgagctatgaccatgccactcaactccagcctgggcaacagagcaagaccccatctcttaaaaaaaatcgttcaggaagccacagaatgaaa

SEQ ID NO: 84779 - DNA, 1061 bp, Homo sapiens
agtgccgaacgtaaagccaactctgtggtttgtcttgtgccactgggccagcagcactgcagtcctgatcgattgatctgcagcaatataaaaccacgaacagcaactgccagacaaaactccatctcaccccatttccctgtccaacctgtctctctgcccagatcccctttctttttcctcgtatgtctgtctcactcttgcttatgtatttcacttttttgggtctatctttttccatctccctgtctctttccataacagttttaataatgttttagttagttccagccttttcgctgaatggatcccattggaaaatgcatttgaaaggaaacagttatacacttcccttcctttgaaactctgttggcaccttttccagtgcagtaaaccatacaacatgtattttcaaagtttccaaacagacacgctggcattaaatttatgaaaaaatattcagctatatggtaactgtgactttcagagatgctgatcagatttgaaattggtactgacttctggagctccagcaggttttcagatctctgtgggaaatataaccaaactggctcttggggagtctgtgatgcttggagccttggcttttgattggcaggttgggcaggaagagttggagcgagagatgtggatgtggggatccccagccacacccagagggaaacagggaaggtcagtgagtcagtgaagaatatggcatagccgtgttgggcacagtaacagaatgtatattccttctatgtgtctatgcatagaaggtaaactactttctgtttattccagccaagactgaaggtcaaagaacgccctttttttttttttttttaattagatggagtctcgctctgtctcccaggctggagtgccctggcacgatctcggctcactgcaagctccacatcccgggttcacgccattctcctgcctcagcctcccgagtagctgagactacaggcgcccaccaccacgcccggctaattttttgtgtttttagtagagacggggtttcaccgtgttagctaggatggtctcgatcccct

SEQ ID NO: 84780 - DNA, 1622 bp, Homo sapiens
gagaggagaaataacatttatcaaagtccaggagacacatggaatttaaccgggaggattttgcatggacaattaagaatgacagtcacattttgcccttactttttgtttaaggatttgactagtttgtttaatatacaccttttattataaatgagtgtgtcagcgttgactgccggtttctagtcagacttctcagcaccagccctgggtgaggggctgactggctcagcatgtgagtaacgtctccagctttgtcatcagtgttctgggaagagatacggggcacagccgagaagccgttgccgtccacctcgccttcactctgcagctcttgtgcaattgcctgctctgttgttgtttgtttttcttcttcgggagcctggattggggtgggggggattgagagtggggtaggtaggaagattgctgtttctttgctggtcagactctccaggctctctgcggagagtccaggcaggatctgtctgacttggattgcagttctctttttctgctgagctggggtgtgggcagcctaggcctgtgtaactcgtgacaggcctcccaaagtgccatgatggcatggatcctcgtggagctgttgagaacaaaaacagggttagtgaccttttgtttctttttgggcatgggttctgagacttatctctgggccttatgttcctgctagtgactctaggtcccccggtcctctccccatcatcccctggctgacaaatggttgaactctcagcttcctgtacttgatccccaaacagtgtagttcagtaaaagtagtaattagggcttttacaaatttattttattagtgaagagagttggtaggtaatgggctgtaattctaacacagccagtttggagattaataaaaaattttaaaagagcagtttttaccagaggcagtgggcccgttatttcaagttctcggctgagccgaaatcagagtggggtgggatccgtggtagactttgttgctgggaggatgcaaagccacgttccttgttgttacagtctgtgcagtgcccatccttgagggtgttttaccctggcattggaaaaaaggaaaccttgttttccaagaactctgctctctctcagcttgataagcatttaaaaataaaagctgcacaattgaaattggcagtgcatcctcattcttttgtctctctgtttatttttttccctcatccctcaacatgtgtgctacagcccatggttattacaccctcaagaatgatggcctggaactcagcaaactcgcaccaacgtctgcccgccctgcattctgttgtttgaagctggctgcggcatcagggcctagcgctgagaggccgggtggatcagcctccacagctccatctgtggcacatttcccttctctgaagctgctgcttggaattttgagcttctccagaatcctgattgtcagctcaatctttcttgttagtttttgtagttaacttaattgatttgtttacctctccattggaggagctcaaaaagaaagtgctttggcactcagcagagcagttctgcctcttgaaaagattcttctgaggtagagttttataatactgacccagagaagaaaaaagatccta

SEQ ID NO: 84781 - DNA, 2071 bp, Homo sapiens
caaagattagtttcttttccagctcctgcccatttacagctcagtcttatggcaaatggtgtcattgggctcacattttttcatttttccaagaggtgtccagtgtatagaatatcacttagagggctaattgggtggggaagaaagatcaaaggagtggagaggaaaggctgcagctgaagtgataggagccatttattgacaaaaagatgtgagttagagatttggaaaagagtactctgttgtttcagctacatcacattatatatctggtgaaccttgctggcccatgaaatcctttccattagtcagggttctctgtgcttttgttcttgactactgctgttcttagtgctattcggtttgcttgtatgtctcagtttccttttcagaaggcagattgtcgtctatttaggaatgcatttactgtaattggagtgttctggcttgtttagtcccctcttcaaatataagactcatatcttgaagcttatgttcagaaaatatgcgcgtgtgatccctttgccccaagtgccaacagcagatgtagcagttgacacgctgcagggaatttccaactgctgggcaggtttctgaaatccggacacgtgctgttcacactttggcttctgaggcaaggatcagtggttgaaagaggggaggagctggcaggggactgcagggagaaagatcttataatgcctgcccagggctttaggctgtgtcagctttctgcatctcttctccagctggagctggcagggtcgaataaatcactgcagagtagttatgagcccagctcaccagggacttctttgaggcacacctgtgacgtcatcctgttatcactgtctgttccacataacctcttttcacctctcccctgagagagggtgatgcccagaactcatgtcagggcaatgagcagaggaaaatgtttcgtaagtattatttttcagatgcctgctagggatacagttgtaggccattgacacattcttcaatattcctcattggaagagaaaacctgtgtttgcaaacatggcctgaataccccttgtggataaaacttctttttaaacttggaaagaaagtcttgaaactcctaagtggtctctttttgtaccccttacctctctcgttccttcccaaacatgcacacacagacacattacatacagagtctgctgtgttcaaaatccttcactgacttcccatttcactcagtgtaaaagccacattatttacaaggccttcatatatggacctcttctcctgccccccccccccccccccgcccccgcattgcctctctctgagctcattcacgactgttctccccatggcttggttactctgcttcagccacactacccttcttgcaagttctctgctaagctggggactctcccacctttggcccttcgcattagctgttttctctgtttggaatgttctgcatccagccatctgtctggtgaatacctcgcctcctataagtctttgcttaatgttacttctgtgagacctgccccaaccatcctatttaacactgctgcattctactccaaacctgcactctttatcttccaattctattgatttattttctaaatactagataattaatgtgtatatgtttattatttattttcctctactattctgcaagaatgtaagctccctgcttataggggtctctggtctgttttatccactgatacattgtgaacatctaaaacagtccctgacctgttgtaacttctcagtaaacatgcgttatatcaagttcaagtcaaagaataatttgaggccaggtgccgtggccgacgtctgtaatcccagctctttgggaggccagtgcaggtggatcacttgagctcaggaattcaagaccagcctggccaacatggcgaaaccctgtctttactaaaaaatacaaaaattagccaggcatggtagtaatcccagctacttgggaggctgaggcaggagactggcgttaacccgggaggtggagcttgcagtgagccgagatcaccccattgcactccagcctgggcaacattgc

SEQ ID NO: 84782 - DNA, 1041 bp, Homo sapiens
ccggtggcagcaagagggcacccaagagacacttcttgcacgtgctattggtattgcctgcttttagggaatatttgggagctgggattaaggtagagcctgactggcattcctttcattatcatttatgcttgctttttttgggtggggggagggagggacagaatcttgctctgtcgcccaggctggagtgcagtggtgcgatctcggctcactgcaacctctgcctcccgggttcaagcagttctcctgcctcagcctcctgagtagctggggtcacaggcgcccaccaccacgcctggctaagttttgtatttttagtagagacgggggtttcaccatgttggccaggctggtctcgaactcctgacttcgtgatccgtccgcctcggcctcccaaattactgggattacaggcatgagccactgcacccagccttatgcttgctttgaatggtgttagtaatcctgaattacagaaggtagagggagtgtcacatgtgggtctccagagggagagagagctagctagctagctacagctgtctgtataggactgatagctttaacttgtaggtgtgggatgtttcatgccattgttgtgatgggaggtgactctagttgagtttggttcgcaaccgaagtgtccttgtcttccagcatacaacaatctcagagacgttcagaaaagcagtatgctcctctgtggtgattcacttctgtcgtgagtctcttacccaagcagaatgtatgaagtgcctaatcctccgcttgtcagaacagttgtacaggaaatccacctttcataaggggttaggcttgagttagctgtgtaaactggccccctcattcctcctcctacatctctggtggtagaaacccttgggctttttctctacaaggatctctgtgggtagatttccgtagggaatcattgccacctgactttcattttcaggatgcctcagtttagagaaaatgaacagagccagcctgagcaaggaattttgtgagaagtagattcaaagtagaagtagattc

SEQ ID NO: 84783 - DNA, 1075 bp, Homo sapiens
tgagccgagattgcaaactatactgcagcctgggcagcagagtgagactccatctcaaaaaataataataataattaagaattaaaagtaaaaaaaaaagaaaatacaggtaaaaggaaggtaagatggtgagtacagagaaagaaatcggttgttccctgatgtgaggccaaggcactttttctaggactcttccatggtgggtcataacgagtaccctctagccaggagagacatggaaaaataaagcccgtacttgagaccctacttttcatgactggtctgctcctgactctcacctcattgtcacctcgatgaggtcactggggccaagaagagtatgggttgaggtgttcagaggctccaagggtgtttcaaggaaaaacggcccaggccacaggatataacactcagtgaggacagagagctctgtggacgtgctgccaagtacccagtgtgcagctgaggtggccatccagaccccgctgtgtgggctgccattgggacaggggcgagcagagtgctcggcagggctggctggtgggaagatgcacttttccatttcccagcacatgagtcatcatctttggtcccctgtgctgtgctgtgcttgcctggacagtggcaataagggggtgttgtggctgagtagcagcatctgtgccgggggtggagaaggaggggggttggggagagggtaaagattgaaatccttcactaatcagcagcagttcgaatcacatttttatgagtaaggaagtgataaatcagcgctgtgtgttcaacccccaagtcccgtcagccagtgcccttctaaaggtttctcccctggccagtctgcattctgtcagagttgccacccaccatcagggccctggctgcctgaaaccaggaagcaagagcctgatgctgccttgccctcccaggtactggggtctgtggtgaattggcagtcactgcaagctacagaacatctgggccatcatttttctttccattccttcttggacatgtccttctgggtgggtggctgcatatgtcagtttccggactctgtggagaaggagcattccag

SEQ ID NO: 84784 - DNA, 1366 bp, Homo sapiens
ttgtttggcataaccctaaggcccatgtgcctggctactctctctagcaccaagcttgaacttgctttttatttctgaagacttcagctgtggtttgtttctgttgccaaagaagctccaggcatgcaccactgtttgggatccagtggccacatttggcaaggagtgatttgaatgacctctccttaggagccctaggtcactggctagatttctgcctccctgcgttacagcctcttcctgtattgggagtggcacttggccagggcattctatttccactggcctgaaaacatacagaccccgatgagcagagccttgtgagagggaggaggacggcaacacacgaagaactgagacagatgactgggggcttctaggtctaggcattcttcaaggggaaatttgggatcgttaggcggaacagtcagtgtgatagtacctcagaagacaatagcagaactatgtctggttacctaaagtaaacgcttgggtaaaatatctttaggccgagtgcagtggctcatgcctgtaatcccagcactttgggaggccgaggcaggtggatcacttgaggtcaggagtttgacaccagcctggccaacatggtgaaatcccgtctctactaaaaatacaaacattagccgggcatggtggcacatgcctgtagtcccagctactcaggaggctgaggcaggagaattgcttgaacctgggaggcagaggttgcagtgagccgagattgggcgaaaaaagcgaaactttgtctcaaaaaaaaaaaaaaatttttttttttttgtttagattcacattacttttttaattgaattaagtttcataccagagagtttagggactgtgaaggtttcaggaaatttgttgagtatttagaaaagccgatggtttcagagagaaactttgatattagcttgaacacagttattgccaggggtgaggaaatagcataccaaagcataataactcatagtgatttatccaaaacttgagttgtttgcatctctggaccctgaaaactcctttatcttgaatttgttcaaaattgcaggataccgggaaggtttgtgaaagtagcaaagaaatgtcctaggcagtagttgtctggtgtgtgtgtgtgtgtgtgtgtgtgtgtgtgtgtgtgtgtgtgtgtgtgtgagacagagtgagagagagactgaaagagagaggtgcctcattgatgggttttctgaatctgcaggatggagacattccctgcagtggctgagaaggtcctcaaggagttccaggtgttactgcagcacagcccctctcccattggaagtacccgcatgctgcagcttatgaccatcaatatgtttgcagtaca

SEQ ID NO: 84785 - DNA, 1108 bp, Homo sapiens
cccatccctagtgcccaccccttagaccctggccaggttattgtgtcactggggactctgttcagtaacaggaaactggggaaagtttaattgttttctcctctccctttttcccatgcagctgaacaaaaggttcatcctcagttttctccatgcccatgggaagctgtttacccggattgggtaagtgtgcaggatgtttattttattttcctacattacaagtcattttggaatttaatattgttagcaactggactgtgtttgtaactgagggcacagggtgtgaattcttagaggcctccaccttctcttctcttcccttcatcttctgtcctactgtgctcatgaaatttggtaaatattactctctatctctcttgtttcttctttctctacctttactaaaacactcctttaaatacaatcttgtcccagcccccaccccagtccctctgggtttctctttcctctgccttccggcttaggtccctagtgagtgcctcagggcagttgtgctaaatccctgggtgcagctgtcagggggtcctccttgggaagaatactgtccactacttttccatcaaaaataagagtaacattttctttctatatccttttgacccatatcctttcctcctatgctcagattcctttgccatattgctgatctcattagataccaagcctcttacggtttcatcatccaccatggatttccatagacatctcagggaaggtagtgtgtgcaaaactaacacttgactgcttaaattcctggaaacagatcgagttttgagtattcctttattccttggatggatccgagttcttcctctctgcataaaactagtgatcctaagcccaacgtaatgcctacacgccagagcagatggatgcctggtgcctctttagtataggatctccctgagtataggagagtgaagaaagtagtaggtggcagtgcccccagaccagtcttccactagaccagttttctactggattctaatattttctgagttggaagttgtattgtgagctaccctttggggtgatttgttttgaattatgaataccccagttattgtcaatgtttccctttcac

SEQ ID NO: 84786 - DNA, 1033 bp, Homo sapiens
ggctggtcttgaactcctgacctcatgatctacccgcctcaacctccaaaagtgctgggactacaggcgtaagccaccatgcctggcctgtatcttttttcttttttctttttttctctgagacagtttcattctgtcccctaggctggggtgcaatggagcaatcatggctcactgcagtctccgcctcccaagttcaagtgattttcctgcctcagcctctctagtagctgggattacaggcacccaccacccggctaatttttgtatttttagtagagacagggtttcaacatgttggccaggctggtcttgaactcctgaccgcagatgatctacctgccttggcttcccaaagtcctaggattacaggcgtgaaccactgcacccggctgtacaagtaacctttatatataaccagtttatgaaagacttaggatataaatagaaccagtttataagggattccttctgattatgaatgaattaaccaatttatgattgacatctataggaagagggataaccaagttaaaataggaagagagagagaatgtgtattcttaactttttatttgaaataacatcctatctgtggaaaagttgtaagaataacacaaaaaactcccacatattcttctcccagattctccagttgcttcatttcaccacttgcttcatcatttgttaggagagaatgttaacaattgagtgtttacaggtcaagcgagcatttagatccgttgcctaagatcccaccgcaggtaaatggcagaggtctttcatgggaaggtccctgtttctcaccatcttcctctactaggaaatctagagatctgcattctggccaggtttcgccactaatgttggtgtagccatgggcaatttattttgcagctgttcctcactcttgtattctagtgtttttgtgttttgttttgttttattttttgagacagagtttcgctctttgttgtccaggctggagtgcaatggtatgatcttggctcactgcaacctctgcctcccgggt

SEQ ID NO: 84787 - DNA, 1087 bp, Homo sapiens
cctactgatttagctcaatttccctcagtctgctggctttaactaggagggataacgaagtaacaaattgctttagtataagaggcagcactaaactgcagtgcaaagttgagaggcattgtttcaaggggtgcgttagttggaagaggtagttttaaaaggcacattttacacttaaattcacatgtctcagatctagccatcttaagtgggacatctgtacaggaacttatgtttaattgaagctaattgagctgtcatccagccctgaacagttctggagtggaggaagtaaagggtgaagagctgttgccatcccggttctacctcagcctcagcgtggctctttggtccaagtaaggggcctaagggttgatttgatttgctacatcttcctacgaggcatttgagtcacgctatttggttttcccgtgcttttttttttttttaatctgtatatcctggaaagaggaatgctgaaagtactaataatgaataactctgtctttactgaatgattattgcattactgatgggtttccacattttttgtaccaggccccccttccctcattttttttttttcttagattccatctcatctctgtgacaggaaaaatgacagtaagggaaacacagtgcctcctggaaccttcataggccttgtcttaggtgtgggagcataaatggccagtgggcaagttggtatgttatttatctttgttcttggactataagctccttggcatcagagaccctatcttgttggtttcctcttatgcccagcataggagcgcagggatgaggatgacgtgtgaacaacatcaccagtgcgcccacatcctcctccgccttgtgatctcattgcttgagagagactgataagtgggctttgattgaatgctgtgaaagtcctggctgttttactaacaggtactcatgaaatttggtctccacctatgttgtctcatatctaagaggatagatcccttttctaaaatgcaagaaagttttgtttttttaaaaatatatggggccaggaccagtgactcatgtctgtaatcccactactttaggagggtgaggc

SEQ ID NO: 84788 - DNA, 1049 bp, Homo sapiens
aaatacttgcaataaagtgttataaatgtaataatagaaatatatacactggacagaggtaaaagagattaactcagggtgaacaggtagagcgacctagaaaggtaatctttgtccttaattttgcaagtcaaagaagtattttaggtagatgtggtcagctgacttttctggcagaaggaacaacatggataaaaacatagcatggttcgaaactgcaaggaatggttgcttctgagattcccagccaagattctgtcattataatgtcttgggccatggtacagatgtccacattggtgctgtctgatcactcagttggaactgaagattcatcacaatgtagatagatttgagcttttgatttggctcaagcttagaagtgaatccttcaaatagttctttctctgctttattttatgtattagcaaaggttgactcactctaaagtcatgccttccatcattctgggaagctttctgagccaagcccagcttggcttaggaataagttatgctttgtgttgtaatcattggcactaagtcctattcttgactttcacacacacagtaggactgcagctcctgatgcgtatgggaaagaggaattgtgataatactcgctatggatttacatttttctgggattttttttcttgataaagatgctaaaaccttattcttgctattgagattttgagtttacttgtgccacaaatctctgagatgctaggtcctaatttgtcaagcaaactatgttaacacatttgacattctcttctgaggaatgtctttggcaggttttcctttagacttctggacagatctataaaactctatggcttttgaaatacttgcaagtgacatatgtcaaaaggttgaataaggcactaatagtgcccttcgtgctcctaggaagctgtcacttgtggtcactgcagaccaggagtgagatcttatgggttgcattcctaaatttctttttgtttgcatgaacagattttttaatctctttccttgtctttacatccgtacactggggatatagca

SEQ ID NO: 84789 - DNA, 1398 bp, Homo sapiens
ctgtgtccagcctaggaagtaatttaatgttgcgtttgttgcttgacacctattttaagaattgagattgatttgtgatttatgaaaggtttgttttgatgttgctggtgttgtgaaaagcacattcctctctatgtgagagatggagtagccatctttggccttaatatccagatgattttgaggtctgtgggaatctgtatggtgtacttgagggacttgttcaaagccaatgtaaagatgtagttttggcatctcatgaataacctgatatcccgacttaagccagaactctggcattagagaattttccagcttgggagagttgactgagaaaagtcctcctttggctccttgccaagttagacaagggagcaatcagctgctgagttccagccaactggaatgtacgtgagggggtactataaatcgtcccttaggatccagcttgtggtctgtgaagagccttccaaataagaatgagacctgtacattggatccttgttcaatctgcagctgctataggaaggagtagtgaggtgatgttactctgggagcagctcactttatatagtaacacactgcctgttatgtggggtaagactgcactaccctttatgtttttcccgtgttgcgtttctcaccaacttcctatattggtttttgtttctgactgttctcttggggagctgtatccatagtttgatcattctgtaaaatccctctttgctcttaaaggtgccagaatttcatctctctaccctcttttcaacatcttagatctgatgtatttgagctaagatagagaatatgaaatcgttgttttcttggctcgtgatccttccccagtctgcgggctgtttgtttgactccagggggaaactccaggttcttcccctcttggaagcctttcactttactcataaatatttagtattgaagtgaactgtgctcttttttttctccctagtatgagtggatagactctctagaccagaaagaatttaaaatactatctgtaccctctgtctttctgatgttttggttcctataaaatgtattaaccacacatttttatttttaagagcttaagtggttttttgagttgtcttccatcttctgatccaaaatttgttgagcatttattatagaaatcactaggcacctctcctgctactgttttttccgtgtcgttcatgcttagaaccatcagagagctatgtaactaggtaacattggttactagtagtactgcttttactgatttgtacttgagtgtgtcatcagcctctatgaagatacataaaaaagagacctagagaaggattgctgtttgtgttgcgtggtgtctttgtggaagcctgtggaagaaatttctgctcttagtagaaaatgggt

SEQ ID NO: 84790 - DNA, 2409 bp, Homo sapiens
gccaggatggtctcgatctccttaccttgtgatccgcccacctcggcctcccgaagtgctgggattataagcgtgagccaccgctcccggcctaatttttgtatttttttaagtagcgatggggttttaccatgttgaccaggctggtttcaaactcctgacctctagtgatctgcccacttcggcctcccaaagtgttgggattacaggcatgagtcactgctccccacccaatattttctttagactcatcatttgtcttttcagtgccccttgcgtagtttgtgcacctgagctgctgctgctgtgaaagctgctgtgtatgagtggtacacatctaattcctccaccctccccgcaaaacaattatagatcagagcatggttttataaggtttccttagacaaggtgacttgctttctgttggaatgagttctaattcctagagttgtatcatgaggctttaggtttatagtttgagagccagtacccattatgaagcttagaaaaagcttttagactggacacagtagcacatgcctataatcccagcattttgggaggctgaggtgggaaattgcatgaacccaggagttggagaccagcctaggcaacataatgagatgccgtctctaataataataaaaatatttcacttaaaaaatacataaataaggctgggtgcagtggctcacgcctgtaatcccagcactttgggaggccaaggcaggcggatcccgaggtcaggagatcgagactaccctggctaacacggtgaaaccccgtctctactaaaaatacaaaaaattagccgggtgtggtggcaggcgcctgtagtcccatctactcgggaggttgaggcaggagaatggtttgaacctgtgaggtggagcttacagtgagccgagatcgcgccacggcactccagcctgggcaacagagcgagactctgtctcaaaaaaaaaaaaaataataataaaaataattaaaaatacataaataagtaaatacattaaaaaagaaagcttttggcctggttctctctggatagcacaagcactgatttaatctataatgataaagaatagttgagtctctgcactagtaggtaagtgctttatctgtgataacccagttatttcattgtctcataattatatcatcatgacagagaaagccagcttaattttttggcctcatggatataaagactccatatcttgctgggaacagtgactcaacgccggtataatcccggcacattgggaggctgaggcaggaggattgcttgaatccaggagttcattcatgactagccttgacaacgtagggataccctgtctctactaaaaaaaaaaaattagccaggtgtggtgggtggtcctagttactcgggagcctgaggtgggagaatactctggtctggaaggttgaggctgcagtgagtcttgactgctccacttcactccagcctgggttacagagtgagaccctgcctcaaaagaaaaagattccgtatctgtaaggtgggcatcagaaaattttttagggtttttgtgagttgacttcatgtctttaattagtcctatgcttttgtaaagtagtttgcaatatgtacctcaggctgtactcttcactctggaagctatttgaaaagtgtgtgaactgcagtttggcagcacgtgatgacagcagttcattagagcctctttctgtgggaagaagcagattggttttctttttcttaggccatgagaaacagcttagtgggatcctcaaagaaggtcagaaccagaaccgggtttttcagatgttgataatgtgaggtgggttgcaaggagcagcccctggtaggcaaggattggggctgctttgtccagatcactgctggactgtaaggctaatgtctttgtggttggtagtgagtgcaagtttctcaaagtacatcagccctacctataaacccttaatgccccaaatgacctcggtcaccaaaccacttcagggctttatttttatcctatccgttttgtttcaatatgtgaggttggtttctttcctctaacagagcagagttctctgggggaagaaacagagtgccagggtgctgctgaggctggttaaacaccaaaaccacactcttcatctttctggggttgagacgtgacataagccatgctgcaaacgccagcttccacactgaagaaacctctctcagtagtcactttgtttattttttgtgtattgtgtttttaggcaaataaaatatagaggagtaaatggtgtaccttcccattctgctgtagacagagatctaacaatgagcacttgcttaaaatctgccatttcccagcttaaggtttttcatcctccccgagagtgttgatgagaactctcaaaactcaccag

SEQ ID NO: 84791 - DNA, 1046 bp, Homo sapiens
gtaacagcagatgtggataggcctggctcctaacatgatcctgtggtgaactggggtagctgtagatgtttggggtgtgtgcgtgtgtatgctttgtgtattcctgtgcagcttgattcaactggatgcagttctctgtgttacctggtgtttcttgtaaacaaaatcacacataaggaaaggcaaagtttgtgttatgcccaaattgttcgtttatgtatttatggcaatgaaacaaattctcattttcaaaatgaacattatagcagaactgggtgattagccttaattggaattgttcctttgacaactcctagagaatttctaatacagactgcttaaatttagatccatgagtaaacagaaagtttggcttcaggtggttgttagtaacagtggtaacatcccaactagtctgttctctgccaagcatttgctttggatctttctctctctgaatggttgcaggaggttagcttgtgggttgttggtttttagtcttgagatgtggtttgggttgaacatccagcctggggagggattgccagcctcaactgcaagtagcatcctattgagattcacatttcaactcttccacctgccagccaggaccctccaaatccacgttgccagggttctgggcatttgttatttagtggctatatcttctgctgttcttcgtctccctttagaaacggggtactgcttgtcaactgggttgttgctgacagtcagggagttaaggatattaaattacagcatcagaaatcattttcacactgaaaagcaagggtctctgatagaactgctgaggattttttagatctgattgttttgttatcagcatcttgaatagaatgtaatacatgtctgtctgctggggaagaaagcatataggattgggagtggttgatagatgatagactgatagacttattttaattttgttttgttttgtgacagagtctcgctctgtctcccaggctggagtgcagcggcgtgatctcagctcactgcagccgccacctcctgagttcaagtgatct

SEQ ID NO: 84792 - DNA, 1081 bp, Homo sapiens
ggtgttgtacaggtgtccctattggtccctgtagtcatgccttacccctccagggttacatctaacactctaccttatgttttaagtattagggctatcaggatgaattgggaaaaagctaatctggaactagcattttcttactgttttttctgttctagttggtacctgaaggcccagcacattgctcccaagaatgggcgcccctataaccagttggctttgctggcagtgtatacggtaagaaatcctgtggacaggggaaaagtgctttgcaggaagtatcttacaatatggagtttgataatatcagttcctggagcttcatttcatctcatcactgtagcccaaagaatatcccctcaaactccttttgttacggttactctcagaattaagttgtcagggattcctcacttcacttaactctgtacttcatctctccacttaccactgcactcaaattcctgagggaatgctcatgctccagctaaacaccattctttgtttctgaccagagctgccactctgaattttgtcttgattctcttccctttctgttgaactaggcaactcattctagacgaaaaataaggcttacttctctcccttaaagttttcacctacctctaagtagtcagatctttgcttcctttccctagaccctgttacttcttttaactttttatctgaggtgcctccttagcagaagcacagtaagcagcaggttgtacctccctaggtctaatcactgtgctctaaatatgtctgtaatggagaagcgggccttgggagctgagacagctcctagggagaaagctcaattcaagggggaaagtggggaccagtggtaggtaccagaggttccatcgtaagaaacaaataagatgctcattagcaaggagaaaattgtctctctctttttttttttttttttttaagagaggcagggtcttgctctgtcacccaggctggagtgcagtgacgcaaactactggcttaggtgatcctcctgcctcagcctcccaagtaactgggactgcaggcacacactgctgcacccggatgacaagtatttttc

SEQ ID NO: 84793 - DNA, 1300 bp, Homo sapiens
tctgtcgcccaggctggagtgcagtggcacgatcttggctcactacaaactctgcctcctgggttcataccattctcctgcctcagcctcccaagtagctgggactacaggcgcctgccaccacacccggctaattttttgtatttttagagagacggagtttcaccatgttagccaggatgatctcgatctcctgacctcgtgatccgcctgcctcggcctcccaaagtgctgggattacaggcatgagccaccgcgcccggccctatttctagtcttagaaataattatgcatcctactttttctttaagaaaaaattatctttaagggatcatggaatcttgaaatggaaaaagactttctagaatgccaagaaatgaacaacatgtaacttgcagtgaagatcttatttcagttgttaaatttaggtgaagacatatggggaaaaactattttcctagacacaactatctttagaatgacattctgctctgcagaatggaaaccagagtgagtagtatacctacctggtcacattttttatttcctgccaggggaggtggttaatttgcaggaatctcaaaacttgagtctagctttttctgtggtgtatttggagctggaagttgcatgtattttattccagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgaggtaaactgtcatctttttgtcctcaggataaaggcttcagcattctgtagttacgatggatttttactacctgaaatactatgttttagaacagaatatcgacaaaaaaactgcccttttcttgggttctgagccttccctacaccagttgcttccttgggaccataaattactggcaattggagttttgaggttgaaagctttctgaatgccttggcctaaaagagagagaatgagaatgtgtatgtatgtgtttgtgtttgtgtggagagagcgtgtgtgtgtgtgtgtgtgtgtgttcatgtgttcatatctttaaaaccatggaggctttgactgtgaatttgccttgttctcaaattggtggccagtgaatattgtgcgtgcctcccttttcataggatgtctgaacatcagcagaactgtgaaagggttgtctgccccggtttttggtggatag

SEQ ID NO: 84794 - DNA, 2322 bp, Homo sapiens
aggctctatagatagagaacagtgtagtgctgaaaaggttagagaggtcttttgttctgacaataatgaggtagtttgggatcttggatttctgaatatgacttggatgacacataaggagatgggtttcccccatttcacttacccaagtgtaggtagccccaacacagttaggtccttagccttgtgaattgttgaacaagtgttgtaaacccagaatttctgcttctacagaaatgtccttctttgcctaccagtattagcatttggatatgtaattcttgctcgactttttttgttacttaaccagaatgacagtctttcccctatcttccttctttattcttatcttctacctttccctcccaaactctttccccgacataacagaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggctgagatagaaaagagcccaggtggtgggagagtaggggctgcaaaaggagaaaaaggaaagaggatgggaaaaggggagggggtgagggaaacccacgacgacccagcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcaggtatgatgtggtctattctggctggagggaaatggggatcagccggaggtgtatagattgctatggctgaggaaggtagaaactttttagctgagccactgggtattatttccttttcacgttgtaagggaagggcagttggaaacagaacagaagttttatttctagtcttt

SEQ ID NO: 84795 - DNA, 1026 bp, Homo sapiens
cgcgtcggagctgcgcgggatcctggctactctggccccgcaggccgggagcagaggtgagtcgcgccgcccagctcctgggccgggcctgcccgccccgcctccctctcctcctcctctgcctcctccccgctcggccctcggctccggagcccccgccccttcccccagcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaagtaagaaagattctaagtgtctcacctctcctgcgttaggcaatagagttgtgtagaatggtagctgtgataggtgccttctctaggtttgcggccagtctgtgaaattggtttttgttgattaacataattggattattaaggctattttctcccgctgctctagaaagtagtaggaatagctttccccatccccccgccccccaccaagttacagactgccgagggtgagctattcttgggttaaactgctttatctttgtggatacttcatgaacctaccttttaaacttatgaaaatagtgaagcactatccaaaacctcagtctcttttcttccccttttccttac

SEQ ID NO: 84796 - DNA, 2192 bp, Homo sapiens
gaggctgaggcaggagaactgcttgaacccgggaggcagaggttgcagtcagctgagatcacaccattgcattccagcctgggtgacaggaacgatactcaaactcaaaaaaaaagaaaaaaaaaaagttactgataggactagatcgtatcttttaggtgcattgaggcagcgaaaatttttgagaactggtggtttagagaagtagaagctgccataggtttaagagttgcactaatacagcttttcacaggcctctatcacctctggtttctcaaaatggttttgcttttcattttttaacccttatggcagcggacaaacataaattgcagagattcctgactgctgacatggccctggtggcgacagtctatgcgccaatcacttttcctcctgcatctgtgctgcttttcaagcaaaaaagcaatggtaagttgagccacagagatgaacagaccctgcaggtccttaatagatgaacaccgttttctcttgtttatttaaatttgggagccaaatggtatggagaaggtaatgatggttttcaaaatacagtaagtcttcatttaacattgttaatagaacaatgaaaactccaacttttacgtgaaacagtgtatagccagtcctcaaataactgccttttgttcaacatcctttccttgtaacaactgatgagaaaaagtatggttttgttatacatcatttctcttgaagtacaagttttcaagaacctattgacaaggttaagtgtgggcttacagtttaccaatcttagcctcagattgggctagggcagggatgacaaaccaggctcttgcatgggtctttaaatggactgggcaataaatgaagactttggcctgtaaattcctaaatagcttctttgcttttgtcctttaggaatgcacagcctcattgctacaggccatcttatgtcagtagatccagacagaatggtcatcaagagagttgttctgagtggtcatcctttcaaaatttttactaagatggcagtagtacgttacatgttcttcaacagaggtgggtatgaaggaggaggatgggatctgattgcctttgtggtataaaggttgggtttacattttgtgggtaaatgtttcatcttggtctttaatgtgtttgattctaagaggatgtgctgtggtttaaaccagtggaactgagaacgaagtggggccggagaggacatatcaaggaacctttaggtaaggaaacacgggatttgagaccatgtctgcatttctgcagtgttgctaaatgactgttgggttggaagtcattgctttaaaattttctacttttaatttgaccgacttgttctgatgtctttctaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtaca

SEQ ID NO: 84797 - DNA, 2948 bp, Homo sapiens
gagggggagcaagtcatgtcacacggccagcgcagtaacgagagcaaggcaggaggtgctacacactttaaacaactagatctcatgagaactcactcaacaaggagggtggtgctaacccactcatgagaaaacctctcccctaatgcagtcacctcccaccaggctccacctccaacactggggattgtatttcagtatgagattggggcagggagacacatctgaactgtatcaggccattaccaagcatcttttttgtcagtgagaagcttgggtttggttccgatagaacttgttataagctgttcggagtgtcgtcttggtttaagctgttgggttgtttggagagaggatgattggagttcttttcagctagctccttagccattttagcagtgacttgagtctatatagcaccatataaatctgacttaatgtctttaaaaatcttcaatattctagatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggtatctatcctccttgttcatcttgtatgttgctttcatttgtcaacatgctccctactttattccttctcttggcatgaaaatatgctgcatttggggattaggggagcccctgagtcattgattagaatgatactgggaacaaagaggtatcagctatgttaaatgaaaaagtgtgatctgggtaaatgaagcatcttgaaggatgagggttggctttaaaaattttatctgagagactcaacatatttggagaaagcttcctcgctattgggactttgaaaggtaactccatgattgctttctgctttcttgtggcaggttggctggtatgtcacacttcatgtctctgaagtccccgtctcagtggtcgagtgcttcaggcaaggaacacccttgattgcattttctttactacctcatgaacagaaggtaaattgctgtcttgtgggaaaatggggggttgtgaaactttccagctgcttctgacagtctaaaattctgtttatgtgtgactaaaattttgctcattgggatgcaaaaagtctgcctttatgattaggaattggagaataatagagaagtcaatgatggttttattcatatcgtctgaacctgtctgaagcatctcagtgatgcaatctctgtgtggttctgagacttctccaagtatgtttttcagaccagattttgaataagggttggcagccttaaaaataaaggtttggctgggcgcggcggctcacgcctgtaatcccagcactttttgggaggccaaggtgggtggatcacctgaggtcgggagttcgagaccagcctgaccaacatggaggaaccctgtctctaccaaaaatacaaaattagccaggcgtggtggcacatgcctgtaatcccagctacttgggaggctgaggcagaagaattgcttgaacccagtaggcggaggttgtggtgagccaagattgcaccattgcactccagcctgggcaacaagagcgaaactcttatgtcaaaaaaaaaaaaagtttatgccaaagtgcagatctcttttctcttggtggccagtagttgtgtatgttgtggggtatgtgatagttctttgatcggttttggtaagggctcaagaagaaggggcttgaatgagtgtggttttgagattgtggtgagtgaatgccttgaaggccactgatttttgtgtggcagatgttgagctcttttctgttaggtgcaggaaggtaggttagcattgaagggtgcatgaaagctctgatcagcctgtgtttggcttaaatgccagtcattggtggaggtaaaggatgaacccgtgtttcagcatctacactccaccattaattagcattgtcagttcttagaatgagtctgaatctgctagtttggtttgccttctttcagtttaggcaattgtattcctagactatgaagatttttgtttttcttacttggtccccagatgtcagtattgaatatggtggtgaggcgtgaccctggcaacactgaacctgtgaaagccaaggaagagctcatatttcactgtggattcaggcgcttccgagcctcacctttattctctcagcacactgcaggttagcaatggggaagctgggttcttgtccatcttgtcttttgggaaagtgacttgtggtggaggggtgccaaaatatatggtttcaaaatcttacatctctgggttagaggtattttcagtactctggcttaagagccaatgatgtttttattcaaaatgtctgaacctgtctgaagcatcccagtgatgcaacttctgtgtgatactgaggcttttttgccatgagtatttgttccatagcaggttttgaatagaagttggcagctttataaaaagggtattagggtgggtgcagtggtgcagtggttcacacctgtaatcccaacacttgtggcattagaacggggaattgaagaccaaaaaaggtaagatttaatcttgtttttgtttctgttttttttttttttttttttttttttttgagacggagtctcactctgtcgcccaggctggagtgcagtggcgcgatctaggctcactgcaagctccgcctctcaggtttacttacaccattttcctgcctcagcctcccaagtagctgggactacaggcgcccgccaccatgcccagctaattttttgtatttttagtagagacggggtttcaccgtgttagccaggatggtctctatctcctgacctcgtgagccgcccgcctcagcctcccaaagtgctgggattacaggtgtgagccaccgcgccccctcttgttttt

SEQ ID NO: 84798 - DNA, 1165 bp, Homo sapiens
ctgttgctcaggctggagtgcagtggtgcgatctgggctcactgcaagctctccctcctgggttcacgccattctcctgcctcagcctcctgagtagctgggactacaggcgcccaccaccatgcctggctaatttttttgtatttttagtagagacggggtttcactgtgttagccaggatggtctcaatctcctgacctcatgatccgcctgccttggcctcccaaagtgctgggattacaggcgtgagccaccgcacccggccgtgtatggttagtttcttaggaatgactctgtagttgccaggaatgaggcttttgttttatactttagactgtattagaatttatgttggttgggaatagggatctagtacaattattttactcttagcttattggcctttggggtagagacaggtgtggatttcttctgaaaaaactgtaatcctattctacaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcggttagtcaacaagtctatcaacaaatctaaattcagtcaatacgtttttaaaaacttggctcagagctgtgtcactgtgatgcaaaagaagaaaaacacattttttctgctcctgaagagctaacatttaatatgggaaggcaggacatacatacgggaaatggtcatatgtaattaagttctagactgtggtgcagactcacgttacaggacttgaatgaaggggaaatactaaggttaattagcaaatacttcttcccaaaggagccagtactcaattgaagtatataatgtttggaaattttagggggtttgggtagaatagcagaagtagaagagtgaagaagtagatgattatatctgttctggaggtgagtgactaaagccagtgaattaattttggatattaggaggtaaggctatgtattaggccattctcgcatggctataaagaagtaccagagactgcataatttataaagaaaagagatttaattgggtcatggtcctgca

SEQ ID NO: 84799 - DNA, 1073 bp, Homo sapiens
ctgtcctttgcccagagaaacaaggatatgaagtttgatttcactgtgaaattccttcagggtagttcagtgttgggcttcccagtgatctctgggcttgcaactgagctattaggttgtttgtgaactgcagagggatttttatgtaatgaagcagtaggtcatgaagcgttttctctttcgcttacagcactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggaggtaagactgatattcttaattcatgttcatatgaaagttggcacaggaaggaaacttaaattcagagaagatagtctgtacacttaggtgaatgaggagactgctagtctgaagtaaggcaatagtcagttataaataggttgataaatcacatatttatccagcactttctaggtagtctgcactgtgattggctctgagtttatagaacacactcaagatgtggttgctttcctcaagggacttaattgggctggaacaaaatggcatgtgtgaaataaagattgagatagcatatggttagagtgcggaccagcagtggaagttgagaaagtagactagcaagcttcacataagagatcagacttgagctaggtgttgagaaggataaatgtgatttatgagttgaagagggataaaagaatatcctagaagataagagacagaatgaacctagg

SEQ ID NO: 84800 - DNA, 1048 bp, Homo sapiens
tacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggtaaggagataacgtagaaggaataagggctatttggccgttattaactctttttcctcatgcccagactgagcttctgtctcccgtctgggctccacgcgaaaggccctttctaaggtgggcggagaggagtcccttttcttgaccttgtggggccgatcacaccagccccttctaatctgccattcaggccgtctggcactgaaaaccctaagcaagaaggtgagaaaagaactcagcagagtcgaccagaggcatcgcgccagccagctccgaaagcagaagaaggaggcggtgagaggagcgggatttgggagaatgcggcttctctggtgttctaggtggctaatgcctcgaagtggaaaatgagaccgggaggagggtccagggacagagcatagccctagagcacgtgtcgagcgtgcaggtctagcattctt

SEQ ID NO: 84801 - DNA, 1655 bp, Homo sapiens
actgccttgtatccagtgcctggcatactgtaggcactccgtgactgtttggtaaataaatgtgctgattttggagacttcgaggcctggtgtttggaaagcatacattttggaatagtctggacctaattctgtgtgaccttgagtctctatgccgtctccctaatatatatatatataacctcacgcctgtaatcccagcacgttgggaggcctaggtgggtggatcacctgagctcaggagttcgagatcagcctggccaatatagtgaaaccccgtctctactaaaaataccaaaataagccaggggtggtggtgcgtgcctgtaatcccagctacccgggagactgaggcaggagaatcgctggaacctgggaggtggagattgcagtgagccgatattgtgccactgcactccagcctgggcgacagagtgagactccgtctcaaaaaaaaaaaagtttaccttagctgagccgtaattagagtttcagggttggggaagcgtctggactctcataacatcctggaaagtggacaggcgcggtggcttacgcctgtaatcccagcactttgggaggctgaggcgggtagatcacgaggtcaggagttccagaccagcctggccaagatggtgaaaccccatctctactgaaaaaaacaaaaaatacaaaaattagccaggcacagtggtgggcacctgtaatcccagctactcgggaggctgtggcaggagaatcgcttgaacccaggaggtgtggttgcagtgagccaagatcgaaccactgcagtctagcctgggcgacagagcaactctccgtctaaaaaagaaagctgggcatggtggctcacgactgtaatcctagcactttgggaggctgggacgggcggatcacgaggtcaggagatcgagaccatcctggctaacacggtgaaacctctctctacaaaaaattagctgggcgtggtggcgggcgaatgtagtcccagctacttgggaggcaggagaatggcatgaacccgggaggcagagcttgcagtgagcccagatcgtgccactgcactccagcctgggcgacagagcaacactccatctcaaaaaaaaaaaaaaaaaaagtcccggaaatctctagatggttctcatgcgttagccatggcctggctactaggccctaatgtttgttcccacccctccccttggtaaagatgtagttgaagccatcagctttcccgcttgtgggagaagcttcattatgtctttgctgtgaagaggcccaaaaaaggatttcttaggccaggggtgtatcaagtcagcatttaagcccaattctgctctccccaatgaaaagagaaatcttgattctcctgcaaaaggaagcagtctagtgacagagacttgaacagtgtaaacaaaatagaaaagtacttgtgtctacacttgaggtggatatgctgggattatagatatggctcaattttggaggttagtcacagataatgggaaatacttttttttttttttggagacggagtcttgctctgtcgccaggctggagtgcagtggtgcgatctcagctcactgcaacctccagctcctgggttcaagcgatttccctgcctcagcctcccaagtagctgggactacaggcacatg

SEQ ID NO: 84802 - DNA, 1357 bp, Homo sapiens
ccagtctgcagagagcctgactctgaagtggacccccaaccagctcatgaatgggactctgggggactccgagctggaaaagaggtgggggctttgggactcaatcccaggagccagggcagggagtgggtttgacctcaggcagagggatggagaaaccccgcttgctccaggaggccaacctcactctttatttggacgccaagaatagcagggagcggctgcctggagtgattcccaagctctctaggacggagccaagcctggccgtgaagaggtttgtctgagccaagctctcagcggctgagacggacagctgtccatgtgccgagcgggcagcacagatctcaggggtcatggctggctgtgtgcacctcttggctatggtcatcctatcttcaggggagtttcgtggggtggtaggaccaggagacaaggaaggaaggaaggatggcaggtctttggacacagtgacagcagtctggttcctttctagcgtttactgggactatgccctcgtggtgcccttcagccaggtcgtgtgcatccactgccaccagcaaagtaagcctgccttgtcctcggctcgggtgggaagggagaggctgccttctgccagctgtgcactgtgcgtggggcctgtaagactcctcgtcctcctcccatccttgttaatggggctcccaggccatgctgtagcccagccatctgcctcctacccagcctgggggcactggccagcagggtgtgatagccgacgagagggcctcagccgcactctccacgttcacccccagagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggtaactcgggtgggaggctttaggggaagggctgtgtgtggggttctctgcccgcctcccttccttccccacgtggagttcttaggagcggccttgtgtggaaccctggatgagactctgccctatacagcccgaccacctacccctccttccacaggggaaagtgttccccaagctacggaaacgaagcagcattcgctccgtggatatggaggagatgggcacggggcgggccaccgactatgtgttccggatcatctaccccggccacaggcacgagcacagtgagtgtcccgagcttcatcccgggggaggagaggaagacgctctgggaggcggggagcgcagcgtcacccaggagggcagcaggcagggcccactgaccaggccaggttaaca

SEQ ID NO: 84803 - DNA, 1053 bp, Homo sapiens
ctctttgagcagtcactattaactaccaccacctagcggccagccgcgcggcctcggtggacgatgatgaggaagaggaggataaactgcacgcgatgctctcaatgatctgctcgcggaacctcacagctcccaatccgatgaaaggttcttatccctccctctccctgacccacctcatccccaccctccctcccgggcccgcctgccacccaccacaggggttcgaacggcagtgttggcattaggggacttgcacccagggcagttcccttccatcgggggcagatcagggagggcagaaggaggccagacaggtgctggcaagaaaaggggctggcccagggcaggtggctccaggctgtgaggaggaagaggatttgctaataggaaggtctgattatctgattgcctcctgggcaccctgaatggatctctgagcccattcctactccgggggtcaggctggcaaatgccagacagaggtctcttcctttctctctgctgattgggaagaccagcctctgggcctggtgcttctgactcctgacttaacagaaacaggatggaggtaccgggtccttcctggggcaggggcagcagctgtgggtcaggcgaggggttgagggctgccatgcgaagggccccagggctcagtcttcccaggaggcctgagggccccagccggcagggcctggtactttggcatgaaatctagaaatagctgcagcatggtgtccaggaaggggccaggctcagggcctggcaacatgaactcccgccccagatatgcccctggttcactgtgtggttttgagcaagtttctcactatcccggagctccgtctcttcacctgcgccagggatataagacagatgtgttcctgccctcatgagtctcagggtccacgaatggagaggtcacctttgttggaggtgatagcgtagtgccctcagcctctcagggttcctctgcctaccacccatctttcctagcacagagctggcttggtagagagggagcccccctcttttcagcaagcaatcagccag

SEQ ID NO: 84804 - DNA, 1033 bp, Homo sapiens
ggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactgtgcgtacatgctccccaggctgttcccagccgccccagaggccctcctgacatcccagagctggggaagcgctggtggggtggaaggcggggcgccctgactgccctggaagggagttctgagcccatttctcagcatccccacaggactcgctctggtctctgggttccgttttgctgcatttcttggggcgtcacctcctgcccccagcctgggaagggctgcccggtctcatgcctgagggccctccactcttccagatagaattactggacactgtggccttaaacctgcaccgcatagacaaggatgtgcagaggtgtgaccgcaactactggtacttcacgccccccaacctcgagaggctcagagacgtcatgtgcaggtgccttgtggggcggggctcagggtgggaggcgggaccctgccgccagttactctgtgaagatgaggtccggaaggtgccctgctcctctctcctgctcctgaatcacacttggctccccctgcctggaacgcttttttcctgcacacccctcccccgcgcctcttcattcttaggggcctaccagacctccacttcagccacacctcttcaggaagctttccctcatccccgcacccccgccccacataccaagcgtgacggccttggctctccctaagtcggagtgccttgggggggacccgtgggttgttccccgttgtctccctgtggggggtgcacagtacatgccttagggtcgtggaaaggctgacttctgggcggcaggtggctctggaggacgtcttcccagggatcccgagggagggaagaatggggcaca

SEQ ID NO: 84805 - DNA, 1188 bp, Homo sapiens
ctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgccagcctgcagcatctgggtcattttattgcaaaaggaggctgaggcctgtagggaagcatgtggcaggagcggtgagatcacctgtctcgaccctgtctgcccagcatagtcctcaagcggctctgacccggtgcctccgccgctctgaaaatggcagttctggtcggtctgaaacttttgcaaagcttcgtatttcctcagaccattttacaagcattatcttgtttcatctttcaacagccaagtgaagtaaataagccagacttagccccattttggcagataaggaaacaggattgaggtggcccagtgacttgttgaggccacacggctagctggagacttcgttggagctgcagtcagacctctgaactgggtacagagttcttacccagcatctgccacc

SEQ ID NO: 84806 - DNA, 1169 bp, Homo sapiens
cagggagacaagtgaacggtgaggtggaagcgcaggatcaggttccttagagggtagctcgcggcagaagtgtgcaaagtgaagaggctgctggaggagggatggggcgagaggcggagaagcccctgaggatgaattgtggaggacagggaaggacctgcacacctggttgagcttgcttcagtggtgcctgtcccaagagcccacactccttgggacgctgggcctcactgggcaggggcatggaccacaacaggtgcggtctccagcagcccccgtcaggctgggcccgctggttgccacggacttgcctctgtgggccagctgatagggagaggtttgtgggggctttgggccccaaggctgctgctcagggtgtcctgctgtcccttactctgtgtgccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctggtgagccccagcccccacgctggccccccagccctcagatgttacacctcaaattccagcctccctggccaggctctttcttgcctgctagaaaagatggccctggccccagccccatcacattcccacgcccccacgagcatctacgcctccagccacttgcttccccgcccttctgacctgctccctgccccatgttccccacagagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactg

SEQ ID NO: 84807 - DNA, 1632 bp, Homo sapiens
agatactacttgcagagggcgccttgcgtaacgtgtgggtttggaaatgaatcggaagaagactcagcagcagccgcagaaggaagctcttgaggagctgggcccggtgaagtaggagccggggtaggcctcactcaggctgtgcagaagggacacccattctggtgctggtcacagaagcaggaacctcaaaggcctgtctacaaaccatttattcatttattcattgaggtgcttttagcgaagtctctgcttctgggcgaatggtggcgagcaagtaaaaaagcctgggtcttgtggcagatgacgaacaagtcattctacagaaggcggccgtatgggcataatagggaccgggcggcgggatctgttctggggagggaggatagctgttcctgaggaaaggacctttgagctgagacctgcaggataagtctgggtggcacggagcaaagtggaggccaagagcccaggggcagcccagtttctccagcaggagggaacaggatgctttttggaaataaaagtgaggcacggtggcttgcacctgagtcccagctacgctactcgggaggccaaggcagtaagagcgcttgagcccagggagttcgaggacagcctgggccacagagtgcgacctccgtctctaagaacaaacacaaacatggtcaggaggctgtcactcagagacaggcagaatcaagagctggtcctggagagaccagtggggctgtgtagactgggagctttggttgtttgctgagagcaggaagctgcaggaagaaggcagtggtccccagccagaatacggagtggcttggaggtggtcaaaggtttgaagacagccacagtaaagtggacagagacaagaaaaataggtaccaaaccgtgcatccaggtagtcacagaaaggaaatgggtttagattgaagcaatgtgggttaaagttagaccctggggaaaccttgcaggggtctgtaggcctgtgaagaactggactaggtgagaagaagaagcttttgacccatgtcactccctggcccagaactatatcctacccacaggtgggttgagttcaggactgctgcttccagcccccagcagcaaggttcaagtgagagctgactcacctagggccccttgttagagcctcagagccaggtgaaaagccacacacaggctgggcgcgatggctcacgcctgtaatcccagcactttgggaggccgaggcaggtggatcacctgaggtcaggagttcaagaccatcctggccaacatggcaaaatcccgtctctactaaaaatacaaaaattagtcctgcctggtggcacatgcctgtagtcccagctactcgggaggctgaggcaggagaatcgcttgaacccgggaggcggaggttgcagtgagccgagatcatgccactgcactccagcctgggtgacagagcgggactctgtctccaaaaaaagaaaagccacacaggtgtgtgtgtaggggcaagggagtttcctactgtcttcctagcagaaaatggggagaaactgttaaagccagaatgagggagggctgtgtgtggcctgggactggcaacagaagtgtcaagctgccaggtttcaggccagtacagagcac

SEQ ID NO: 84808 - DNA, 1024 bp, Homo sapiens
gggcctcttgggtgagggctggggtcaaccggctgcctctgagtcccaggagtcctcctgtctccctcctggtgggacggagggtgacaggagttgtgattatgagcacagatgtgtcctccagggggtgggcgcagcatggcacagggcgaacgtctcccagtctgctttaagacagtgttggggacaaacagcctgtggcaattttgcgggtggcggcgctggtcaggaaggccgtctaatcgagtcctcctccctgagcctcctatctgtctgggtttcaggatcggaaccagagaagtccacaacaaattggagaagaacaggtgtgtgtgtgtgtgtgtgtgtgtgtgcgtgcgtgcgtgcgcgcgcgacccgggccccggcggccctcggccccagcttccccggtcctgcctccccccgtcccagccccgccccaggcaccgctgaccggcgctcgcccctctcttcaggagggcccatctgaaagagtgctttgagaccctgaagcggaacatccccaacgtggatgacaagaagacgtccaatctgagcgtgctgcggacggcgctgcggtacatccaggtatggggcccggaggccggcgtcgcgcagcttcccccgccctccctccgccgcccctcccccggccgcgccccgccccgccctcacgccccggcggctcccccgcgcctccctcccacctccacgcgggcgctgagcacatggcccggctgacgtcagcggggctccctgcccgggagggcgcgcgtgcgcagaggagggcgcggctcccctcccgcgccgctcccgagcccctgcagcctcggcgtccccggggccgtgaggcgcgcgccgtgacgcctggtgcgagtcccgatggcggctcccgttcgcgcgtgttggtgcagccgcgggagggaagggcatggggcggcccggcgcctcctccccggccgcagagcctgggcgggagcccagattccgcccgaatgtctgtagctatctgcggggagggttg

SEQ ID NO: 84809 - DNA, 1263 bp, Homo sapiens
cctggagtctgcagactccaagggcctgggccagccccgtagccagggaaccagaatggtggcgcctgggagaggacgaggcaagcgggagatggaggtgcctccccttcccctgttggcagccagctcctgagtgggccttgccttcctgctgggctttcagcagggatgctgagcgggtggtggggtgcactgccctgctcagcccccattgaagagcccagccccttcttgtttgggagaaatggtcgctgctgtacctcctcctcctcaactgccctctctcacccagaaccaggcaggtgcactttccccggtgcctggctggagtggttgggtatttgtattgtctcaggctgagcggggtgtcactgaggatgtcagaggatgctttaggcctgaaggacaggacatgctggcgctgctgctggtggtggggatgttggggatttggggaaaatgagttataacacgagaagggtcagagagggacgaagtgtgtttgttgaatggtccctgaggaaaacaggcattgggacctagcctcggagtcaagagtgctgggctgtttccacatgtgtgaaatgagggtgatgtccctgtcctgcccatgatgtgacgtggggctcttgtgaggatccagggactgtcagcacttccttgtgagcacggcaagcgtcctccaggggtcaggaggcttgctgtgggacctgcagcgaatcactttgctccctgagcttcactgacttcatctgtgccatgcaggcactgcctgccctctagaaagtgcttggtaaacattgttaaaggccttccacggaagctgggatctgtcagcacacccccccctctggtgtgaagtcttgggtggctgggcctctgcccgcctctcccacctcggccctgtggtcccctgaccctcgctgccctcacccgccttcctcctcaccctgcaggctggcaggtggcctgcagcaccctctgacagctctgctccacctttccagggccgcctgtcctgcccgcagcccggactgtcagcccccgtgactgtcagcccccgtgactgtcctactattccctggtggcggggaacaggtctgcttgatttgttcactgctgtgcccccggcactttcccccgtgcctggctgggctggtaggctatttgtggtgtctctcgctgagcaggggtgtcactgagtactgactgggctagggtcagaggacgagttagggctggagttctggggccccgctgaga

SEQ ID NO: 84810 - DNA, 1017 bp, Homo sapiens
gactgtgggcggaagccttggcccctgggtcactgcagaggggcatgctaaattctttgggggcagcctctgggtggagcccagggaagcatgtgagggggcgcaccctgtctggtggatgtgcagaacattcttttaaagagcctaagcgcagggtgctcctgagggagcaccagccaccaccagtttggtggttctccagtgcacagggagagggttgccgctgggtgggaagggacaggaagctccggtgggctggatctggccaggggcagctcctcttcctcaccacctgtggagctttttcatgctgctccaggtgtaactgggtccttcctggcacctgtgaggtgtaccggcgtggttctgggtgagagagggcaggtgagaaggaggttgctacctcccaggtgagctttgggattgctttaaaatatggggaatgggggttggcttgcactctagggtcccacatgtccttgtgactcagggagggccctgattgttcctctgcctataaagagtggagtccatgtctcaaggccaatgaaaagttaggtctgtgtcagccaaaggaatggaggcagggtctgtgttaggccctgggatccagagccttgtcttggggtaggggaaggggctggggacaactgaggctgtgcccgactgagaagggccctgtcactggaactcagcaggctgcttggccactgcggtctgtgggaagcgggagcgcagggctggttttctcccgggcgtaacctaaggcctccccgcactggagcaggcctgcaccggcctggcatcgccccttcccgaagggctagggagatctggaagaggcccgctggctggcccagcccctgaactccggctgctgggaaaccactgaggcttcccctcccaggacgcttccccctccgcttcctcctcggcctcttccctctgcaggagggcggggctgggagcaggcctggctcacactccagttgttgattggccaaagggcctgaggcc

SEQ ID NO: 84811 - DNA, 1091 bp, Homo sapiens
ggcagccggcctcaaagagctaactctccgattgcacccgagctcccctaaacactcgagcccggaagacgcgggcgggcgggcgggcgacggggggtccctccctctggggagcgcggttccagccggccgcagcggaccccgcccccgcgccccgcccaccgccggtcgccaggcgcggggagggccgggcttccgccctccacgttgttgttcccgatttgggccacgccccccggtctgggctgcgggcgcttcgtgttccccgccctggccccggccccagaggaaagggtggcccatggggtggcacagtccgtatctccacccacatcgaatacgcgtggacaaagactggagttcaggggaaggaaagataaaggcctggttttaaatggaaggtggtgaaaaggaatggagaggccagggcacgactgcgggattccccttacggcatcccaccctgggttcgcccagtggccccatccgcacccgcgaatgtgacctgcagacactggccctttaaaccgaaggctggcggcgcggggtgtccatgtggagctgctccatgccgtgttgtcctgcccgcccattggctcgcggcccggtgacgtcccctaataggatgcgaacgcactgcggggggaggaacggagacaaaacgcggagccggactgccgctccgctccctccgctggttctcttgacagtctccagtcgccggcagctccgcccaggggcggatcccgggggaattgcgacagcccggcgattgcgggatttaggtcgcgagtgggtggagcgtggagacccagggtcaggccagtctctgccattcccaaggtttccctgacccggaatatcctggttggaactctgttaaatcttgaattgttcaccctaccctccctccagcaggacagatttcgtcgtgaacgacccaaacgcaccgccccggcccaacttgtggcttgcagccggggcggggccagcaggaaagcggaaccgcggcgcgcacaccccgctcggacctctccctccctgcccgggccacgtgtgcgcgcgccggatccggggggcggggccagcag

SEQ ID NO: 84812 - DNA, 1113 bp, Homo sapiens
aggaacagccgggcgcggtggctcacgcctgtcatcccagccctttgggaggccaagacaggcagatcacttgaggtcaggagtttgagaccagcctggccaacatggtgaaaccccgtctctactaaaaatacaaaaattagccgggcgtggtggtgcgtgcttgtaatcccagctactccggaggctgaggcaggagaatcacttgaacctgggaggcagaagttgcagtgagccaagatcacaccactgcactccagcctgggcaacagagggagactctatctcaaaaaagaaaaaaagaaaaagaaacttaaggaacacctttttagagattgctggcctttggataattccccaaacctgctaacctttctgctgaaaccaaaaggacttatttctctttctcttgagtgagtacatttgccagcttctatcctggctccacccccttggaacaggaagctggggctaaaatattaaacagccctcctattcattcccctcttctttcatgccctcacatcgccatttataggtatctcccacccccactgtccattcctcaactggggaaagcttggttgatgaggtattgtttttggccattttcaggctcctgtaggcaacaataggtccagaaacagcctcccccaccctttttttttttttttttttttttttttggagacggagtctctctctgtggcccaggctggagtgcagtggtgtcatctcagctcactgcaacctccacctcccgggttcaagtgactctcctgccttaaccacccccagtagctgggattacaggcgcctgccaccacgcccagctaattttcttttttcttcctttttttttttttttttttagtagagacagggtttcaccacaccacgttggccaggattgtctcgaactccggacctcaagtgatccatgcacctcggcctcccaaagtgctgggattacaggcgtgagccaccgctcctggcctgcagcctcccttctaaacccttgtttttgtctaacatcccctggctgctgtccccacatgacccaaataaacagatgatcatgtgaagccagtaaggctgtttgttttaaatagc

SEQ ID NO: 84813 - DNA, 1198 bp, Homo sapiens
taaaggaatccctgacatcgtcatccgtctcctgtgcctttccgctgggtcagcctcctcccaccaagcttctgacccactgtcatccgcagctgccactctagctgcagagctcgactgggctctggtttctcagaagagctcagaggacctggctcctccctctttgcttctgaactgcatttctttccttattactcagtgtccacacccacggtggctgcctggataaaaatctgcccctttctcccgtcacctttcatgccagacaaaagccccagtgagtaatggtgacctacccaggtccagctagcagctctccattcctgagtggcctggggcagaacagggtcctgcgagctcctggatcccaagtctgattccctttccctgtcttcccgcttatctgctaagcttgtttattggggaccactaagcaaagtgaatgattattcctgtctttaacgaggaggggtggagttccctctccatcttcacccacttctgggaggctttcagggactcaacaccccacactgatagcacttccccaggcctggcccagccagccaaagaggaggaccaggccacttctcaacctagctgatgcttggcagctttgtgaccttggatacaccttctcttgggaggtcagaccccatgatcccagctcttccagctatgacatcatgtgaggctgcaatttttttttttttttttttgagacagtatcttgctatgttgcccaggctggccttgaaatcctgggctcaggcgattctcctgtctcagcctcccacgtagctggaacttagggcgtgagccaccgcgcccagcttctggaaaggacatgaatggggaggtggaacttgattggacctgttctgtgagttcaggagaggtcctctgacaactcacttggggtggggaaaggaggtaaagagtcctgtggaaacttttggctgtggggaccccatttcactgatgattgaatgggtccacctctgtcaaaggaattcagagtcccactcatcattcagactgggggaatcaggctcagttgactggcccagccttaaatccactgaatttgtttttatctctacatagaaaaacggaattacagttgcttctcactgtccaatggggattggttcctggagcctccctgaatacctgtccatggatgatgctcaaa

SEQ ID NO: 84814 - DNA, 1034 bp, Homo sapiens
tgaacccgggaggcagaggttgcagtgagccaagatcgtgccactgcactccagcccaggcaacagagtaagactcagtctcaaaaaaaaaaaaaaaaaaaaaaaaaaaaagcagctgggttcagtgttctgttgttgacccttgtttggggttcctctggttggctggctaccatgcatgtcgtgtgttgcttatatcagaaggtgagggttctgtgtggtgtagatgctgtcggttagccggccttgcttctcacaaggggcgtttctggggagaacgctggggtctgtgtgggctcaaggaggatcccgtctccccttatgtttctggtacaggatcagatgtggccgcccagcagttgtgcacataggaggagaaggggccaggtgggaaaagtaagtcaagagccctctggaagaaggagcatttcaaaggtgcagcaggtttatggcgatagagggggtcccctcaggaaagggtcacggcctttttagggaagttggtgcacaggagacttggtttgctgaatgggcactaacctcggtaaaacccagaagaggctgaatagaatgaactgactcctgcctcctgcgggcagcactgatgtgtcgaacctctctagtaatcccgagtacgcggctctcggtatgagtgccagcgcagtatcagaggcccggacggcgcctgccccactgatgatgggcatcacacgtgccccggcgttcctgctctgttctgtgacattcacatgctctgctgtggctcagccaaatgactaaaacagcggttggtgttttaaattcctggttggagcagctaatgctgcctggtggaggctgtgctttgtactccacggactgtgttgtgactacagaacgcccttgcccctcgaggtgccctttgagatgtagcctgtctgccggtctcaatccaagcagaagcgtgggtttccttagggaagaggaagattgtgggtgcttccctcacaggggaactgaaaggagaaggggtagaggaaaagtacagtcggact

SEQ ID NO: 84815 - DNA, 1036 bp, Homo sapiens
acctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccagaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctaccca

SEQ ID NO: 84816 - DNA, 1102 bp, Homo sapiens
ttttggtagagacggggtttcaccatgtgggccaggatggtcttgaactcctgacctcaagtgatctgcctgcttcggcctcccagagtgctaggattacaagcatgagccaccgcgcccggcaggtgccattggtttttaaagtggaacttgagtccctctagtgggtagggtataattcaccttcccagcttgagatagaatggaagatgccagtcgtgattttcttggaaccagctttgaaatccagtcttctcatcagcgccggtgtcaccctccccagctaaaaggcagtgcttagctcgccgccggcttggtcccgacatcagccacgattcaggagtcctcctcctctgcccacgtgatcttagtggccctgatccttcctcgcatgtcatctcatggctgtggttcaccggctgctttatctcaagcctcagccaatataaactcaaactacaagttgatgatgtttctgccctgcagttctttccagccaagaacacagtgcccccagggtcctcgagttgtcatgaaataaataattgtgcaggtctgctttgggtaccacaggtacacgaaggacgtttagcagttggaggagttacatctgatagccagaacaaaggcagtgcggtgcggctggaaagaacgtgggttcggcgttcagtcctaactgcagttactgtgtgaccttgagctgtgtgacatagcctttctgtatcttcgttttcctggagatgcctaaactatcttgtggggttcttatttttttaattaaaaattttttttttcttaagagacagggtctcaccccgtttcctgggctagattgcggtggcgcaatcagagctccctgcagcctggaagtcttgggctcaaatgatcctccctcctctgctttcagagtagccgggaccacaggcatacaccattgtggctgactagttttaaacgtttttttagagatggaggtcttactatgttgctggggctgatctcaaactcctgggctcaagtgatgctcctgccatggccccccaaagtgctgggattataggcgtgaatgactgcaccttgcagggttgttttaagtgctgga

SEQ ID NO: 84817 - DNA, 1209 bp, Homo sapiens
gttgactgaccattgtatatgggaaagttgggtcaggatgcaggtgaaggagccatatttgagagagggaagttttcattttagtcctgagataactgggtaataagttgtcgattttgtgatttctgacttcctcagaactctgaaagtatccctgatagagttcttgtcaggttggtaaagatgtattttcttattttaatctctagaaatgatgaagcccgtccttacttttggagaaagagtgtcgcaggtcagctttagcataatgagaaacagcaatatcctgactttactggtcagaatttgtgagcaaaatgatcactccttctgtgagaagagatgggaagtgctgcccttttagccatgcttgtaggtgacctttgctgtacagggcgggctggcagggagggccaggttgcagtgagctctccatggtcatggcctttgatgttgggacggggaatggggagtctgattctccacccccatcatcctcccacacaccggcttaatacgcttcttccccagcttaatacgcttattgtaagctccttactgcaaagcgttaggctctcagtagactagaaattatgtttctcatgcaggatgattgagtaataacaatatgactgtcttaatgtcaatatgaatttgtctcatcttgtctgaaacataattgaacaagttcaggttcagacaggtcttagagtccactattcatttctcaagagcaggttcttcaaacacacacacacacacacacacacacacacacacacacacaccctttgttttttatccttccctaacagtttcctagtatagaataaactggttaggttgttgtgtatgtatgcagtgtgaggccgctggttagttcttattagaagacgtcccccagtaatcagaacctgtggtgtctgcatgtgtgcgtgtgcgctgtcagtgtggccaggtacgactggaatgatcagtagcagtcgtcagattccttttagcagaaaaagatcttcaaacctgacttggtgttttttcttttttatcctttttgttgttgttgtttttgagacacagtctccttctgtctccaggctggagtgcagtggcgcaatctcatctcactgcaacctgcacctcctgggttcaagtgattctcctgcctcagcctcccgagtagctggaattacaggcgcggccaccacaccc

SEQ ID NO: 84818 - DNA, 1060 bp, Homo sapiens
gccagtcttcaatagtttctgacctatcaaatagtttttgatgtataaaaatgtcagtttcatacagttttaacctaattggtgattttagaggctcttaaattttgcaacaatcatagtaataattgattcgtggaacaattggcaaagggaaatttgaaaaggaacaggataactacctagtttcaaagaaccaccccttccccctttaggttacttacagttacagagagaagtgtgggagtttacaaagtaaagagtttgctttggagaaagcacaggccacctccctgaccaggtgctcatctcctgatgtgacgcacctggaaggacaagcagcgcctccgtgctcttcacgccagaaatgtgtcatctgaatccaatgacgtggaaacttcagacacacccagttgagggactgtgtaaaatcagctcctcaaaaacattaaggtcatgagagtaaaagaagactgaggaactattccagattgaaggaggctaaagagacatgacaagtacatgaaattcgcaatcctaaggggccttgtatcggggagaatattgggataaacaggtgaaatttaagtgtggactgtattccagataatagtattgaatgagtgttaagttttagcaatttgataattcctctgtggttacaaaaatgaatacacttgtttccgtgggggcgcagcggctcacacctgtaatcccagcactttgggaggccaaggcaggtggatcacctgaggtcaggagttcaagaccagcctgaccaacacagtgaaaccctgtctctagggaaaatacaaaaattagcctgttgtggtggcacatgcctgtaatcccagctactctggaggctgagtcaggagaatcgcctgagcctgggaggtggaggtgcagtgagctgagattgcaccactgcactccagcctgggagacagagtgagcctctgtctgaaaaaaagtctaaaaaaaacaaaaacaaaaacaaaaaacaatacacgcttttaaaatggacatgccaaaatattacagttaatgagacatgttgatg

SEQ ID NO: 84819 - DNA, 1047 bp, Homo sapiens
cgaggtgggcagatcagaaggttaggagttcaagaccagcctggccaatatagtgaaaccctgtctctactaaaaatataaaaatgagctgggtgtggtggtgggtgcctgtagtcccagctactagggaggctgacgcaggagaatcgcttgaacccaggaggcagaggttgcagtgagccgagatcatgccactgcgctccagcctgggtgagagagtaagattccttctccaaaaataaaaatgaaaataaaaataaagattgcaaaggtagtggctcctacaatctgcgaagactgtgtttctgaggatgttccatgcctttaattgattagtgtttactgtaatcatgtatattacatagacaggaaagaggaaaataccgcatgattgtattgctcccattaggatggtcctgtgatagaacaaaacggattcaaatatggcttttgattagaaaacagatgggttcagttctgtcccatgaaccagaataaatttgttgcctcgtcctttcagcagtttaggttcttggaatcagtctcccagtgacagatgtgaggacattgagctgtcaagaacttaatgaagggaaactgagatcactaaccagttgcagaggagggttaaggccattccttttgaaagctaattattttggacaacacacctgtcattaagcaacataaggtactcaaaaagagctatttgtctcgcttgacttctcaccctgccacatgttgttgaaatgatggataatatggtagttcaaaaactaaaagagctttcaatccaaggatttagctttgggacatagggaaggttttatttattattattattgtggtaaatacacgtaacataaaatttaccatctgtattagtccattctcacactgctataaagaaatacctgagactgagtaatttgtaaagaaaagaggcttaattagttcacagttccacaggctgtaccggaagcacggctggggaagtctcaggaaacgtacaatcatggcggaaggtgaaggggaagcaggcacatc

SEQ ID NO: 84820 - DNA, 1053 bp, Homo sapiens
ctttgatgaattttgagttaacttttcatatggtatgaggtaagggtggattaaatatttaaatgtgaaaagcaaaaccgtgaaaatgctaggaaaaaacaagtaaatatttgtttaatctttgggtggatcttctgtacaggagaaagaaagcataaagaaaaagtgacagattgggctttataaaaaggtaaacaattttcatgtttaaccacaaaaatggaaagtaaaagacctgggaagaaatagttgcatgaagtagctgtttgaaataaaatattttagtggctatgattttaaaatcctaaatctagcatactatttggaaagtaaaaattgcaactaaacattctaacttagagatagattacattcaaacttggttcttggggtgtacacatttttcaccagggttttttgttgtttttcagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaaggtaagtctgtttttacaacatagagtccatctttacaacacaggaatatttacccgctatgtagttctcttttttttggtggcgggggacagagtcttgctcttgttgccaggctggagtgcagtggcgtgatctcagctcactgcaacctctgcctcctgggttcaagcttttcttgtgcctcagcctcccaagtagctgggattacaggcacctgccacctgtaatttttgtatttctagtagagacaagggggtttcaccattttggccaggctggtctggaactcctagcctcaggtgatctgcctgcctcgacctcccaaagtgctggaattataggcatgaggctctgtgcccggcctcccctgtgtagttctaaaacaaactatgtcactcagagcaaaagtaatcctagtgctcagaagaacaagcagataaagattgcaggctgggcgtggtggctcacacctgtaatcc

SEQ ID NO: 84821 - DNA, 1050 bp, Homo sapiens
tgagcattttaggtgaattagtcatgtattcctcgacctctgcttgtgtgttcttcattttttatacaacacacgaaagaggaggccagcaaggtttcgatcctttaggaagttggatctaattaggaggtaggactaacatacacgaatgactagggaacccagtagccataacatgtatgacatcaggtaccagcttgtgatttctctgccaaaaaatacaaaaattacagaaaatacaaaaaatagccaggcatggtggcatgcacctgtagtcccaggtactcaggaggctgagcagggagaatcgcctgagcccagaaagttgaggctgcagtgaaccgtgatcacaccactgcactgtagcctgggcgacagagtgagaccctgtctgcaaacagaattctgagaagaatggtgttttcatgattattgtaacctttccctctggtgtgtagaatgtgttttgtatttttattttattaggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaaggttagcgccacagaatgaatgcctccaaactttgtgtcttcacctgcctttttagtttaacgcatttcattacctttttctttaatacacagacttcggtaatttaaaaaaatctggcactttgtaattgggtttgctgtcttgataccagaattaactcagaaaatagtaactacagttgatccttatgatttgtggattctttttttgtgaatttgcctatttgcctaaatttatttatttatccattcatttattttagtagattttcttgaataaatgtttctttattcgctataaccccttagaaacatttccagagactttaagtgggggttttttgtttgtttgttgagtttattttttagggcatttttaggttcatagcaaaatgaagtgaaaggttcagagattccctgtata

SEQ ID NO: 84822 - DNA, 1050 bp, Homo sapiens
atctcacagtagcattgtgatattggtattactgtcctcatttcacagcagaggaaacactttcatagaggtaaatgacttgttcaaagtcacacagtgaggagacgacgagacaggaatttgagccgagtcatttaatctctgtgctccatatacggatatgcagtgtttttggtggaggattgtactgattttcataagctgtgactgtgtgaaacactcgtgtatgtgccactgggatgagtgctctgtgtaactgtgtgtgatctccctgggaggttcggatgggtatttggttctgcctgtttgccgtagagcttgtacaacatagtgaatcttactaatcagttttacttccttttctttattcctcagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggtatatcattttaaattcttttttggctaaacagttttcataagttttgcgagatcaaattctttgtaaacttttctactgggtatttgttgttgtacaaaagaagctggctacagatacaggttgagcatccttaatccgaaaatccgaaatgcttcaaaatctgcaacctttgagcactgatgtgttgctcaaaggcaatgtgcgttggagcgttccagatttgggggttagggatgttcagcctgtaaatatagtgcacatatttcaaaatctgaaaaaaaaattgaaatccaaaacacttctcatcccaagcattttggattagggatcctcagcctgcattaccgttcttttttactacacctggccttttctcccactgatttctcttgagaagggattgtcagtccaaacagggagcaagaggttaagggaagtacaaaatgaaaatgaggctcttatttatatagct

SEQ ID NO: 84823 - DNA, 1974 bp, Homo sapiens
ctgtgttttttttgttgtttttttttttttttttttgagacggagtcttgctctgttgcccaggctggagtgcagtggcgtgttcttggctcactgcaacctctgcctcctggggttcaagcaattctcctgcctcagcgtcctgagttgctgggattataggtgccaaccaccacacctggctaatttttttattttttatttttagtagagacggggtttcaccatgttggccaggctggtctcaaactcctgacctcttgatccacctgcctcagcctcccaaagtgctgggattacaggtgtgagccactgtggccggccttagctgtgagattttatgtaattttcttagctttactgagactgaatcttctcacctgaaaaggagggatgagaggacatcctcatgaaggttagcagttgtgtagaatgactagcattctatggacactgagttcatggtaggtgctcatattgttgttaagcctggtataagtaaggtggcaaggattgctactctgatatcttatttttctcccctgcatgtcactgctttgttataatcatatctgaccattgcaattagattttagtttgtgttttttcacaataatcagttccatagggacagcctacaatttagttcagcactgtcagttcagcttgaatagaatgtgacacttaaccgatttgtttttatttatttatttgtttatttttgagacggagtcttgctctgtcgcccaggctggagtgcagtggcgcaatctcggctcactgcaagctccgcctcccaggttcacgccattctcctacctcagcctcccgagtagctgggactacaggcacccgccaccacgcccggctaattttttgtatttttagtagagacagggtttcaccgtgttagccaggatggtctcgatctcctgacctcgtgatccgtcagccttggcctcctaaagtgctggggttacaggcgtgagccaccgcgcccagccctatttgtttttatttttatttattttaactgattttttttttttttttttttgtgagacggtgtctcgctctgtcgcccaggctggagtgcagtggcgcgatctcggctcactgcaagctctgcctcccaggttcatgccattctcctgcctcagcctccggagtagctggaactacaggctcccaccaccacgcctggctaattttttgtatttttaatagagacggggtttcaccgtgttagccaggatggtctccatctcctgacctcgtgattcacccgccttggcctcccaacgtgctgacattacaggtgtgagccaccgtgcccggccaactgatttgtttttaaaccaaagacctagcatggaagggctttatcatgctgggtagactgtaccatttttagcacctcagtgaccatctaaagactagaaaccaaccttggagtaacactgggaggcttttggcttttgtttttgttgcatcaggttcagcttctacaggattagaatgattgttattttaacaatggattacagaaatgtgtctgttcaaaatccatctgtaatggtaatactgtattcatcagtggtagagcaggagtcattctggggaaatcggccatgagcctgttgacaataggctattttgggaagctgaatgtgttaaacaaacaacaaagactgaaaatgaataaactgctgattttcacgtgagagctaattttagttcctgggcctccctgtgatctctgaaatgagaatgagaaaagatcttgcctgtctgtgttcaggttttttgaatgtcccagagtgctaacgtgacctagattcttaactagtgaagtcgagtgacttgactttgcccaacaaaagtatttttgacactcagactagtgtctggatcttttcagaaaagaaaataaacaacaaagtctaacaatcagctcttcattggtgttcactt

SEQ ID NO: 84824 - DNA, 1054 bp, Homo sapiens
tgaactcctgaatcaggtgatctacttaccttggcctcccaaagtactgggattagaggcatgaggcaccgcacccggcccccattaatggtttttaataaatatgctgattttctttctctctttctctccttaagatggctctgagtaaatcaatgcatgcaagaaatagatacaaggacaaacctcctgactttgcatatctggcatccaaatatccagattttaagcagcatgttcagataaatctgaatggaagagtgaggtaggtaacggatgaaaaatcactgttattcttgtgtgattcaaatggatatgatgtaatagaaagcccacctgagtgttaatcttagacatttgattaaacgtcccatgcgaccttggacaaatcacttaacctctcttggtctcagctttttaatgtataacattagaggaatggaccagatgcttttaagtttccttctggcttaaaaaaaaattctcttgatgtccaaattgttgcttaccctacggaaatcccagagtaacttcagagatttacgattgtgctctttgtgatctaaaacttagtgactggtgaggatctaaacacttttttttttttttttgagacaaagtctcgctctgttgcccaggctagagtacagtggcatgatctcggctcactgcaacctctgcctcccaggttcaagtgattctcctgcctcagcctcctgagtagctgggattacaggcgcccgccaccacactcagccaacgtctgtatttttagtagagacggggtttcaccatgttggtcagactggtctggaactcctgacctcgtgatccgcccaccttggcctcccaaagtgctgggattacaggtgtgagccactgtgcctggcctaaagatattttaataagtgtgtgtttattttgatgtgaggcaggaaaataataaccaggacatcaggactgatttcacagatattattatttaagatgttactaaatttaagaagttgatttatttttatttatttattttgtttttagagataggatcttg

SEQ ID NO: 84825 - DNA, 1029 bp, Homo sapiens
agcgtgagccgccgcgtccggccggatcctcagttctttcgctgtaaacgagagtactcttccccaacccacaggcttatatctcttacaattcagtgagtgagacatcggctgaggacacacctgttgcacaaaaagggctcactgcacgccatcacacccaagtctcgtaccctcatcttcataacctgcccaatcccagtgagtgtgagaggtaagtctgcagcagggcccggaaaacttgtttctttttcttttaaataagttttctcgcgaattcgaacgcatgtcctcctcctgccatacctcaaaggactccgctcgtcaccacgcccccgcgccttctgttaggagcagcaaaccccaggtgtcgcgagggtttcttctttcttcaagatcagccacaggtcgcgcgagagggatgtgtccaatcacgaggctagatggcttcacaagatggcggcgcgctgggagcgtatcatctgcgtttctaggagcttcgctatgcggctgctttaagattctagggttgtacaggcccacgccagacacgacgtctggcaggaacctcggcctcagaggtgggtcacttatatctctcacgcagatttactatcatgggtcacttaacccgtggatcacacgggttcctcattcttgagttttgggctagtgaggtgccgacttcggggtctaggaggggagacctgatgtggctgtgtgtgcgcacgcgggggtgttgagagtggatgagtgggaggagttggcgaatagaatagagactaggactgaagtaggaaagactccccggtgtttaggaggtttagagagatccaaaactgaggcgggaagacaaactgagctgataaaatgagggcatggaaagaacggcagtggcaggactagtgggaaacgtcggatttatgagagaaggcgaagagagaagatgtagattggtgtggaagtgggagggatctgtgcagaaagaatttgaagttctgaaattggaatttagactgttttacaggc

SEQ ID NO: 84826 - DNA, 1088 bp, Homo sapiens
ggcgctgccctcgctcctctcctcccgggcccggctttgggggctgccggcgcctctgcgacccccgccccgcggccctccccaagaagggatcgccctcctccctcggtgacttagcaagaaaagtattcttgggttggaagggcgtggggaccaggtagctctctgatcttggggaaaaggatcggccctgctctccccggccgcggagacgagcaccgcagtccccaccccaccctcagttatcggctcggggaccggctcagccccgcgccgccggggcactcatagggccttccaggcattccgtccccgactggtccttaagatggggttgaccagcggagggtggcccaccgtctccctggcccccggtgcggcggtccagcctcagcacccgccgaggagaggcagcccggcccaccgagcaatccgcagcatccacccaccgaatctggcaggattttctttctgccaccggctcctcggtcgggagttgccttttgatgctgttaacattcagcttcgaggctccctgccattccccttcgtctaatctcatctccctgcccctttgggaaacgcagtgcctctgcatatttaccctctttagcctcccacatgagaaaatgcctttgaggtggtcgacacattttgactctgcacctctaaacgtagcagtagaggggaagaggttttccgtatttagtaggagagagcaaggtaccatagctttatatgttatgctacctttcttcagtgacttagcaagaaactccttgggaagagggcaggaaattttcttttggggtttgggcccaatttatatcagtcttttggttaagaaaatacgcctttgaagaggaggaccagatttgtggtctcgttctcaatgggcgatgtcatgccaaggtcccccctccctctttccttaagtggcagtccggacaaatagagatattactgatattcccatctctcctttaagcacacagtcttggagtttcataaggttttaaaggccaaacaaacaatttgtgccatttttggcaattctgtttttgttgggggggtgggttattttgtgt

SEQ ID NO: 84827 - DNA, 2377 bp, Homo sapiens
tagttctgtatagaactcttaatgagattggaaggaattttttagtacaattttttgttacctgtttttccagataaaatatctctagtgtaaagagattttgagatgtttctgggaaggaaaagtcagaatcataatttatgcttttctagctagaacatccgtgtctttttttttttttttttttttttttgaggggaagtcttgctctgttgcccaggctagagtgcagtggggtgatctcagctcactgcaacctctgccttctgggttcaagcgattctcctgtctcagcctcttgagtagttgggattacaggtgcctgccactacacctggctaatttttgtatttttagtagagatggagtttcaccatgttggtcaggttggtctggaactcctgacctcgtgatccgcccgcctctgcctctcaaagttctggaattacagatgtgagccaccacacccttccctattttctattttttaaaaataatataaatgtttctctctcagttgtatactaagtaacagagagacagaaagtgtgtgtgtgtgtgtgtctgtctgtctgtctgcgtatatgagactttatggcttatattttaagtatccagcaaaaataagaccctcttgtttacatgtggttcatgttattcataatttgtcatctttgtgaataagtcatggatgctatagaaattgtcaacattaagatgaagatgtctggccagacatggtggctcacacttacactcccagaactttgggaggccgaggcgggtggatcacctgaggtcaggagttcaagaccagcatggccaacatggtgaaaccccgtctctactaaaaatacaaaaaaattagccgggcatggtggcgcacacctgtagttccagctactggggagactaaggcaggagaattgcttgaacccgggaggtggaggttgcaatgagccgagatcgcaccattacgctccagcctgggcaacaagagcgaaactccatctcaaaaaataaataaataaataaaaataagatgaagatgtcttaaaaaacccaaagcaaaatattagggcagagtgaattttcaatatcttcccattgagttctaaagcagtgagtcatgcgctcttttgccaaagggacttgaggctcggttggttttaaaccaagctggccatttctgcttgtggtcctaaaatattttttacttgcctctaagtccctgttaacgaaaatatttcattatgacaggtaacttatttttatgtgctttggaaagagggaaatagttaagttttgaagtggaaattctttgccactgtttttattatgtcatctacagtacaactattactttttttttttttttacttagaaagttgttctatttaaaataaaactagtggtatacaatacgagttctgaaaaaaagacagacctaccgttctccagaagatgcttagctgtaaattgaatcctcgtcattgaaggtcaaacattttgagaaatctgtatttcatgaagaaagatgctgtattatgtaagcgtaatagttaactgcagtgaaggctttttggattgttctttgttgctggtttggcatggcactttttggctagtcattgaaatggaaccttagtttaacttctgttacatatgtaatttttaaccttggcatggcagtcatagaatttaattgatatttatgaaatgctttatattcattggtggcaggcatcataagcacttattattttatttcttgttttctttttaaaagatggtggcttcttgttgaaacttacctagataggactaatctgcatttgtcaaggatacttctggaatggtactctctattgtcttttaacattgtcataaacgtttctctagaactttctaaatattgagcttggtactgattttcatttgttcttctgccagctactttttgaggtagattggtatttttatggatgagagaactgaaatccagagaatttcttttcctgtcgaatgttaggttagtgactagaataaggtaaatattgcagtcacagaactcttgggtactgctttgtaaaatcacacattccttctttctataacgattggactccttaatctttgttaaatggtgaaagttggtggtatttattgcctgcatcatttaaattggcatttattaacatatggtcttgtattgttgactgctttgcatgcataaggcttttggcatttgagtagcttctcccaaaaaatgcctaatactgctttacagatagtattaataagtgaataagtactagttgcatttgactgaatggttatgtgaaaggaaatgtgctatcctaaagatctttgtaat

SEQ ID NO: 84828 - DNA, 1304 bp, Homo sapiens
ataattgggccaggcgtggtggcttacacctgcaatcccagcacttcgagaggctgaggtgggtggatcacttgacgtcaggagttcgagaccagcctggctaacatggtgaagccctatctctactaaaaatacacaaattagccgggcctggtggtgcatgcctgtaatcccagctactcgggagactgaggctggagaatcacttgacccaggaggagtattggagtgagccgagatggcggccactgcactccagactgctgagcgacagcaagactctgtctcaaaaaaaaaataattggagtgaacgtgggaggtcattttaggtggagggaacagcaacataaatagtcacagaagcatgagaaactattttatgtatgctggtaatagtttggcagaggggattgtagaatttgaggttggagaggcacgtctgagccagattgatagaatttgtatattgtgtagcttgtaggcaagttggaagtcattaaacaatttcaggtaaaaacaagcattatgagatgatgtatattttggagagattatgcaggtggcaataatgaatgtggattttggaggtcatgtagacttcttcagaaaataatgattagtgcttgaagcaagacagtgacattaaatgttgttgagtggagaaaggtttaggaggtccggttgtgaatgagtagtgtgatggggagaggcaagttgaaacaattcagatttgtagtttgggtgactgagtggaactgagaaacgaggtgttattagccatagcagagaataagaggaggagttgtatagaatattacataaagcagccagataaatgttcctgaaccacaattttcaagtcactttgttgccaaaaacccatcatcagctttttactgtctttaatgaaaatgcaaagaacacaatggcaaaactatggtactgaataggtgtttattgaatcctaaatgggcactcaaagacttctcttacatgtcctggcttttcatcctgtttcttattgccttccatgtctactgtgattcagctttgggaagatattttctgttccttttgctgctttgactccctgccgcgccccccttacttacgcttcaaatctgcctaccaggttttccatttccaggcagtcttttctaattttttccacctggaagaaactttcttttctctgagttcgtaatcttataataagtacctatttttctcttcttctagcgtatataaaatgtattatctgacgtgtcaagtgagttaatgcatttaaagagcctaggaatggt

SEQ ID NO: 84829 - DNA, 1031 bp, Homo sapiens
ttttaccatattttctttatgtttagactacagaaatgggcaattaggttgtttacagctttttactattacagacaatgctgcagtgaacataaggaaggtgtttgctagtgagatgatatgatgtgtttacttgggctgggtgtggtggctcacaactgtaatctcaacactttgggaggccaaagcaggggattgcttgaggccaggaatttggcaccagcctgggcaacatagtgagaccctgtctctacaaaaaacaaattaaccggatgtggtggcatgtgcctgtggtccctagaagtttgaggtcgctgtgagctgtgcttgtgcctctgcactccaacctggacaaccgggtgcgacctcatctctaaaaataaaaaatgatttgtttgtttttgcactgcagaattcacccttaggttaattaaataaaatatttgttctttggtaatatttatgcttcgagctgaataaagagaatggataatattattgcatcaattttagaccataatttcctaaacttcattctgttttcttccgtctcttcaaccattcaaacatatttattcattatctagccaggggttgaatactggcagccttgtatttctctttgcattgatggttaacatttttttgagccaacatttaaaaactagctgttttacataaagtctctattttctggttatcctgaaaaattaggagctctgtcaacaggcagcccacattttcccatgacagcagttaacctaagctgaattacagctgccttcttgaatttttttttccccctgctggagatggggtctcactctggtgctggggctggtctcagactcctgggctcaagtgatccccctgcctcggcctgccaaagttgtgggattgcagggatgagccaccgcgcccggctcccgctgcctgcctttagatgagcatacgctctccagtggaacaagttgctggtcctccttgttggtgtttattatcgcccttgtattgttcatggtggacagata

SEQ ID NO: 84830 - DNA, 1065 bp, Homo sapiens
gtctagtaggatcgagtattcatccattgttcctcaaatattctacatacaaatgcctgctatagccctctgaagctccttcccttccccttccctttcccctttctttccctttcctttccatctctttctctttctttcctcttatttcttccccttaagtttccttatttacatgtcattcctgctctgagacagggagcggactatgtcttgtgactttatataccttatcactattacagttggttatgtgatagaaaccttataaatgtggttctagagatagattttaataattgcaacattagttttccctgtagaaaaaaagaccaatttatacatgagatacaatatttctaaaatagttatcctttgttacttgttcggttagttactcagtaaggtgccagactggcctgctgagtgcaaatgtgaaacaagaaaggagtgatggagttggtgttaaccaattttctgttcacttgacaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggtaaggggtagaggatagtgctttaacagtaatttctatcatggtacttcagaaggaatattgtttctaacagtgtacagtgttcctttattcacctcttaattgtcagtattggtggaagagcataccatgtagatagtccagggataagccacagtagttgagagtgctttctattaggaagttttaagtatcttttagtactttacataaaatatttgtatgagtatttcttggtaagaaaaactgccaggtcatttatctgtatttgagttaaaaatggttttgtttgtgttttaatttttgttagttgggaaactgaagtccagagagagtaggtcgagtgaaaacgagcccagattctcttgctcacttaagtgaaatgagctgagcgcacagacccc

SEQ ID NO: 84831 - DNA, 1050 bp, Homo sapiens
gttccagctacccgacaggctgaggcgggaagagctcttgagcccaggagttcaaggctacagtgagctatgattgcaccactgcactttagcctgggtaacagagcaagtccttgcctcacaaaaaaaaaaaaaaaaaaaaaaaaaaatgtttccctagcgttcatatgtaaacattcagactcactgaggtaagtatatgaatatattcaaatgttgataatcgtgatgccttttgtttttaaaccatttgtacaggttgaaatttaatcctaaatggagttgactatttccttgtgggttgttgttttactgatttttttaactttatcgtgtaaatccaggtttcttatccaatttgtataaaatccagtgtatttagaacttgctttgacatagtgaaaccccatggtaaaatcccatggtcaattgatgtttcattgctcttggtggtatattacttcataatatattgctgttatgtgttttaggccatgaccacaatgtttcttcagtagccatcatgcccaatggagatcatatagtgtctgcctcaagggataaaactataaaaatgtgggaagtgcaaactgggtaagtaagtttagttgaaaaggcatcagcggccaggtgcagtggctcacacctgtcatcccagcgctttgggaggccaaggtgggcagatcacctggtcaggaattgaagaccagcctggccaacatgatgaaaccccatctctactaaaaatacaaaaattagccgggtgtggtggcgcacacctgtattcccagctacttgggaggctgagacaggagaatcacttgaacctgggaggtggaggttgcagtgagccgagatcgtgccattgcactctagcctgggcaacaagagtgagactccgtctcaaaaaaaaagaaaaggcatcagcttaaagacatatttataaaaaacaaaattgtgttctggtgttgcagtcacttcgactttaacccggaatgatcattatgacagtcatattaaatatactttaaaactaagtttgatctgtac

SEQ ID NO: 84832 - DNA, 1333 bp, Homo sapiens
gcagtgagccgagatcgcgccactgcactccagcctgggcgacagagcgagactccgtctcaaaaaaaaaaaacaaaaagtaaataatctttgtgctggtatacctctgttaggctgaatttggttgtgcatagaattacacttgatttttgtagtacaaagttactagttttactcagattagtagagcatagcttttttccaatatggctggaaatacttttaagtgtgcatttagttttgaaagattttatttcttatacatattttatcttctagatgttgattttattagctccttaatgatatgtctgttagcttattgttcctactttaattaaccaggattgtacatttattctgtcgacttgcatctctaacttggtaccattctcttcatcccagtacatatttttatatcacttctgggaagtgtcctgatgattgtcattcacagtgtaagttattatttatattgacagctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgaggtactgtatatacaaatgtcttcatggttttattgctgatatctgaagtccttagataactttgctaattccctgtttcagggctgttaatgcatttaaaaatctgcatccagcaattctgaatcttgaaattctctactcttcacagcttgctgatgtgtttacattatttaaccagtgatgattattgctgtcagcctatccttgatttgatacgtgatgggtattctcctaaagaattaaaatttatcagaaaaatcagtgttatgagatcatctcaatgtaaaacaaaacctgagggagaggttaaagttttctgtcagaaaaatagccttcattaatgaagataatgattttatttataaatttatggtaaaatgcagttcagtatttattttttaaaattaattccagatgtgatagtataaatgtttttttaaatgaagactaatccatatggcagcctctgatgttcttgatcatttaaaagtactagctgagcctggagttttaacgcatttctttgtgatctttatggttttggtctttattattaatatgttaaaaattacaaggtacagcggcacatggctatagtcctagctactcaggaggctgaggc

SEQ ID NO: 84833 - DNA, 1064 bp, Homo sapiens
agatatatagtgaatgcctgtatatccttcacttagttaccatttgttggttttccttcatgtatgtgtgtatattttgctgaaatcatttgagcgttctttgcagacatcgtaacactttacccccaagtattttagcatgaaccacctaagaacaaggatagtatataaataaccaaaataaaattattcacactcaagaaatttaccattgatagactacatattgagatttgttcttgttatttccataatgccctgcgggacttctttttaaccctcatccaggacccagtcagggatcgtacgttatattcactcctcatgtcttatgagttttcagtttcctttaatctagaatcccctagacttttattttcttctggtcttttgatgtttttggtatgtatagttttatcgtattatgaaatagatgctatttaaacattttgccttttactgagtcaaataacttttttgtttttaaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttgggtatgtacgcctcgcgaggtctctgaacattagattttggagtgccagacaaactgtgttttacataatcgtgtggactttgccaggtaagaaatgactgtgctttcagggcagaatagagaagacatgaaaatcttgtggattcctaccatttgttttaaattctcctttcccgttaactctttccatcgttagccttataataaaaacattactttctccactgcacaacattggttttggaaaccacaatttgtgaagaggttacttaccactctgatgggtaatttttctcccctattagtttgtttctcaaacaaaatcttcctcaacctttcccactggcaggtgtatactatcagatactagaaactcagaaaattgtatttgatttgagtaaacatcctcactatcatctg

SEQ ID NO: 84834 - DNA, 4454 bp, Homo sapiens
tgcccggctaattttttttttaattttgtattttgtagagagggggtctcactatgtttgttgtccaggcttacgtgtgagttttaaataaaccatttctttttctttcagatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtggataagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctataaaactagatgtgatttttttttttttttttttttttttttttgtcttcctttgcacaggggaaatgctgatagaaagtggggctgtgtgtagctccagtcacaaagagtgacacgaatcggtgtcagggcagtaaggcctcatgagctgctttccttcagggcagcacccgaactggctttgctgtcccccttcccccgggtggaggagggagtgcctcagcctgagccttgccatggcatgcgtctgcggcacaggcccgctctccccaaccctcccagcagcccgttctgactgtggctatcgctgtggccagagagccaaagccaggatggctggttacaggcccaagactagactcttggggacagagtctagagataaggggccctgccgggcgcggtggctcacgcctgtaatcccagctcttggggaggcagagacgggaggatagcttgagccc

SEQ ID NO: 84835 - DNA, 2021 bp, Homo sapiens
aagcacatcttcaagacgtacttacaggtgccacccgtccgctctgcggctggccatggcctcccagggtggtgtggggcgtcgggaaagagcctgaggtggggctgagggccctcatgactcggatccaacctgcctcgcagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtggtgcgtgcggggcaggggcggtggggtgggtgggattgggcagatgaggcggccaccacctgctcccagatggcgtctaaggcctgtggtcataggccagggagtcagagagaagagggagcagctgtggagatcactgggtgctggagggtgagggcagccgggaggctcccgggggccgggtggggcagtgttgggggcccgggctggacagcgttggggagctgggtggggcggtgttgggggggcccggcggtgcttgggctgctcaggccccctgctccctcctcagtgagaccgtggaccaggctgtggagacctacggcctgcagaagataacgctcctgcgggagatctcgctgaaaacagggatccaggtgggcatggctcacagcatccccgctgtgtccccgctgtgtccccgctgcgtccctgctgcaggctcccactcctggccagggccacaggggaagtggctttttcacggtagccgtctgtgcgcaagcgttggtgggttgggaggtgccaacccgctgaacctgggcctgaggcttcctgtggtgggggggctgccccccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggtgtgtggccaggtggggctgggtggaggtgggggttccccatggcccgtcctgaccttgccacccctgggggtgccctgcaggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggtaccctctgggctgtggcagcaaaggcctggcctcgtgttgggggatggggagtgagggggcccctgacggaggagtgggtggagtccagggagaccccaggaagtcgctggttctgcccaggccacccctggctccacccctctgtaactgtgtcccgagcgggagagctcaggagcaccctgtgctgcggtgaggtcagttctgggaggcgatggcaggggacccccccacagggcgtcagcaaggacgcctcctgagactccgtgagtgggcaggaagcatgccaccgagctcccacgtcctctgtgcccagtgcaggctgtggggttctgggtgccctgcctggccggggctggtggaggctgtggtggggttctgggtgccctgcctggccagggctgtttcagggttagcatgtcttaggatccctactccctgcaaagggactgttttttcttctgtttataaatgggtgggttgtttgtttgtttgtttgtttctgagacagggtcttgctttgtcacccaggctggagtgtagtggcgtgatatcgactccctgcagcctcaacctcctgggctcaagcgattctcccacctcagcctcccgagtagctgggattacaggcgtgagccagcacacccagctaatttttgtatttttagtagagatg

SEQ ID NO: 84836 - DNA, 1136 bp, Homo sapiens
gcgcccacagttgatcacggaacctctcccctccaccaaaagaactgccattaaaatcccatgaaaccacataggggcagtgttgacattgggggccttggaaagtcctcaggccacccctacatgaggctgcctcgggagagcagggcaaggctgtggtgtggaagtcccacagctccaaaagccctgcccagccgacacactggcgcacaaaagcaggcagccttgtggacgcctgaggcctgtgtgtgcttcagaggcatttggcagaaagttctttataaacaaagatccctgctcaccagtaggcagagtgtgtgtgtgtgtgtgtttgtggtgtcaaaaccagaactccagcttatgtgttcacagtggaatttgaaaacggaaacctaaagttgaaaattaaaaccactgtgttagcacctccaaaacctgttttgtgctgggcaggttgttcagggtgcagggccctggtaacgccataccctccctgccttcctgacagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggaggtgcgggaggcactggggccggggattgggccaaagggcggggagcacggaggtggggggctggagaaggggccgaggggcctgggcctgaggcacccggaccacggccatcaggaggtagggagacagctggccctgggtggccctgtgctgaccaccagcctcgggtccctcagacagcgggaagcggaagaagggcttggagatggaccccatcgactgcacaccacccgagtacatcctgccagggagccgggagcggccactgtgtcccctgcagccccaaaaccgtgactggaaggtaggatcctgggggagggaggaagagggtccctggcggggtggaggccccacaccagaggcctggcccctcagactcggccgctcccgaagcccttgcagtgcctgaaagtactcaccatgagcggatggaacccgcccccggggaaccggaagatgcacggggacctcatgtacctgtttg

SEQ ID NO: 84837 - DNA, 1050 bp, Homo sapiens
gcagcccaggaccacagctcaggagggatggaagaggatggagctggagagggaggggcaagggcactgtgtggggtcagagaagaggagaggaagaggggaactgctgctgggaagctaggtgtgttagggccggaggagaccctcgggcttggcttgaagggtggctttggtgaccctggggagagtggtttgggacatgggttcaggtgcaagccataccacagtgggccagggaacagtggctgggaggggcggctgggtgtggaagtggcctgcaggtgcacggagggcgaggcgcgaccgtgaggctgggactctcgagggcatgcagatgcctttccagaaggcacgtgtccccgtgtggggtcaggcggacagccccgccgaccagcgaggctgcctgattctgacccgttcttgtcacccgcagagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtaagatggaggaacgggtgctgggggccaggcctgagcctgctggggagggtgagctggaaagctcagccttgctcgtgctcctaccggccccattttgtggcaggaaactgaggatcccgtgccctccctagagtcactcagctagcgtggtggacgtgggaatcgagcccagggtcaggtcgttgccccattgctagaggacagcaaccagctgggcctgccagccctatgtggggaggggagtgatagtggctgggaagtgttggcatcccaggactccccagcctcttgctctgtgccctcaggcaagtcacctctctctgggccgtgattttaccatctgccagaggggagggtagtattgggttatctccaagggcagagccagcgtggaggtcttgcaagccggtg

SEQ ID NO: 84838 - DNA, 1047 bp, Homo sapiens
cctattccctatcccgtttcaaaggaatgcagctggctcccaaggggcctcctctccccaggacagcatgttttaccctaatccttcctcctaggaaccccgaaggtctccccacccctggatgaaggctgagcgatctcccccgcaggcagctggctggctcaccaggtcccggtgctcacctggtgcagttggcagctgccctcccctcggctctggagtctcaggatggccgtggcagcaaggcagccagctctccagctcagccccagcattgcccgggttccttgttccagcctctgccgctacccttgccctaatgcagccagtcggcccggggctggagctccggctggcttcgggtttcagtggggccaggcctgccatggcagccccaggaagggcacactccccctgcctggcatcccgctcaaggtcggccagaaggacggctgtgggccaggagaacccggtggccccaggaccccagggggagctgctatcagcactcaggcccacctccctatgccccctagagagggggtcactgccggcaaagccgctagggggatcggagaacccagaatttggggtacctggacccctcaagattgagggcctaggagactggctggcaggggcagggcccagcaagggggtcctctcctccgctcccatcccagtgggggtgaacaggaccgcttctgccagctgccgccaacagctggcacagacccgggtccaggccataaggtggctgcctctgcccaccagtcccagacactgagcaccccactgtccctgggccaagggcctggctgggacctctggctcctgctgccccctgcaggtgacctggctgccagccccttcctgggagtcactggttctggtggaagggagggggatgggcccccagcttcccagaggacaactgcacccgtgcccctggcctccaggctccatcaagaagctggcaggctccatcttcccttcccagcagccccggctctgccaggagggaaccaagtctctcccaggggagaa

SEQ ID NO: 84839 - DNA, 1065 bp, Homo sapiens
gagtgctgttggggcacggctctcccgctctgcagaagacctccttttcccctcccctaaagctcacatcctcagaggtgctcctggactatgagaggagggagtattggcccaagggtgtagaggccttggggagtgctgtgactgggatagttctgctcccccccccccgagtagaggctgaggcctggacgaggaggcaggtgcagcctacctgtgggtgctgccgggcccctcgggagggggtgggtgggctgcgctgagtgggagtgggtcagtgggagcgggtccatgggagcgggtcggcgggagcaggtcggtgggagcgggtgggtagcccgcgctcagtgggagtgactcaaaagccatgggcttgggcgtctgacactcctgttttttctttccttttttttttaaacttaatcccaaatgtgatagtaacacctggttttttcttgctctgggttggctcctcttgcctctgtgaccttgggcagctgcttcctagccttctggagcctcagtttcctcaggtgagatgggctggcacggcggtttagggagctgccgtgggctgggcctagcgtgagtcctggctctgtggtaatcagagtgcaggtggttgtcaacacttctctggggtcactgccaggctgccctgccccacccctctctccggagggttagggtgtatttcaggagagggtaggagcagaggggctctgtctaggcctggtccttctcctctggtcattgtgtgagacccagaaccttccatgggggctgtgaagcagcccagggtctgcctgatccctggtcctggaggggaggggatggagtgagagcctggctcccgcccaccctgggtagggtggatgctggggcagcccttactgggcactggcagcatgtcagaggccctgggaaggcgccctggccagctgggcacctcctcccccgccgtgcggccactggcctcttgctgccagctctgttctcccctgggagagacttggttccctcctggcagagccggggctgctgggaagggaagatggagcctgc

SEQ ID NO: 84840 - DNA, 1022 bp, Homo sapiens
ctccctgtttcagcagcattcattgtgggcctgttccttgcaagagattcccagagacaaagccttgccctcaggaagcgtatggcttagtacagaagccaggtgcattcaggcacatgcacacacacacacacacacacacacacacacacaaacacgatgaagacttatggctttgcacggaagccaggtgcgtgcaggcatgcgtgcacacacacacacacacagaacaaagagtgataatatggcagactgtggtgctagctgccacccagattccaacaaattgcctggggaacagagaggcgggagagagtcgttccatcttggtgggggatcagggatggcttcatggtaaaagtcacatcagagcaaggccctgaaggatgggtcaggcttcaagaggcagagatagggtggatatagtaagtgaggggatggcctggctactgggctactggaagagtttgtcatcagagcagcaagagatagaatccaaaagagaagaagatcagcctgcagatgtggactgctaaatgcaggctgatcttctcccctttgggattctcttatgagaagccataaacgccaggacgagcacccagtggggtgcttctagttgccaggcactgtagttgcagatactgagcaaactactttacctttctaagcctgtctcctcatcgataaagtggatacattaatagaatcttcaacgtggggttgttgccaagataaatgagttaatatatgtaaaatgctaagaacagtaccaattacttattattataagtattattatttatgcattgatgccatgtccaagaaaggcttcttgagttcctgctttccgactgccccaggcctctgagtcaggccatgaacaggaataatgactaagaaacataaacctcatattgattatttcttttgagatagagttttgctcttattgcccaggttggagtgcagtggtgcgatctcaactcactgcaacctctgcctcccaggttgaaacgact

SEQ ID NO: 84841 - DNA, 1127 bp, Homo sapiens
taggagcttgcagtctgaggcggaggtggggagtgggcccctgcagactcctcatatggttaggaagcctgtcctctggaccagacacagtcctaggtgctgaggacgcagcagtgggcagcagagaagcaaagccctgtctggctggagcgtccatgcctgatgggtgttattctgcccacatactttgttttttcctttggagctgatattttagaattggaagattccacattgtgaatctgtttttcagtcttgagaaatcagaagctctgggaacactggctggactggccttccctcattacacctcaacttctagctacctgatcagtacagggctggtagcctcctgctcactgcagcccacctacacctggccacacctttgctacctgccccttccctgaaggacgggacgtacggtgtggggagcaggaggctgggggttgggagctctgggtgtaaccctgtgaacacagaggctgggggttgcatcccagtcctgtgcgtcctttgggacttcttggtcttggcagatccattgcgatgagaaaggaggggtcccggcagcctagcggggcgccctgtgggagctgggctgcagaatggccactgtggatttgccttcaagtattcctcctccctccccctcctgaattacctccaaacaaaatgacagaagttatgggaggctgcgcgtcgcagtacagaaactcaggaataacgtgagaagggacagagacagaaacactcgtggatccccgctctgggcctgcacctgcctggtacttatgcttcacttacctcatttcattctctgcatgacactgatgatcattatcttcattcttcatagaggagaaagctgaggttcaaaagggatggcgtctccaatgtcacctagctcgtataacagagctgggattccaatctgtctggtgccaaattctatgctttttctcccaccaccaattatatggtgaccctggctgaggtacttaacacccccgtgctacagtccaatgaagtagattgaagtgcagctcagagagaccaggtgtcctggtcaagactccaaaactctgttttgggtctcctgttaaggagttaagaactctggcacc

SEQ ID NO: 84842 - DNA, 1014 bp, Homo sapiens
ggctaatttttttgtatttttagtaaatacggggttttactatgttggccaggctggtctcaaactcttgacctcgtgatctgcctgcctcgtcctcccaaagtgctgggattacaggcatgagccaccgtgccctgcctgacaatctggtttttgaaagaaatgtttattatattttaaaaatccttgttccttgcagaaaatttggaaaacacagaaaagcacaaggattaaaataaaaatcaccttcagtcccacaagggagactgtagagatattaacgtttaatattttttttgtggtcttttttttctatgcaaaagcacaccctttcacgtaatatacttacatctgcatctacgtctgtttctctgtattgtaacaaaggcgggattatactttaggtacagtacattagtcaagacccttggtggcaagtgacagaggcccatcttgaattagccaaacaaaataagggggtttattggctggggtaacccatctgtggaaagggttgggcctcagaaacagctggatccaggggcattggcagaactcctctctgtctcgtcactgtgtctctttgtgttggcttcattctcttgggccatctgtctccatgatgttggatccatggttgtagatccttgtgggctaaacgtttcattttattttattattactattattcttttgagacagagtttcactcttgtcacccaggctggagtgcagtggtgcgatcttggcttactgcaacctccgcctcctgggttcaagtgattctcctgcctctgcttcccaagtagctggaattccaggcatgcgccgccacacctggctaatttttgtatttttaatagagacgaggtttcaccatgttggccaggctggtcttgaactcctgacctcaggtgatccacccacctcggcctcccacagtgctgggattacaggcatgagccactgcgcccagccaagggctaaacattttaatggctgaatttcccccag

SEQ ID NO: 84843 - DNA, 1028 bp, Homo sapiens
ccgggaggcagaggttgcagtgagctgagatcgcaccatggcactccagcctgggcgacagggcgagactccatctcaaaaaaaaaaaaaagaaagtccctgcttcctgttgggtcctcctccttgccttgagccctctccctccattcagatccatccccactgatgtctcctgctcgtctcttgtccattacttttttcctcctgagccctactgtaatgcttggagagtttggggggctggtgagggcaggatcatctgctgtctgttcatgtctcccaagagaccgcagggtccttcaggctgggtgggtgctgaatatccaatggggaccaggtaggcctgattcctgccctcctggagctcaccgtccagcgggaaggacaggcatcagactgatcgtgacaactgaggggctgggagcagggggctgggagcagggtgccgtggtggcagagagcacggggactgatggatgacatcggaagggagggacattcaggcagagacctggaggatgattaggatacaggaagacgaaggcttgggggggatgggagtgtgggtgagagaagggtctagacagagggagtagtgtgagtgggagggctcatcacaggaacccacaggctgtgtagaccggttggggcaggtgtggagaggaagtgagaggggtgggagatgaggctgggtggggccgttgggacaagggggtgcggagagttgggtttgagccacatggtcatgggagccatggaaggaggacagaataatccacctcacatttatttttcaccttcttcttttttttttttttttattgtggtaaaatacacatcacacacagtgtctcacttgaatcattttaaagtatacggttccgtggcatcaagtcctgttcacagtgttttgggatcctcactaccattctccagaccatgttcatcatccagatggaaactgtatccattagccgtcactcccacccccgcctcccccatcccgaagcaactaccatctactttct

SEQ ID NO: 84844 - DNA, 1022 bp, Homo sapiens
gaaacccaggttacttggtgtgtttagctctcggccccccctttactttctgtcaccaagtcctcttaattttgctcccgaaatgccttatgactctgaccctttcatgtcatttctgtggctgtgagcgcagtggagggcagcgcccctcggccccgtttcggtcttcccctggcccctcccttccagccgctccgttctctctctgctgcttgcagagtcctccagcaaagctctgcaggtcatgggcaccccgcctcgggccccttggcttccttcctttgccctcgagagagggttcagcatgcggcaccttttcccagcgtccgcacagcgccggcactgtttgtactgtgtgtgtgtcacctgtctcaggcccataatgttttccttcaagcggctcaggtgttacaacttcagtggacttgtttcagaaggcacctttacgtcactaccataaaaggaaaatcagggtggcctcccacaaagagggtctctgtcaaagctcagtaagtgactgttacagtgaagaccaccccaggtgccctcgggggcccgcggggaggcaggcgtccactctgggaagccgtgggccatgggatctcctccccagcgggccccttctcctcctcagaggcagtgtagcaccgtggtaaacgccacagaccctggggccaagcctgcgcccaagcctcactctgctcctttccagcaacatgatcttggtccgcttaacctctctgagcctcattttccctgctgtaaaaggggttaatactatttccttcagtggattgtggtattaaataagagagtgtacatggatcacttcacacagtgccctaacccttgaggcctgtttgctggcatttgcccttccccgctactttttttttgagacggggtcttgctctgttgcccaggctggagtgcagtggcgcgatctcggcttactgcaacctccgcctcccgggttcaagcaattctcctgcctcagcctcccgagtagctgggattacagg

SEQ ID NO: 84845 - DNA, 1065 bp, Homo sapiens
ctgggatgggctgtgaccccgaggtcagccctgccaggtaggaacaggtgcgcaacacctgctccttctcaagctacccattcactccacctgttggagccttttgttcctgaatccagtgtcctcttccctcccccacactctgccaggtctgctgggctcatgccctttctcccttccacactggccccagcacaggcatgagggtcatcagtgcccgcatctccatgtctgtccccttggggcttggaattgagccatgtgcatatacccggggcctggcggttcccacatggcagctgggctcccgtgtccctgtctcccagcttagcatccacagtatgtggggcagcgagtgcccagatctgaagatgtccctgcccccgtccacctctgccttctgatcagctttctgccttggcccctcctcctccgtgcccattcttcccgttgatttgagccttggcaacaaggcgaccagccatgtttttgcagcgtaccaggcactgtgctgagtgctttctgggccttcctcataacgccccatgaggcgaggagtagtcacaccgttttacagatgaggaagctgaggcatggagaggtgagataacctgaccacacagtgaatcaggagtggtgctggagtattgattagcaggagtattgattagcgattgcatcccgttcccctctccctgcagcccctggcaacctctcatcaccgttctgtctgtggatttgcctgttctgtggatttcatggaactggaatcacacagcatgtggccttttgtgcctggctcctgtcactcggcaccgtgcttcctaggtgcatccgtgttgtagcatgcatcagttcttcattccttttctttctattgtctttatagtcataagctatcagtttgtttttatttttattttattttattttattttgagacggagtctcactctgtcacccaggctggagtgcagtggagcgatctcggctcactgcaagctccgccttccgggagcttccgctattctcctgcctcagcctctcgagtagctgggactacag

SEQ ID NO: 84846 - DNA, 1014 bp, Homo sapiens
aagctcccaggcatcatttgggaaatccttctggtcagaagctgccatgtgctccgacttgagagtctgcctcgcttcctagagaccggccccaggagcttatccagtgtccagtagagaccggccccaggagcttatccagcatccagggggaaaaggcaggggagaggggctcagctcagggagtgttggatgctgcgcccttttgaccgggactcagggccttgaacaataatcatatgtgccctggtgccatgagcgtggacaccttgtgcctgatggggaaaaatagacagcatgactgtgtgtatgagcgtccagtgaccggtgatgttaaaaccagctctgtcctcctctggactgtgtgtttctggagagccagggctgctgtccatcaaggtgcctgcgagccatctccagaggccctctgctaagcccagagtcgccctatagcatctggtgggggcttgttttacttcccctccctgcgtgcttttccttgctgggctcctagccttacaggggagcagctgtcattctcaccatgggcccgaagaggacctgagggtgatgccctcctgcttgatcattcttcctttcccccatcatggctcttaaaggccaggcccattgaggaggagctgtggctgcttgggagagggccaggtggaggaggcggtgagcctgtgctggacccagctctgttgtgcacacaggcaggtgagtgtctggcagagcagccagactggagcctacggtggtaatgtccaaggccgtacatagaaggaggctggcagctctagctgagaggtagcaggagctggtgcctgcttttgtgtgtgtgtgagagtgtgtgcacacacctaggagctatctcagccctgctggtttcttgagccagttacagcctggatcaggcgggagagtcccccctctccagccatcaaaacttacatcaacaaggtccaggaagaaagaaagaggaagggagatggggagcaggagacagggatt

SEQ ID NO: 84847 - DNA, 1051 bp, Homo sapiens
ggattactggcgtgagccacccaacccagcctgcattgtatgttaaactgtgtccgagagcccagtcactcttggaggagagaagggaaggcgcaggcaggtcctcactcacctcttttggcctcttcacaggaagcaggagctggccaacagctcggatgcgaccctcccagaccggccgctctcccctcctctcacggcacctcccaccatgaaggtaagaggcttcgattcaggaaggcagggaggggagagtgtggggaagttgtgaggccttgctgtggctttggctccaggcccagcagcgtccgtcgcagtggggctgtggagtgtcctgacacctcggaggaggtgatgttcagttaagcaccagtgcgggggaagcatgacaagagactcagggtgtctgtgtcaaggggcggtgaggacattggggttgaaatggggttggcaggactcttggtaattggtagtggagtttgggaacaaggggcccagccaggaggaagccgggggatagaaggcagctgcccagaaggactgcctggggctgggctgtggccctcctgggacttgaagggcatttgcatgctggtctgccggcctctggctggcccttctgagctgggcctgttcacggcagtccccatggaagggttggctggaggttcgggtcggggtggcagttattttcttatcagcacttccttcgtgagcctttttcctggggagaccacagtccaggctgctaggcccaggaccttctcactcctggacgggagccgagggagcagtgcccttctgccaccatgaccttcccccatcacttttcagtccgacgcctcggcaggatggccacacaggcctgagctggtcctcagaggagacttttggctcagccagtgtttctgcataggctggcatgcacgctctccctccctccctccctgcctccctccttccttcacactctgtggagtgagtgaggactagtgctgaagaagtcacctgcctcctgagtcatctgaggggacatctaggccagctcctc

SEQ ID NO: 84848 - DNA, 1075 bp, Homo sapiens
taagaagtctttgcttaccccagctcacaaagatttccttccatgtattcttttagaagctttatttttatttattttttttgagacagagtctcgctctgtcaccaggctggagtgcagtggcgtgatctcggctcactgcaacctctgcttcctgagttcaagcgattctcctgcctcagcttttcgaatagctggaactacaggtgcctgccaccacacctggctgatttttttgtatttttactagaaacggggtttcaccacgttggccaggatggtctcagtctcctgatctcgtgatccgcccgcctcagcctctcccaaagtgctgggattacaggcatgagccactgcgcccggctagaagctttattgttttagctctaggtctaggataaacttgttttaatttaattatgtatggcagtatgttggggtctaggttcatttattgccatatggatactctgttgttccagtactgtatgttgagaagactttcctttccttgctgaactgctttggtgccttagtcaaaactctgccaggcatgtaagtgtacacgtgtgtttgtttattgtctctccaaccatggtgtttctctgcatcagggatggaaaatacgtgccatccgtgccgtcagtccaccgtttggctcccgtggcagatactggtaattgatcatggcactctttcccaagagcttagacgtggtctcagaatcctgttcaacaaagcaccgtaggcagccactggcagtcatttggagttgtcatttgagataaatcacttctggcatctctgattgaaattgtcacaagaggttatttgctgaaggtcccacagctggtgagtggcagagccaggatgtgggctcaggtttgtctgtgtgggtctgaagcctgtgctgtcttccccacctctacagactgctctgcgtgaatcatttcaacaggtcgcttcatctccgtgacctccagtctcttcacttgcataatagggacggtggccaccgggaggagtgggtgtgggcagtaatgaggtcatccacagaatcgctagtggagcatct

SEQ ID NO: 84849 - DNA, 1039 bp, Homo sapiens
atccttgtcttctggtaatgtttttagtttgctgttgatgtagccttgtcccctccgtgtgtcctggattggggtgggcgggaataacgaggcgattgcaaggactcattgagcgacctgtgtgccaggctctgtacacgctggcccgtgtggtcctgccacagctctgtgagttagcggtcatgttttcagccccatgcaaaggcgcaagcactcagacagcgtggttctgtgaacatgagtgtgtggtgcctcccaggagcagggattttagcgaggctgctgacacataaacacacccccacctccagaagcagaggagaggagcccagggccagggcaggtagctcagcaaggacccagcatgctgcaggtggggccagtgagagtcacttctccagcgagggtcagagaggagagaggcaagagtgttgcaggggcgagggtctcatgagctggggtgcggcaagagggaaggaacaggtggatgcctgtctgcaggagaagctgtgcctgtgtgtagagctgctgtggaccagggggaggcagggagggcacagggtggtgatgagatggagagaaggggtcctggactcgggtgcaacaagagggaaggaagaggtggctgcctgtctgcaggagaagccgtgtccatgtgtagagctgctgtggaccagggggaggcagggagggcacagggtggtgatgagatggagagaaggggtcctggactcgggtgcaacaagagggaaggaacaggtggctgcctgtctgcaggagaagctgtgcctgtgtgtagagctgctgtggaccagggggaggcagggagggcacagggtggtgagatggagagagggggtcctggactcacacgagtgccatcttttcccgtcgcttcttctgctttgccgcctgggcagtgggctggcacccgaaccggcaagtaggggcattgggaaagatccctcaagatttcccaagcctaaattactccttgtggttcttgttcacgtctgcccctgctacctgggacctcctc

SEQ ID NO: 84850 - DNA, 1052 bp, Homo sapiens
cccagctaatttttgttatttttagtagagacagggtttcactatgttggccaggctggtctcgaactcctgggctcatgtggtctgcccgcctcagcctcctaaagtgctgggattacaggtgtgagccaccactgcaccagacccctcatttattgatataatggcttttggatagtttgaggtatggtcttccagatcattttctatgaatttatatgcatacattatatacagtatctttttttttttaagagatggagcctcactgtgtcacccagggtagggtacagtgtcatgatcatagctcactgcagccttgaactcctgggctctagcaaccctccttgcctcagcctcctgtgtagctaggattacaggtgtgaaccaccgtgtctggctgtttttataaaattgagattatattcaatgtattgtctctgatttcctccacccctcaacttaatatatcttggagagtgtcatatgtaagcaacatgaatctgttgctgtctttttgaatgattgtatagtttttttgaacagctttattgagatataatttacgtatcataaagtcacccatttaaagtgtacaatttggccgggtacgatggctcacgcttgtcatcccagcacttcgggaggccaaggtgggcagatcacctgaggtcaggagttcaagaccagcctggccaacatggtgaaaccctgtctctaccaaaaatacaaaaattagctgggcatgggggcgcatgcctgtaatcccagctactccggaggctgaggcaggagaatcgcttgaacccaggaggtggaagttgcagtgagctgacatcgcgccattgcactccagcctgggtgaaaagagcgaaactccatttcaaaaaataaaaaataaaataaagtgtacaattcagtggtttttggtggtattcacggagctgtgtaaccaccatcataatcagttttagaacctttttattgctttgaaacgaaatccgtaccttttagctatcaccttccaatcccccatccccctcagcttaagc

SEQ ID NO: 84851 - DNA, 1189 bp, Homo sapiens
atgtgttctcacacctcaagaagtctctgtttccatctaaatcacgcaaatctctccgtcctcattcaggcagatcctctgagtgcttgtactgcatagtgtctgcgagcctctgattgcttaaaagtgacaaagttaaatttaaaagaatagattctgcccttcagatttaccaggttcttgatgtactgagggcagattccggaaatctgtagcctgaggccgctttgcagagtctcacgtgacgggaggctgcctcagagcccctgggtcttgttagcatgcagattccagggcctcagtctgatccagcaggtctggggagctgtgtttttcgcccgtgttccccgagccagggagtgacccactggctcaggacacctcccagctcccctgggtggaggtgccagggttcctccttgctgtcttgccccagatagtgtgaactggtgagggccgccccatgggaatgagaatgtggactcggtatcttgtggttaagaacttgcccttcagagtcaagacagctgtgcgtttgaaccctggatctgtcccttactcatcgtgtcatcctgggcagtgacttaaccccccgaccattggttttcccatctgtgaaatggggatgatgttctctcccggatacagctgtggtcaggactgaaggagatagtgggtattaagcccctggcacggtgcctggcgcctcctgaggatccggccgtcggtacctgttaatgtcgttgtcattgtcatcagtagcatccttctcttccttgttgctgtggggcttctcctggtgaaggaggtggtttagggggaacatacctggaaggtttcttcctccttcctgctcacactcagtttctttttttaggatcatctaaacttttactgtaccggcagcagcctggggaacttgatcctgtccgtcaagtgcgaggaagcagaggggatcgagtacctccgggtcatccttaggtagggctgttgcgctgcttgaggccacttctcttccaggcagggctctcatcggtggtgtgggggctgggatgggactcagaaataccagactgaccagtctggtctgggtgcactggctgacggggacaggcctgctggaatcctggggctgtgtctgaagttgcctagcagggagacccacgcgctccaccagttagctgacagt

SEQ ID NO: 84852 - DNA, 1035 bp, Homo sapiens
tgtttatgtacctgatgctgctgtggaggaaaaagccaagaagataatttttttttttttttttaagaacctaggcagattgttgttttgcaaacctgcagctgggggacatttaatatgaacatttgttgcatcaaagccctatgctggtctctgggtataaatgagcctcacctaactctcgtgtttgctgttcactgtgctgtgcatgctgggggatacggtgactaagacccctccctgagtgcacagtccagctcaaggccaggatcaaaataatggcaatactactactctcaggctggatgtgaatcttgcaagagaagtgcaggtcccacagcacacgctgcattgtttttctagtgggagatgtagtttgcctggaagcagctgctcttccacagtctggcctcatgacctggggcaagtaggacatgtggctagagttgtgacgccttcatggcatgctatagatcagggattggcaaacttttttgggtaaagggccagatagtaaatatttttagacttcatgggccttggagtctctgtgacagcctctcagctttgccttggtggtgcagaagtagcaatagacaatagataaatgagttggcctgtctgcgttccaataaaactttatcgataaacacaggcagcaggccagacttggcccatgggctgcagtttgttgactccttctagagtgcggtgtttcccagccttcagacattcacagaccatatccaggatctgtatcatagcatttgttgcaccctatgccactgttaagatctttatcacaatattttaacgaaatattttctttaaaaagttttgttttaaacttacatacatttattttttatttttatttttatttttttgagacggagttttgctcttgttgcccaagctggagtgcaaaggtgtgatctcggctcattgcaacctccgcctcccgggttcaagcaattctgcctcagctccctcgagcagctgggattacaggcaggcaccaccacgcccagctaa

SEQ ID NO: 84853 - DNA, 1063 bp, Homo sapiens
ctgagtaaatattaagtttctcttcctgagaaatggaaagatgcgcgtggagtaagtgaggcaatttgtgtgaaagtgcccagcacagtgcttggtgtaaaacaggtgctcagtgaatgagaaactcagtgtgaagggactgagcattgggcctgcatgcagtgggtgcttaacaaaggaacaaatgcatagacaggcacctagccaggactcgacatacaggagcgggtttttgtgtgtgtgtgaggagggctgtcactctctcacccaggctggagtgcagtggtgcgatcatagctcaccgcggccttgaacttcaggacagggttaacatttgatatcatgcatgaacagcccaacatggttccagggacacaccaggtgcttggtggccgagatcacacccagaagcacctggccctgcttgggatatggagttatggttgggatcctccttccatcccacctacgccaagctgggtgagcagtgctgtcatgatctgccacctcatcactctcattcacaccttcaagaccccctgacacgtctcctcctccaggaagccctctcaggttgctttccagccctgtaattttgcccttgcctctgtctccagagctgtcagggatttcatgcacagcagctgacttagcccttgctggctggtggctttgttagttttctcaggtggcttcacctgtgtttgtatttctcccagatcaatgacaggctctaccagggcaagaccccgccttgccttttaaatattcttgccaagtcctgagtcagggatctgcatgctgtagaggtcagtaagatgctcgctagcctctacctaacgacttggccatcttccccattttttttttcctttttggtggcttctaaagattgaaagaaggttgggcacagtggcttatgcctatcatcccagcactttgggaggctgaggcgggctggtcaggagtttaagaccagcctggccaacatggtgaaacctcgtctctaccaaaaaatacagaaattagtgggtgtagtgtcacgcgtctgtaatcccagcta

SEQ ID NO: 84854 - DNA, 1014 bp, Homo sapiens
cccagggagaagggcagggggagtagagcaggaggccgagcacgcagccttcatcttagctgcagcatttgtgagcacgaagctcagctcagcagtaggtccacaccgttgctgggccgggctgggcagaatgtcagcctccaggccaggtgtctggagctcacaaggagcaggcacatctctgctctcagagccagcttctccatccccaccctcttcccttctaggaccggaccagggctgccctcctggacaaccttcacgatgagctccacgcccacacacaggccatgctgggactgggcccagaggaggacaagtttgagaatggaggccacggggggttcctggagtcttttaaggtatgagcgtcagagtgactgatggttgctgtggggttgggattggggaagaaaggaagtggtccaaggtccatgggatactgatcccagagcccaagggccagctggaggggtgacaggaaacgtatgggtatcctaggtgtttgcaaagggcagggccgttaggaagtgtgtgaggctggagcagccagcagttttctcagcagcctccccatccttcctctatctgggtcatctcctccgggcccagaagtctgttaagcagggacaggtaaagaggtagcagtaggagaggagctggagcaagccaggaacatcggcgctttcacctgcctcctcctgggttggggagcccagggcagaatggcaggagcgaggaccacagcccttacgggtcttcgtagctgctgtgggtgccacagtgattcttcctagccagccggccgagcattggaagacctggctgggcaggggccatggaactataggcaagtccctttggactttgccaagggaaaaaaactaactagaaggagctgctaaaggaagcagtgagctccctgtccctggaagtattcaagtggagctcggacggcccccgagctggcgtgtggtagaggtttttcatcttatgcttgctgagtgcttgttg

SEQ ID NO: 84855 - DNA, 1039 bp, Homo sapiens
ttggagcagagttggcatctgtcttgcatttgccccgctagagggacagaagacccggtgctgactcctcacacttacccagcctgccgcctcctcacacttaccttgctgactccggcggctgcaccaggactaattgaggagccagtgtcctccctgacaccagcctctgagtttttcttttcttttcttttctttttttttttttttttttttggtgggagccttgaaaattcgtggtttctaatcatccttcagtcatccaccagttgaattgtattttcaacctggaccagtttttaatatacagggacccttttatctggagcccagggttctgggtttggatcctggctctatctcttacctgctatgtgggcttgggcaataatttacccttcagaactttttctgtccaatgcctgtcctctctgcatctcagaattgtagagattcaatagatcttgtatgtgaagctcatgagaccagatactgttacacaggagttactatttcccacatggaatcctttctgggaaagagacagggaggaatacaatcacgtgtcactcaacgacgggaaatacgtcctgagaaatgacgggaatacgtcctacgacacacgtcggctatagagcccgtggctgccagcacagacctggatggtctagcctaggacacacgtcggctatagagcgtgtggctgccagcacagacctggatggtctagcctaggacacacgttggctatagggcgcgtggctgccagcacagacctggatggtcgagcctaggacacacgtcggctatagagcctgtggctgccaggttacaaagctgtgcagcaggttcctttactgaatattgtaggtaattgtaacacaaagacaggcatttgtatactaaacatctaaatatggaaaaggtacagtaaaaatatagtattagaatcttaataggaccagtgtcatctatgcagtctgttgactgcagtgtcattgtgtggtgctggactggattgcagaatataaatgattag

SEQ ID NO: 84856 - DNA, 1088 bp, Homo sapiens
gctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagg

SEQ ID NO: 84857 - DNA, 1063 bp, Homo sapiens
agaggtcaccagtagactgccctctggatctcttaattcacatcctagagacagcttgtgattcagctcatcttttaagtaaggccactgaaatcctggcttaggtttgggttaggcctcttacctctgaaccagttagctgaggtttggtgggtgctgggaggtcttaatggttgttgttgactttttactttcctctggaagaggaatgggcaggcagacattctgaagtatacgtggtacatgctggttatatacatttacattttgggggcacattttaaaaattaataggatcttatatagctagaatttaaaaatatctctgatgtagcaatacttgtattgttaatttcatctagtgtgctcccatagactttaatatacttctaaatctgtattttgtttaaagaaaacaaaatatataaaagatatatttgaagaaatttaagtgtgaagttcatatatttccaatttttgtgtataaaaatcataaattcacatggatatgcacaactgggcatttatctggtcatactccaccatttaaaaaacattccgtcatttaaaatatttttataagtagcatgaatgttgaccttgaaaaattgagctactccataaggaaatgtgtgtcctcctgaagtacttcaagctcggaccagggttactatttgtcagaaatagtagttttcctgtattgggtaagagataggactgcatcagtgttgtttttttttgttttttaaatttttatttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttgagagagcacagggttggggggtaa

SEQ ID NO: 84858 - DNA, 1039 bp, Homo sapiens
cccttaaattcccgaaacctaactgtgggtccatgtgggtgtccacttctgttttacagactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcaggtaagtttttcttttgttctgtcctcagacttacactgtcgcctgcctcataagcaccagctctgtgcgagtctgcagggcacacagagcttagcagtcttggcatcctgctggagatcattattctgtaaagatgaaaagcacccttgtccttgcaggtaaaatcctctattgagggagcttacaggccagcagggcaagttctgtccctgagcaccaaccatctgtgctgaccacctctggggctgggtgagagaaacggctctttctagctttctggtttctatgtgactccgggcccaagaaaacagatgagctgatgagggttttggttactgtgttggaagtgatgtcagatctgattagaagtgcaggataggctgggcgcggtggctcacgcctgtaatcccagcactttgggaggccgaggcaggcggatcacgaggtcaggagttcaagaccagcctggccaagatggtgaaaccctgtctctactaaaaataccaaaattagccaggtgtggtggtgggtgcctgtaatcccagctactcaggaggctgaggcagagaatcgcttgaacccgggaggcggaggtttcagtgagctgagatcacatcactgcactccagcctgacgacagagcgagactccatctcaaaacaaaacaaaacggccgggcgcagtggctcatgcctgtaatcccagcactttgggaggccaaggcaggtggatcacgaggtcaggagatcgagaccatcctggctaacacggtgaaaccccatctgtattaaaaaaaaaaataga

SEQ ID NO: 84859 - DNA, 1022 bp, Homo sapiens
tctcccgtcagatgcctctcccagctttccaagtccggactgctccctcctcattccctgcctgagccctctcctccttcagtcaaatgctggccctcacacaaggccccactcagacccgactctctgggaagcctttcccaccggagcagggagccacggtcctgggcctccagatgcctcatttgtcattcacacccaccttgctttcttctctgttctcaccctaccctgaagggacagacacctggtctcctgattaagacaggaaggcctacgggagcacgatttccacctggctacccatcagggtggagcacctagcatttcctaagcctaactgcttgagagttgaaggccagatgtgaaatccagagggttggttgagatctcactgtccagcttctcagcagtaattagactcttgtcctccacaggccaccattaaatgcaaccctggtgatcacttttgaaatcacatttcgttccaaaaatattactatccttgagctccccgatgaagtaagtaaccaatcttaacggatgggtagggaaatgctaggtaacagaacacatttgaattaagagctggtggaaacaggtctcctaggcggcccctgttccatcaacctagaaatctgtgattttggctttgttggtgtcttttggggatgagtatcacatgccattagatggaattaagaaggtgatagtgaggaacctgaggcaaaaatggttctgggaatgtaaacgttcttaccgggagtggtggctcacgcctgtaatcccagcactctgggaggccaaggtgagcgggtcacctgaggtaggaagttcgagaccagcctgatcaacatggtgaaaccccatctctactaaagtaaatacaaaaattagccagtcgtggtggcatgcacctgtaatccaagccacttgggaggctgaggcaggaggatcacttgaacccaggaggcggaggttggggtgagcctagatggccccactacactccagcctgggtg

SEQ ID NO: 84860 - DNA, 1070 bp, Homo sapiens
attacaggtgtgagccactggcccggccattgattgattgagacagagtctcactttgtagcccaggctggagtgcaatggcgcaatctcagctcaccgcaacctccacctcccaagtttaatcaattatcctgccccagcctcccgagtagctgggattacaggcacacaccaccacacccggctaatttttgtgtttttagtagagatggggtttcaccatgtttgccaggctggtcttgaactcctggcctcaggcgatccgcccacctcggcctcccaaagtgctgggattacaggagccaccacgcctggccaaagtgtcctctttttaaaatcaaaaaagataccaaacaagccttggctgtaggagtccttgaacctgaagcacaaacagatccagcaaatccatggtgtcagtcagggtagcagtgaccctcggggccagcggaggctggaggaagcaagcaggggttccgaggacttgggaatgtttcatttcttcatctgggagctggatgcattcagtctgtagacatttcatcaagctgtgatgtgtgtacttctctacctatatgtcatagttcagtttttaaaaaagtcttcaacagtgagaggctgggcaccgtgggattacatctgtaatcccagcactttgggaggccgaggtgggcggatcacctgaggtcaggagttcaagaccagcctggccaacatggtgaaaccccgtctctactaaaaatacaaaaattagccaggtggtagtggtgtgcgcctataatcccagctactcaggaggctgaggcaggagaatcacttgaacccgggaggcagaggtggcagtgagctgagatcacgccactgcactccagcctgggtgacagaatgagaccctgtctcaaaaaaaaagaaaagaaaagaaaagtctttaacaatgagagtcaaaccattggtgtgagatggcattgatgggcaccaacctaccttttcaggctcctgcctcactggcccttccccacccaactctcaccactcccctctactacccgtgatgctggaagcctctggtt

SEQ ID NO: 84861 - DNA, 1028 bp, Homo sapiens
agtccatctctactaaaaattcaaaaattagctgggcatggtggcgcacacctgtaatcccaggtactcgggactcaggagcctaaggcaggagaaccgcttgaactcgggaggcagaggttgcagtgagccgagatcactccactacactccagcctgggtgacagagcgagactccgtctcaaaaaaaaaaaaaaaaaggaaagtctcactcaggccaggcgcggtggctcacatctataatcccagcactttgggaggctgaggcgggtagattgcttgagctcaggagttcgagaccagcctgggcagcatggcgaacaggaggttcaagttggctggtgggcgcagcgtctctccttttgcttagtaagctcttggaaggtgaggctgcgggtggtgcgtccctccgttccctagcgtgttgcatagagctagatgccagcggggtcctcggtaactgtacgtggcatcggattgaacctcagtcttcctaacaggttgtggtgcctcctggagtgacaaactcctcttttcaagtgacatctcaaaatgttggacaacttactgtttatctacatggaaatcactccaatcagaccgggtaggctggcctcagggtgtgcgggcctcacgtgacaagaagggggccgtgctgggcacgtgggagtctccttcagaagcccagcctcagctcatcccggtccccaaactcctttccagcccgaggatacgctttcttgtgatccgcagcagcgccattagcatcataaaccaggtgattggctggatctactttgtggcctggtccatctccttctaccctcaggtgatcatgaattggaggcggaaaaggtaaccccctgggccgtatgtgcaggctctctcggggcccctaggagcagggcgttccagcaaggctgccgatagcgcagcctccaacgtcccctctacccttctgtctgcctaccctttccagaaagttgtcccagtgcgaaggctcggagagcctgggtcggattcccgtg

SEQ ID NO: 84862 - DNA, 1046 bp, Homo sapiens
ccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacggggggaaggaaaggtcacagcagtcagaggacccacagggctctgcagcatgggaggacgtggggcacaggcagtcagactggggcgcatccccgcagacccgcccccccaaccagacccaggaagccccggccaggcctgtggggggcgttaaccccgctctacagacggggaaaccaaggctaggagaactgtcacttgcccaagacagcaggctccggtgatggagccaggattccaaaccagaagtcccactcccaccagtccctaagcacatgaagtccaggctgagtttggggacagccttgcctggaggtgagaagaagaatcatagctacagggaaactagcacagggccttggccccagggatgtggaggagacggggaaggccgcatcggccccgcctctgctggagctgtgaggtgtggggggtgcggggcctttgcttgctgtacatgcagatgagacgcctacccccaggaccacccaaactgttccttggctgaggcctgtcatagcccaaaggtcaccgtgtccttggagccaaggccccagtgggaggaatgagaaccgcttttgtttggaggggcagtcacgaggcgcatgaggcagccgcccagccctcaccgccctccgtctgtctgtccgtctgtctggcccaggcctacatgaacttttactacaaaagcactgagggctggagcattggcaacgtgctcctggacttcaccgggggcagcttcagcctcctgcagatgttcctccagtcctacaacaacggtgagtcagccagcgggctgctggccaccct

SEQ ID NO: 84863 - DNA, 1433 bp, Homo sapiens
gcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccaggtctcggaagctccagggggagggggcggcgtgaacccaactcaccgagctccgggcgccacttgtaacttggttttctccgcagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacactttgtggagttctttcctgctgtaacgcttaggctgccactgatgcaaaatcgccgagatttgactcctggagagcaaggaatgggccatagccttgtgttaagtccttgtatttacacataggccattcagaaacgggccctaagggcctacataaggaaagaacttattaacatcctaagaagcagtaacagttaatatgtattaagagctccctgggccgggcacggtggctcatgtctgtaatcccagcactttgggaggccgaggtgggcggatcacctgaggtcaggagttcaagaccaacctggccaacatggcaaaactccgtctctactaaaaatataaatattagccgggtgtggtggcgcgcgcctgcaatgccaggtactcgggaggctgaggaaagagaatcgcttgaaccctggaggcagaggttgcagcgagccgagatcgtgccactgcat

SEQ ID NO: 84864 - DNA, 2219 bp, Homo sapiens
ccactaaccactactttcaggtatatatggtgtcattttagttccatttcatttagtgacagtcctttccataagaaaaaataaagtcaagctgtattttttagaatatgtctagggaagattaaacattgtttggacatttaggctgggcacagtggctcacgcctgtaatcctagcactttgggagtccgacggcaggcagatcacctgaggtcaggagtttgagacaagcctggccaacatggcgaaaccccatctctactaaaaataagatgcaaaaattagccaggcgtggtggtgggcacctgtaatcccagctacttgggtggctgaggtaggagaatcgcttgaaccctggaggtggaggttgcagtgagccaagatcataccactgcactccagcctgggtgacagcaagattccatctcaaaaaaaacacaaaaattgtttggacattgaagttgaactttgggcaggtttagggtgtaaacacctccatgtgttaatccatgatcctttcttgtcaggagggttattttagaataaaacgcatttgtggccgagcacggtggctcatgcctgtaatcccagcactttgggaggccgaggtgggcagatcacctgaggtcaggagttcgagaccagcctgaccaacatggagaaaccccatctctactaaaaatacaaaattagccgggtgtggtggcacaggcctgtaatcccagctactaggaaggctgaggcaggagaatctcttgaacctgggaggcagaggttgcggtgagccgagatcatgccattgcactccggcctgggcaacaagagcgaaactccctctcaaaaaaaaaagaataaaatgcatttgtttaattgaggaataaatattgcattagaatgacggtaattgcctgagtgtagtggctcctgctgtgatctcagcactttgggaggccaaggcttgagcccaggagatcaagaccagcctgggcaacatagtgagatgcccatctctacaaaaaaacatttaattagccagatgtggtggcatgtgcctgtagtcccagctactcaggaggctgaggtgggaggatcaggatcacctgggcccgggaggttgaggccacagtaagccacgattttgccactacactccaacctaggcaacagcgagaccctgtctaaaaaaaaaagaaattacagtaatgaaaatgatggtgctcattggatttatggttaactggggaaaccagcatcacctaacttcagaaatacttaaatcatggtgagtactatgaagaggacatagcagacctagcccaagttggggtatatggaggtcaaggaagtcttctctgaggaaataacattacatctgaaacccaaaagttgaataacataggcaagtgtggggaaggagttaccttcaggaaagcgcatgtttccaggccattgggcaggaaggaatgtgactgtatttagagagtgagagaagaggccacagggtagacccagaccagatcatggagggcagtaatgggtgtggggacatgcgcctgtagtccagctactcaggaggctggaatgggaagatcaagatcacttgagcccaggaggttgaggctgcagtgagctcccatttgccctggccttgatcctcagagcaaatgggggaagcctttggaagtttttagtctgaagtgacgtaatcacatttggattttttttaaaaaaagaatctgttttagattggaaggggatctgagagcttgaatccaagtccccttttgacagatcatagatagcccatggccagtcatggaaatggatctgggacccagacctgttaaattccgtttcggcttcaggaacacatgcacacgacgccaaggagaagctgaggccatagcgttgccccccatctcagtgagccctttctctgcccccactgaagatcctcagtggtttgcccacctcagtcctctcagaacctcctctgagtgggaaggaaaggttcattcctggtgtaagggagaagcagagggagtcctcagcctggtgggagaggagaaaaaaggaagagggataagcgagctgatgtacttaaccatttccctattgttgggcagtaagtttgaaatgttcactactataaaaaatactgcaatgaatgtctgcgtttatattgttttgagaaaattaataagttcctacagcagag

SEQ ID NO: 84865 - DNA, 1023 bp, Homo sapiens
caaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgt

SEQ ID NO: 84866 - DNA, 1038 bp, Homo sapiens
ggagaagaagggaagctagtaagcaacttatagggggcagtgtaagaaatgtcacatgttacatcgctcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaactctggtttttatacttgagactctgtagtcactgtggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccagg

SEQ ID NO: 84867 - DNA, 1029 bp, Homo sapiens
gctaccgccaggtgggctttacggacccctgtgtgtctcatgactagaggcagtgacgcttggataaatacatactggatggatgcaggatgagtccgcattctagaagtgtgcagaggtacagaagtggccctgctccctgtccagcacccagtcatcagctttccctggcttcccgaggcaccctgacgttcacactccaaacacaaagtcttctctcaggaatctcgagtgagctgcagtctgggttctagccctgccctagcagggatctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccgcaggccccgatcctgcctgggacgaggttcaacagaagtaggatggtttcatcatgacctggcaggaaaaccaccagacctggaattttgcttttacaactgtttaacttctgtttcatacaggatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcgtgttagagagccttggaatgtcctgcctttttacgtttaattaaaattaaataaaatatacaaaattcagttcatcagttgttctagtggcattttaagggtttagtaccatatgtggctcatgagtaccatcctggacagcgtcgacctagagcagttccatccccgcgcagagttctgtttgacggcgccactctgcacttccagcagcctggggagcaggggtgc

SEQ ID NO: 84868 - DNA, 1548 bp, Homo sapiens
aaatacattttgtacagatggggtttcgttatgttgcccaggccgtctagcactcctggcctcaagtgatcctcctgccttgacctcccaaagtgccgagattacaggcatgagccaccacgcctggctctcattgtggttttgatttgtatttccctaatgactaatgatgtcgggcaccttttcacatgcttcaggatgaactttcttaaatatatatctgattctgttattcctctgcttgaacgttttccaaagcttcactattgccccgagaataaattccacactcctgatcgcatgagcccagtaattcaaggctgtggtgagctatgatcaagccactgcactccagcctgggcagcagagcaagacctgtctcaaaaaatacatacatacataaattccaccctttttgatagcatgttatgaggctcaccaaggtctatcctctggcagtatccctggcctgttctccccatctcccctgccctctgctcaccagttccctaaatgtatcttgatctcactagccctacagactgtgcacagagctgtttctacctccagtgacatgcttccgcccaggcttctccccctcccgcctcaatcttcccctcaccaacttaaggtcttaggggcccttctaggaggcagtccccaacttccagagccagggtataggctacttctatgtgtcccatggtactgccacagaagagtctcagctctctccaggattcagttctaaggtcagtgcctaagataaaaatggagtgtaattaaaattcctcttagaaatctaaggaaggtgccctattgaagaccaacatcttgaggtcccatgtagtcatttcttgcccatgtgggaacacattactgtttggttgagtaccaggtgaagtgattggcctgcagttagggctgtgttgtgcaaaaatcacttgttttggggtgttagaaccacatttaggcgagaagatcacttttggggagcttgggaactgaggcaggccgcaggtgcagcagaggcatgagcttgcccgggcccgccctcttgtctatgctcatggagtgaaggaggggccagcggaatggcccaaacaactgatttgtttttctttttttaaatctttttcagacaaataccattgtgtttaagcgaaatgtgtgtataatgccaaatcactgtaccccacaaccctgcacacctctacactggactgtaatttcttgttcctagtttgtcttgctagactgtaagctccgtgagagcagggaccgtgtctgcttgttgagtgggctttcccctgtgcctgccagcatgcctggcatctagcaggtcttctgtaaagatgggatgagtttgtaaaccctccagcctcaggagtggctccatcctctgaggctctggggccctctggcaggctagtcatttttctgccatgtacgtacaatgctttattttcatgttgtattttcctttctagccagtaagcaagctcctaatgagcaagtttctttgtggtgttatctctgtatcctttc

SEQ ID NO: 84869 - DNA, 3137 bp, Homo sapiens
agatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggttggtaacacttaaaacggatgggaatggggattcagtgagagcagaggacagtgggtgtattggagaaatactttcttagcagaaggcaagaaacagcccacgccaaatataagtgattattccttttccattatagttatcgtcagcatcagcatcagcatcatcccaacagttaggaacgcttagaaaatagaaaaaaatagcacactcctggctctttctgtttggcacaaatctttttagtttcatgtgagctattctggtctttgcccacatacaaatcctagttttttcatacagcattttatcgtagttgtttgccacattttataatctttataaataaaacttttaggccaggcatagcggctcaacacctgtaatcccagcaatttgggaggccgagacggggggatcacttgaggtcaggagttcgagaccagcctaaccaacatggtgaaaccctgtctctactaaaaacacaaaaatgagccgggcgtggtggtgggcgcctgcaccactgcacttcagcctgggcaacagcaagaccttgtctcaaaaacaaaaacaaaaacaactttgaattgccttataatgtggccgtctacaaaattctaaacacgtatttctctattgttaaattttcataaaatatatttcaaaaattaatggaagggatctgggagtggcctacttctggcagaatggattggcacacagggtggtgtctcagcagggaagggcaggagtaggaggaaacggcctctcaggtgattctgatgtgtctggtgacagggagggacctgacctgtccccccacggtgagaatcccgtgctgggtccagacccttccgtttgcgggcaggggctgcggcccgggaaatgagattttgcctgcccaaggctgcactgtggtggcaggctccacagactgctggcgtttcctgcacagcaggtgttggcagtgctgctgccccctcagtgctaccctggttcttagcgctgactgcgaaagtgaaatgccatctcatccaaacaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaactgtattgtcccatattttgttgattaaccttgctttttctccctccctttagagagattagaggatataaccatgatatatttcagcttcttattaggattctaggaaagagatggttctggtttctctgccagttgagacttaagacatctgagatttctcagcttttcttt

SEQ ID NO: 84870 - DNA, 1060 bp, Homo sapiens
acttgaaaccaggagtttgagaccagcctgggcaacatagtgagaccttgtcgttacaaaaaattaaaaaattagccagaccaggcatgatggcacatacctgtggtcccagctacttgggaggctgagattgcctgagcctggaaggtcaaggctgcagtgagccaagattgtgccactgtattccaacctgggcgacagagcaagactttgtctcaaaataataataataatacacatactttactgttacacagttacacttttccaatttgagttactttaaaatattttcatcatatactttttatatccatattaaggaaattaaaaagcaaattgcccctatttctagtaccctgtatgatgactgagttcatcttacatttttcccatttgttttcataataaatagtataactcttgggaacatgtactttatattctacttctttcgtttattgtatttttccattttcattattcatggtgcttatgttctataaagtcactgtgaacactgaagtagcaaatactgaatcgtacatagcctctggccacatcatttttgtcagttgatcaatatgtaaccttgttttacatatgtttctctcttttttttttttttgagacagagtcttgctctgttgcccaggctggagtgcagtggcgcgatctcggctcactgcaacctccgcctcccgggttcacgccattctcctacctcagcctcccgagtagctgggactacaagcgcacaccaccatgcccggctaatttttgttgtattttttagtagagacagggtattagcatgttagccaggatggtctcgatttcctgacctcgtgatctgcccacctcggcctcccaaagtgctgggattacaggcgtgagccaccgcgctgggcccatatgtttctctttaagacaccttatttaagacacattgttgattcgttaacattgagttcacagccagtagccctataactcatgcctgaatgccttacctgatatggtatttttccacaaggcacatcacagcccccttgcatct

SEQ ID NO: 84871 - DNA, 1039 bp, Homo sapiens
aagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggtgagtccaaaaccttcaaatgcaatagtatttgagtttttcttaatccttcagttggtattccgtggtgaaatgtctaaaccctgtgtaaactggaaggaaaacaagagggaagaattcaagattcttagatgtggtaaatgatggggaatgctgaattgtagttacatttaaaatatctgtgttagtacctaacattgtgtcaacgtgtagttgaaatgaattagcgagcccagacatggtggctcacgcctgtaatcccagcactttgggaggccgaggccagcagatcacctgaggtcaggagttcgagaccagcctggccaacatggtgaaaccccgtctctactaaaaatacaaaaattagccatgcatggtggtgggcgcctgtaatcccacctactcgggaggctgaggcaggagaattgcttgaacccaagaggcaaaggttgcagtgagctgagatggtgccattgcacttcagcctgggagagagattgagactccatcacaaaaaaaaaagaaaagagaaagaaatagtggatttcaaggtccttcctatcagtttttgattgtgtgcttattttggcattcttgcaggaag

SEQ ID NO: 84872 - DNA, 1037 bp, Homo sapiens
ttaagttagtgtggatatagcgattcaccttgaaatcttagaatagtgcttatgcttctacaaaaaaagaaaatagttttattgagaaatactttgaagtgttatctaattagtaaaatgaagaaacagcaagtaatggcatacttcctaatggattatgtactgttgttaaaaatattaacatgcattcatttaaaaaatatttactgagtacctattatataccatattctaagtgctagggatatagcttcaagcaaaacaaagtcctggccctctcggagcctgcattctagtggggagtgcagaggatacactgatgcacagatatctcatactgtgtcaggtggcaatgagtgttgtgaaaagagtaggggatagagaatgatggagactgttcttttagacaaggtgggcaggggaaatctctgagttagaaattctacagcggaactagtgctataatgcttgtaagtattaaaggtagaatgcttttcttaatggtagctttactactgaagaaatatcaaaaggactttaatttttatattaaaaatactcttctttcttaagttggatacgttgtctcaggtagaagaggagtctttgttaagaaacgatcttcgtccagctaacaaacttgctaaaggaaataggttattcatgagatttgctacaaaaggtaaatgtaatatttggtattgttttatattttcaatcaaaatgatttattatggagtgacatccttcttttttgaatagaagttagatcaagtaatctcaaagttcccttcaaactataatattctgcgcttatgaaataattgcttgccacctgagttggaatttctgactttaaaagtgaatattaactatttgtatatttctgtgacttctggctaaagttattttctgttgaaactggtttgcctcatatattttcagccagttaccatctgaattatgaaaactttcaaatgaaactttatttattacagcaacgtcctcctgaacattgccagtgtaccattcggttc

SEQ ID NO: 84873 - DNA, 1021 bp, Homo sapiens
atttatttttaacttttcatttcttttgagacaaagtctcaccctgttacccaggctggagtgcagtggtgtgaccttggcatactgcagcctcaatatcctaggctcaatccattctcccacctcggcctcccaagtagctgggactaccggctcatgccaccatgacttttgtatttttttgtagagacagggtgtcactatgttgcccaggatgatctcactccaagcgagtctcctgccttggcctcccaaagtactggggttataggtgtgagtcaccatgcctggtctatatttctcttcattagttggtttgtatatttactgatgataatctgttgctagatgaggctgtagtgatgaatgcgatgcagaatctgctctcaagaagcttaccatttccatgctgtgtaatgtcttattttacattttattttaggtaatgtagtttggctggatgaaatgacagccacacgagcacttatcaatatgagctccctgcctgcacaggataagatcagaagcagggatgccagtgaggacaagtcagctgagaaaaggaaaaaaggtaacaacacaaaggagggaactggggtctgaaagtcctcttctttacacagtcctgtttctgagcagagctctatatagcatctcatcaccaagtgtttctgaactaatctatgatgcttgagatcatcaggaaataggagaaaatactggacttttaaaattatatgagatagttcatcttgtatctcattatatgaaatattttatcttgtttcatcttgtccttcacattccattttagacaagcaggaagacagttcagatgatgatgaagctgaagaaggagaggttgaagatgagaactcaagtgatgtagaggttagtaataggggaaagatagatgtaaagttattgtaaaaaattgctcactgtctttttaacttaagccttaaagacttagttacgttttttctctagctttcaccattagaccttctgagggtgcacc

SEQ ID NO: 84874 - DNA, 1101 bp, Homo sapiens
ctttgcccatttttattttgggttgtctttttcttcttaattgacttgtagcatctctttagtttcatgctttgacatagtcacgggcagcatctcttctctttcagaattgtctccactactgcgcgtttctctttaacatacatttaaaaattttagaagcagctggctaacttcaacaaatactcctgttgagcttgatagtgctctgattgctacagattaatgtggggagaggtatcgtgtattttatcaacaccctttgtttaatctttctgagcctgataggcctgttctgaattaatgctgtcgttgagtgataaaaattaagatagtttaccttactgttatgtctcgtgctcttttgaaataattatagtttctctcagcatgtttctttctaaactcgtgttgtctgaactattaggaaggagtgtggatgggatgtgcagttgcggacaggaaaattctatcatcttttctgtgtcttgtctttctagcaatccccaaggtgagactggagacaatctatatttgcggagtagatgagatgagcacccaagatgtcttttcctattttaaagaatatcctccagctcacatcgaatggttggatgatacctcctgtaagtacacccgagtttcctgtgaatatgcttttgttgatgatttttcaagagttcttgccatcagagatggtgaatggttctggcccatactacttgtttatgccgaacttctgctgttagtccaggagagaaaaaattgtcgagcagtgaaacgcagcatgcccttgccagtctgccagctcataccccatagtgtcccacgtcagctgagaggtggtggccagggctctaggaggtgggttactggcctctgaatctgccgtagttgattgaggcctctttaacactcaccttttcccaacaaaggagaggatccaactgcgtagacttggggctgcattttcagagccttggactttgtcattactgccttctgtactgttactcagagggctgactctgcctgtgtctctgacctagagatagaccagaatagacactggacagagtgtcattctgaatagacagaatg

SEQ ID NO: 84875 - DNA, 1843 bp, Homo sapiens
ataacgtgtgttaagtgcttactatgtgccagtcgctctgctgtgtcattaactgatcctttcaacagccctgtgaggagaaggtgttgattatttccgtttcactggggagaaaatgaaggtgctgaggggttgggaaacttgctcatagtcccacagctatgtaagtagcaaggctgaggttcaaagactgatctgactgaaacgtgtgttcctaactgctctgccagcattcagacagtttgggctgtggcacactggactgtcctgcatcaagagtgactcgctacatttgaacgattcagtgtcaaaaaggttcagtctctttatgcccaagattcaaactctcatggttggaagagacctcagaggtcatctaggttaaccttgtgcccaaccctgcaggccttttggcaaacttcctactggtcttttggcggctgcctgaatgtttcttaagtgacagtgtgagaactatttatgagacaggcaactttatttttgggtacttacttgtgttgagcattgccttctagtaatttctgtccgtcagttactgtgtgactgtgaagtcctttcatacagtagcccttcgggtgctggaagcacaggcttgctgcccattcgctcaactttgcttcatgtgtcgcaactttctggtctcccttctctaaacgctttgccgtttctgaatgttctttctgaggtgagatatgggttccagttatggttggattcacagagagaacggcaggactgttcctcaccgttgtctctgtctcagccatttcagtgttgcactcatcctatatgcagccaaagcacttaggtcttttccccaggaattgtgcccatcagaacagtctttctcatcatgtacttgaggcacttttttaaaaaaattacttttaaatgtagtcctattaaattacatcttgttgatttcaaacctctgctttcagtctgctgagtgcattttcatcgtaactctacctttcagctcctagctctactcctcagcttcttgctctccattgtgtacacgtggcttctgtttcttcatccagtggttggtgaagggtgggcagtgtcttccagtatcataagtcttattctattaccataaggcccacagttccttttactgtcatgaggaactggattacgtggcttaatgaacttgaaatagagcaccgtctatgtattctctgaatttcttgatctggtaatcctatcaaaaaagaaatgaggttagtgtggctttcttcttttttttttttgtttcatccacagtcttggagcttgcttcttatggaactgttgtcatttcctgtgggaaagatttggttatttatttatttattttttagagatggggtctcactgtgttgcccagggtggtcttgaacttctggattcaagtgatcctcccgccttagcttcccaaagtactgggattacaggcatgagccacaacgcctggctaattttgtatttttagtagagatgaggtttctccatgttggtcaggctggtcttgaactcccaacctcaggtgatctgcccgcctcggccttccaaagtgttgggattacaggcgtgagccaccgcgcctagcctgctgtcagcatttttgatgagcctgttcactctggactctaatcttttcttcattagctcttttacaaacagttcatgctcaccaaagaaaatttgtaacatagaacaggaagaaaagttgcccacggtctaccatccaaaccccgtcattgtcaacagtctgtgtgtttccttctaatctcttatggcagtgaacttttgtttttctcctttgcagtcacac

SEQ ID NO: 84876 - DNA, 1027 bp, Homo sapiens
tctccagcaaacctttttgcttttttgtgcctccatttctgcacctggaaaattgggatgttgaaattgtttagttgtaatttgttggcataattgataataacaaatgaagtgtcatataactttataaactttaaaggactattcattcagtcagcagatactcactgagttcctactatgtcccaggcacagtgataggctgtgttatgtcggagatggttgcaaattacagcgatattaacatatccccccagtcattgagtgtgaatatccaggtctctgccagactgattcaaggtgtagtgttgcttatttcttcttttttagttcaggtttgtcactgatgcatcatgatgcatgtgtgatttaactcgccttctccatattttactactttcactttttctgtactttctaggaagcaattgaaaagaaagagcagcgagccaagcgcttccattttcgatcggaagtaaatcttgcccaaagaaatgtagccttggaccgagacatgatgaagaaaggtacagggtgttttgtgggaaatttgtccacatttccccagagagtgccttttccctgccatcacctcatgcttctggccttgccttgcgtgtccactccttatccaagcactcttgtgagaagggacctgtgaagtctccatttctgaggtcacctgtttaaagttcagatgctgtcagctggctcagatgttagagctgggaaataagagattgtcttttctgaggaggcccagaaaaagttaccagttagtggcagagctgagattcgaacctgtgcttctaaggacccttactcattttctccttttatcgtagaggtgttaacttttctttgcctttaaacgtagtgaaagtgtatcacagtgagaccttcttttcggggagttagagcaattttgagattggtggggaaaagccattaacacttttgttgataatctgaatctattggccaggtgtggtggctcatgcctgtaatcccagcactttgggaggcc

SEQ ID NO: 84877 - DNA, 1056 bp, Homo sapiens
tagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaagcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaa

SEQ ID NO: 84878 - DNA, 1034 bp, Homo sapiens
gcggcagaaccgatgtgaattcattcaggtcatagggacagacttgagtttgggtgttggcaatcccggtagagggaacagccagggcaaaggcatggaggtgggacccacagcgctgtggctaccttacctggtagccagcctgacacccaggagtgaagccttctctgccttcttttctcaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggttggtggggcagaacgaggggttgttcatgagcccctcagtagtctgcaatgaagactctttcctgcccctgtctgtgccacacggctatctagctttggtttgcataccctcagagctggggagatcactacctaacaatatagcttcttcccaaccaggggagctccagctgagccaaaggctgccttccctaagtcctgctattcccactcccagcccaggcctaggaaataggtctctccctggtcccctatgtagtcttcttagagatgtgaagatagatgctatgtcccccttcccccctaactcttctccagcttgcacccctcgcctctaattctgcctcttagagtctgctgtgactcagaagcggccggcctgcctccagcctctgggcttctgctggagttcttgccatttaggtctgaaagtgaactcaggttc

SEQ ID NO: 84879 - DNA, 1038 bp, Homo sapiens
cccccactctcccccaaaaagagagggtgagactaacaccaggaggtgggcgagcggcattgaacagatctggggagctggccccagaaagcacctccacctccacctccttgagatgttgacggtggtccctgtgaagtttggcttggaaaggtggtgcctggctgctggaggacagacacaggctgggtacctgcggctccatctgaggggtggggtggaggcaccccgaggaatgtgctcactggaagcccagacagccctgcccagcgctactgcagtccctggggcctcctaaagccagacggggcgggggtgagagagggaccctttgcgctcccaagccagctgggtggccttttagggaagtttttctgaagcctgatgcttgtggcttccccgtgatttatgtcatttacgagggatgtgtcctggggagaattctggatcctgggtcagccctgggggctgggggcggtcctctcaccccacctcctggctctgcccaggtgtggctgagcagttgtcaggggaggcgtgggggctgggctgtggtggttgtattggggacagatctgggaggttacaggcgggcttagactttactctgaggacagtgaggaaccatgaaatggggtgttgggactggatttcggcttttgcttgatgctaggggcagaagtatgatgggacggtaagactggggctgggggcagggcggcaggccttgaggccttgaggcctggttggggaaggcagtgggagagatgagctctcgcaatttgggtgaaatcaggcctgggtgtgtgtgatgggcaagagaagcaaggatgagcctggtgtctgaaccttacgataatgggtggtgattccccaaaatgaaaaccaggagagtatgtactggagggtttgggggtgctgatggaacagtggagtgaaggaggcgtgggggacgttgcggggatggatcctggatgcagcttggggggtccggtggggctggggtagactgaggtctggactaagggaggccttggg

SEQ ID NO: 84880 - DNA, 1059 bp, Homo sapiens
cagggaggaagccaggggggctcctggttcttgtgctgtctggggctgtcgccggagtggcaaatacagagagtgggagaggtggcctgaggggtccccggggaacaaggttcagcaggcagctggacatctgggcttggggctcagcaaagggccccagggagagcaggtgggagggtggaagcgggcccagacagcagaaaccggtgaaggaggctgacaggaagtggacagagatgcaggcggagggcagggacggtgtgtggcgatcaatgccagtgtggggggctgaatgtcagtgtcagacaccaccccgaccccagggcggccaggctgggaagggctcacgggccggtgcaaaggaggttacacggaactccagcaaaggcagctgcaggggcaaggagtgagtgaggctggggatgcgggctggaggctgcctgcccctcactccctatcccctgggtccttgccaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtgagcagggctgggggctcaggcctccggctgcatggctggggcttctgggacatctggagaaggcagacaggacactgaagtttttgttttgtttcgttttgtttttttttttttttgagacggagtctcattctgtcgcccaggctttagtacaatggtgcaatcctggctcactgcaacctctgcctcccgggttcaagtgattctcgtgcctcgacctcccggcgcgtgccaccacacccggctaatttttgcattttttagtagagacagggtttcaccatgttgtccgggctagtctgaaactcctgacctcaggtaatctgcctgccttggcctcccagagtgctgggattacaggcgtgagccaccgctcctggctgacggtgaagtaagacttggagaaaagaggggagaaggctgcgtgtgggcaaaggtttggagttgg

SEQ ID NO: 84881 - DNA, 1054 bp, Homo sapiens
aaaaccacctcttatataaatattatctttctggagcagaaatcctttttcaaaaaaattagttgctatatttagttgagctgtgggaggaactggggagataaatattatttaatatcccccattagtgacttggcagggaggttgtgctttgctgcaggagagctgggcagcatgggctgcctctgaccctggggtgggctgggggcgagggccggcgcaggcaggtctgcggtcccactgcctcttttgtgctgctatagcctccagcttgggaatcctgattcctgagggaaactggagacgcagcccttggcctgtccctggaatcacacaaatactgcttctgtacgaccctagccaggtctgtcttcattctgatatcatgtcttcattggtccagcggaggaggaactgactgggagggagggagccccagccttccccacctgttatttggttagatgagatccttggggtgccctggccagcgcacacctgtgtgaactgatggggaaggctgtgggcttggcgtggtgtgtaggtccacagagggtggatgtgtgttggggtgtgatgggaaaagttggggagggatattgctgggctcccctggatcctctgggcattgatagtattaataataaaagctgatgttcactgagcacttactatgtgccaggttctagtctcagcatttttcatctattatctcatttcttccccaaaacaactccataagggaaggactgttgtcatccccattttatacagcaggaaacggaggcacccagaggttaaaccacttgcccgaggtcacatagtaggtggtggagctggcactggttacctgctcctctctgggcctcagtttccccatctgtacaagacagtcacaagttctgcaggatgcagaaccctggtgtgggcgtctgtgctaggagtttgggtcagccggcagcagctttttcagctttgcctccagccttcttgggtccctagagggctcttctctcagatcactgattggggctgggggcattccagggctcta

SEQ ID NO: 84882 - DNA, 1177 bp, Homo sapiens
tctccctgacacgtctccctgccaaccccctcttcctccctctgccacctccaccctcttgctgcccagaccctgaaggcctgacgggcctggcctcgcctccagggcatctcagtgccctcctggccctgttttctctactccctctggtccccagcactggctgttcgtttcctgtgagtgccttgcccttccccacctgcatctttgcactgttttccccagagagttttcccagacctctgcagacagccttctgagcctccgccctgggactgcccctctgggcagtgatgattcctacctacatttggagctttcatgtgctcttaatagcattttttttctctctccactctgcaggcctgtgggggaggggaacacatctggttcccctcctccgtccccacatcctcagtgctcagctgagggtcttatcagcactcactgaatgagggagtggctcccgacattggcgacaactctttttccctctacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaag

SEQ ID NO: 84883 - DNA, 1028 bp, Homo sapiens
gattgcttattttgtcaggcctagagccaatgggggagaaactgcccgggatcagcccttgacaacagtgagttttggaaaataaaacgatgggttatttctgcttccttctctttttttcctcccctcagcacaatagactgattgaatgtgggagctgaaagggcctttcagagttctttagcttccctctcctttcacacatgaggaaactggcttgaggaggggtcccggcctggtcacccaagggcaggtggaggcaaaggtgaccccggcaccgggcacctggctcccgccagggttctgagcaaggcagtgccacgcggtgctgggcggcgtgagtagcgtccgcccatgagaggcttctgctttcgcaagcaggtgtcccaggtggtctgggagagctgcactgcgcatctggcgctgtcactcacagcccctgctctctctctgcaggagcttggcgtgctgcaggattacctgctggccctaaccacggacgaccaccttctccgctgtgcggcacaggtactctctccaccccaacagagctggcccccaggctggggcgccaccatctcaccattgccagggcagagaaggtctgtacattgcgtctgagtaggacagaatccacccggagcttacacagagcttgttccagttcagtcacttcctcctggtgctcagagagcatgcacgagccccatttatcagagtcattcactctaaactgtggggtcagaagaatttgtgtctttaaaaccaaaacaaccgatgccttaaatttagtttggctgattcttgaagtttccgtggagttagatttcacatatttttagatgtgagttgcttctctggtagcggaactcctcttctgacagctgtttggtctcaggacgcttcacacttttcactgactgaggagctcagaaagcttttggatatgtctattatgcatatatccatatgtgccattagaaacgagattttcaatttaaaaattaagcaaaagtgtaaacctttat

SEQ ID NO: 84884 - DNA, 1548 bp, Homo sapiens
aggtgtgaatgcagcaaaggtagggtcactgtatcctctcccaaggattgggctagtgaggaactcaggggccctgagcgcgatttccagctgaaccagaaagctttgtcgccatcttcccagtttccaagtgcagaaatcttgaggcacattcggtagctcctttttgatcctgtccctcacccaccttcacacacacacacgcagtccatgaggaagttcatttggcctctcagccttgctttgtccatctgagaacaccaccagacctcgaggtcttttcccggccttgcagccctgcaggtgctggcaggcttgctctagcatatctatctttcggaagggacagagggagccaccctgcctctactaggcccttgcataggcgtgtcctcccacagttcttgccacctagagctcccaaccctgcacctcactccaggcatcgattacattgtgtggtcattatttatccataggccaatccacctgcttggctggggactccttcaaggaccaggaccctttatgattggttcagttagttctttcagaccacctctaagtagcatcattctgaaaggactgcagtgtcctgattgacaccaagagcctggtcaagtgagaggtggctggtggagttggttttgggtggtggagtcacagaggctcgtcctaggtctaagatgatgccagcacctttgggtggagcttgggttgaagtaaactgtcccttcttcctgatgccacttgcaggccctgaccttatctgtctgcttcccaccagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggtaagcctggggccggcaggccccataagagcgactgagccgcagagacctcgtcagcccctccgtgctcagcccctccatgctcagcccctctgtggctctctcccgctggacagcagagacctgtccaggaaagtgcttccttgaacaaactgcagtctgcctccctgaggccagggattctgtacaagcaagtcttctcttctccggacttttcttgttttaatagaagaaaatgggccacctagccctggaggagagctttactttccctgcggcaggctcctcagagtgagtccttggcttcacagtgagacagtgagtctgaatgtggtccaggttggaccctcactcttcagctgccacctcatgacctgcccccaccgtggatactacagcccctttttaaaatttcccagaactgaatcagagtctcatcttttccatccttaactttgtgcctgggcagggaggtaggcattttgatgaggcaggaatggggcagcctccgttattctcattgacttaaggccatgtagtccctttagcacttttttttgagacggagtctcactctgtcgcccaggctgcagtgcagtggtgtgatctcggctcac

SEQ ID NO: 84885 - DNA, 1064 bp, Homo sapiens
agtaagaatgcaaattgtcccactcagttgcttgatggataggtagccattactatttttgtgtttacctgcaagctggctttattggctaagactgagcccgagagatttatgtttctgcagtccctactttagtaaggcatgttactatagaagaaatagctgctggaagcatgaactgtacttttgtgcctttctttttctgcctgatgtcacccttcagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggtaatggggagcttctccagttggcagtggatctggctataatttgacatctgcatggggattaactaggaggaaatgccatctgatttcgatggatggtaaaccataggatcttgattatttttagaaacgcgtgggccttacacacagataacttcaaagaggaaatacaattttcctgatggcttctctgtctttccattgtttcaaggaatctgatactactacttcatgggaacacaactttgtcagacgagaagaaaaattgaaaagtttcttactttcctctctaaatgacaattcctgtgcttcatcatagaagatgaagggaagaatagagggagctagcctcctaggggatgagcaacaggtttgacagttggagtggaaggaggtagacaagttgaaaagctgggcgatggccaggcacagtggctcacagcagtaatcctggcactttgggaggccaaggcaggtggattgcctgagctcaggagttcaagaccagcctgggcaacatggcaaaactccatctctactaaaaatacagaaaattagccaggtgtggtggtacgtgcctgtaatcccagctactcgggaggctgaggcatgagaatcacttgaacccgggaggcagaggt

SEQ ID NO: 84886 - DNA, 1046 bp, Homo sapiens
tggtggcatatgccttttgtctcagctacttgggaggctgaggcaggaggatcacttgagcccaggagttagaggctgcatgcagtgagctgtgatcatactgctgcactccagtctgggtaacagagagagactcttgtctcttaaaacaaaaggaaaaagatgtgttcagtataattgtttatttaattcttccagggaacaagaattacagaataaaactttctactgtattttatttcttgatcatttcttgagtttttccagttttagaagtaaaatatagaaaaattacatagtggaaaaaaacaaaggaaaatagaatcatccttaatcctaacactcagaagtaactgatttttttaatatttctccaagaaagaaagaaatagctattagcatttttatttccacctattcttttctctttgcctattctaaacacatctatgctggatatttattatttgctacagaattaagtttacaaattgtgaatgtttttccataattaaatgttcctgaatggcctcgtgttatatgccagaaatggttcatatcctattttcagcttactataaacagattagtcatttccaaggtaccttgtaactgaagttgttccacagagcagcagtatttcaggacttggtggtttagcttaatctgtggtatgtgtttacaaagtatcacaattacattctggtatgtgggtaaactttctctaagttttaatagtatccatggttttttttaaccttttctttctcatttcaaagattctcaatatattaaggcaaaaatagaactgtcatatgtcttcttctctttctagagttaggaagtaacatggtagtacctcaggcaaaaatggcattagtcctaagctccccactgtggaaacctgtcttcaggcatcaggtttgtccagagttggaattagaagcaagctggcccactcacccacaccggaatagtaaggaggtatttactcttccgttttctttctatttagactggaaactgcctgcaagtatttattactt

SEQ ID NO: 84887 - DNA, 1771 bp, Homo sapiens
tgatctgtgtgaagatgggaatgtcaggtttgtcttcgagcctgcctgctggtttgtgcagggctgtcaaggccatctgcctggagcactgatagagaaacagtctgctgcatgtggctaggtgtctagtgatagaacctttctttcccctggctcatttgttatcatagctggatgttgagacctggcaacaggaacagcctgtggtgttacatacgtggacgaaggaatctgcccacaactatgaaaataattgccatgaggtatccgtctttgttagcccaggggcaacctattttgaagtggaattcgatgacaggtgtgaaactgaaaaaaggtaagacttctatattctttcacccccaagcgctaataggtcagcaatgagagaaggaagctaatagaggttatgccttcacaggtatgattatctggaatttaccgacgctagaggtcggaaaacacgctatgacacaaaagttggcactgataaatggcccaaggtgagtgatagtcccagaaagaggtacctacttctgcaccaatgcttttccttttgtcagccttcagggggcagtagaggtaaggtctttgaagggaggcatttatgttacacgtttgtgaaaggaaggatttatatcagagtttgaccagctatagtctgtcacctgttttgtaaacaaatttttttggaacacagccatgcctgtttatcatttatagctgctttggcactgcagtggcagagttgagtagttgcagcagacagcgttgtctagagtaaatgaagagccttcatccttagcaagaagtgctggtgggtctaggaggatggcccagaccatgtgatggaagccaagagtctgcctcacagttagagctgcttgagctcttgggctggaggtttagtactgcctcagactgttgaccttctctccatggtcagtggtcttggcaggagcagaggcatggaaatgtgaccactggctgagtcggtagtggacagatggtcaccccaggtgtagaaagctgagcagcagtattctgccaactctccttcttcatggggtgtggctgtgaatggtctgtttccgtcacccctttgtacatttctccgttagtcattttggacatgtggaaatagagatcaattttaaactgagatgtttctcgtcatgaagagcatgctgatttctgaagcactcctcctctaatctgtctgaccacatgatttctgtttgtctctagaaagtgaccttcaaggccggtcctcggttgcagttcctctttcactctgacagcagtcacaacgaatggggctacaaattcactgtcactgcctgtgggctgcccgatgttgccgtgtcttgggggctggatttacagctcctcgtctcccggctgatgggacgcctggcttcccagtgcatggcgctcaagtctgtgcgccgtaagtgcacatccctgtgctttcccttcttacaaccacggtgaagtgcaagatgcgcgcttgccctcttgtaggtcgtttccacgtaatggcagggggttaataatacgccttttcagtttcctttaaaccgaaagaataaagtgtccactcaataccattgtcacgaagctttttgccttagactttggaacatagcaggaaggctgccatgggttctctgtctatggaggataacagcttttttttttggcaacattgtcatttttttgcaagtaggtgtaggtatagtccaaccaaaaggcaggagtatagaataag

SEQ ID NO: 84888 - DNA, 1084 bp, Homo sapiens
gaggtcttcgagatttttgcctgtttcaactaccagagaagctaaatgggcctacaggcttcattactagaagtattgactcttgaaggaggaagggaactaatatccttagcgactgcctgcaagtcagactatacctggtatggatgccagacttagagggctgtctgtttaaaatgtgctcagaatcaagtagcaaggatgctgaaagggcctggggccgtcctgtgaagacatgtgaagacacaaggaacgtttagccaggactttgaagctagcagtcgtgagatgaggtgtatttcatattggtggccaaggtgatttattcatcagccttctacctcagggtctcatccaggactggaggatttgtgagtctgtgctaatggaagcacatgtggacagacagcggcacagccccagctgggtccacagcctgtattcctgacccaaactcctcccatcccatggaaatgacactgaaacctttctgcgctctgttttggaatcttttaaaatagtataaaaatctttctcctgaagccaggtgtcatgactaatttgtatcctttcagtgacaaggatccaggcggccttcttcttttacctgagaagaacgacctggccaagatgaacatcagtgaagtcctggcggtcatggacactctcgtctctgttgctgctcgagaggtatccagtggctgcctccctgttttctttgtctcatgcttgtgggggcacgtgatgtggcagtctcttgtgcccccctttgcctctttgcagtatgaatgtactttgttgtggttttttctgttgttgttgttgttttgagatagggtcttgctctgtcacccgggctggggtgcagtggcacaatcacagctcactgcagcttccccatcccaggcccaagcagtcctcccacctcagtctcccaagtagctgggacacaggcacacgccaccacgcccagctaatttttaaattatttgtagagatggagtctctcttatgttgcccaggctggtcttgaactcctggaatcaagaaatcctcccactttggcctcccaaagtgttgggat

SEQ ID NO: 84889 - DNA, 1033 bp, Homo sapiens
tccttaaagcatcatgtgaggggaaatggcaggggaatgtgttgaggcatttccagaaaagcagggggctcaaatgcatgttgtagaagcactggtcaggatcatgttgtgtgtagtatggactggaggagagcaagtctggaggcagctgggctgggaggaggttgtcacttattgcctaggaagccagtgggtgactcctactagagcagcagcagcagtgcagagatgtggaccaagagaccactaggagggagaagcgacaggacctggtgattgactgaatgtggagcaggagagggaaaaaagcctcatcggcagtgaatcctggcttttggcttgagcaggtggggaaattggtagtgcctttcttactctggggaaaaacaggtttgtggggaagatgatgagctcagattttgttctgttgaatttgaagttctgagaaacctttgaggtgttcggtagccaatggataatcggtagccaatggataaacaggtcaggagccaggaagagaagtttgtgctgaaggtacagatatgagaggcatttaaacgataatttaaaatgtagaaataggccaagtgtggtggctcatgcatgtaatcccagcattttggtaggccaagataggtggattttgagcccaggggattgagaccagcctgagcaacatagtgagacccccatctctaaaaaaaaaagaaaaacataaaaattagctggccatggtatcacgcgcctgtagtcccagctacttggaagactgaggcgggaggatcccttgagccccggaggttgaggctgcagtgaactgtcttcacgccactgcactcctgcctgggtgacagagtgagatcctgcctcaaaaataaataaataaaatgtagaagtggaagagatcattctgcaagagtgtgtgaactgggaagagaagagaacttaggtcaacatgagacacaccaggctttaaggggcaacaaggaaaactcagccagacaagcagcaggaaagccagggcctcatgaag

SEQ ID NO: 84890 - DNA, 1542 bp, Homo sapiens
gaggtcaaaccagtccctgagccatctagacagtttttaacgtttcagtataatgtgtttaaattaaaagcaaagaagtgtaattcagtgtgatacatttttagtgcttcaagcataaaccctcaactctctggtcaagccagctcattacccaaggcttcttaatagcagaggcttattacagtagcgtattggtattatttaatatttaaagattaaagattatagaagtgaggctttcattccctggctctctggattgatttaatttttccttaggttaccttaaggattttgaaaaatatttcggataaacctgtagaaagcatatggcaggttaatgttacttgtgttgatcacttacatggggtttgagctacctggattttttcatgtttttaagaagtgaaaagtttttgctctttgcttatagctgctgttctaccccagaggtagaactgactcttctggcttttgctctcgcaagaggaagtgttgccaaagtcatgagctctctatgcaccatcactgaccatctggacacgcagtatgatgcctcatccctcatcttgtccatggcgtcagtcagacagaacctgctcctcaaatatggtaaatatggtaaaacatgggggtgatagaaatgtcaacagtggacaaatcgtaaaaccattcttcgccatatgacctcctggtatcttctcatctttttgggttgttatagttacaccatgattcctggatgaacgtatcctctgagtatcagaccttactaggattggcagggagaagggggatttaggttcatttatgtgatggcagtatcaccagaagaggacacttgattgtccacaaggctatactcccatgatctgcttgcaaaattactcaggtctggtggccatttgaacacagccatctttggtgaagtactgaagtgtctcattgtgtaggccaagagggttggagtagttcttacctgttggagggaggaaactagccaagatacggtgcaaagggatctttgtcttagaatgcattcctctgcattcccgtgatagctgctctgaaggatttggacacctgtctgccactgctttccccccttgggcctagcagtaattcatatgagcacttttctaccaaaccaggatggggccttataatccttctcaacatgggagcccataaagtcactcccaaaagactgcagtgcagcacttctacttgtgagtgcagccttcctggactccacaatatgtggtgttgggtctcatcctgttggcagtattccagtgacatttctacccttttatttattttgagagagagtgtcttgctgtgttgcacagattggagtgcagtggcatgatcacggctcactgcagccttgacctcccaggctcaagtgatcctcctgtgtcactctcccgagtacctgggaccacaggtgcatgccagcatacctggttaatttttaaaaattttttgtagagattgggtctcactatgttgcccaagctggtcttgaactcctaggct

SEQ ID NO: 84891 - DNA, 1034 bp, Homo sapiens
ctagaccagcctggccaacatggtgaaactccgtctctaccaaatacaaaaattagccgggcgtggtggcgcatgcctgtaatcccagctacttgggaggctgaggcaggagaatcacttgaacccaggaggcggaggttgcagtgagctgagattgtgccactgcactcctccagcctgggtgaacagagcaagactccatctcaaaaaaaaaaaaaaaaaaagccgtaattttaacccacccctcattcttggacatttagattgtttccaattttataccattataaccttgctttaaacatagcattttggaaataatcacaattctgtgattgctttctgggcttatttcgttcagggagccggaatgcttcatgttttatctcatttcttctaatgctttcctgggccaaaagaagtgttctttgctcaaaggaactgaggcctagggaggtagagtctttgtgtctcacccctagcaaataagtagttaggcctgtgggttagaagcttcctgtcttatattgtgatcttttctctaagttgtgtcctttttaaattcttaccttctctcctctgacccaaataagaaattgtgacatctcttaaaagtgagtcatgtctgtgtcatctgtttggatttgattattaaaaataaattctcacaattgcttgtaagccagccactgttctataacttaatccaaatttcagaatcctaggaagaattctagaaatgttcttaccatgtattcagacaggcttgttttaaaatgttctttgtgtagttttttcaagactcctaagttcctaagaagttttgttgtaaagacttaaatcacccttaattttacatattattcttatgatttcttagatttgtcaaagctttttgacaaatttattatatactagttccattgcacatgctatttatttctgtcatcaaagtgtaccttcagaattttcttttcaaaatgtctattactattttgcttttagttgggagcccagcatttgcctaaagaagt

SEQ ID NO: 84892 - DNA, 1136 bp, Homo sapiens
cccttttatcatattcattaactattgatgaatcaatagaatctattaaaaatagcaaaaatggcctggcacagtggcttatgccgataaatccagcagtctgggaggccaaggcaggaggattgcttgaccccaggagtttgagaccagtctgggtaacatagtgagactttgtttctacaaaaaaataaaaaactagctgagcatgtcccagccactcaggaggctgaggtgggaggaccgcttgaacctaggaggtcaaggctgcagtgagctgtgatcacgctactgcactctagcctgggtggtagatgaagaccctgtctcaaaaagaaaaaaaaaaaagatagcaaaaatgtcagtatttttatagccttggttatatagaatttttattagcaatacacagcaggagttgtgtgggaagttggaggtgcagggagtgcttgatttgtggaagttttggtggaagtgggacttgagtgctaccttgagattcagagggagtgagtctcacttctagagttgataggagttcacctggacaaaaggagcggaaagcagcttttatagatggaggaaagtaatggagctaagaggttttaagcatttggtcttcagatggtaaggaacccgaggggttatctggtcaaaggaaggggaagggagttgtggtgaagaacatgaaccctgaagccttggatgcaaacactagctgtgtgacctcaggcaaggtacctgacctctctgtacaactataagacggggaggttaatagtactgttactgttatgaggaataaatgacattatagtatataaaatgctctgctcggtgcctggcatttaacgagtgcccaaatattgattcatagtttccaagtctgtgtgtcgttcccaactgaatgaatgatagctgtgctaatctcctcagaccttgagtcttacaaatatcattattttctcagtatgctataatgtgaacaatttgggaagtagctattatctggtagtgtagcgttcccaccgcagggcctcagggaagatgaggctctgctctgtgccacctccttcttcccccacctgctccacttttttttttgagatggagtctcgctctgtcgcccaggctggact

SEQ ID NO: 84893 - DNA, 1021 bp, Homo sapiens
gggagagaaaacattgagttatatttggcagtctttgattcacatagctaggtcatacagttctgtgagtgaggcttagccaaggtttaaaaacctgattgtgataatctcacagtggccaccgtctctcatgataatcttgtgatggctgctctgtctgtaagaactagtaagttaggactagccaaagaagataagatttagccatgcatttgattctgtgctttaagaatgtctatccttagacttgaataagtatatacttttgtgcatacttacacagttaattctgcgttgttaatctacgtctaagcttttgagaatatactgctgtattttactgcaagatgaagggcttgtgaagtaatgtctttatagtagcaactaaaatgacaagttgtttccgtcattcgtttttataagagctaacatggtaaaacagatagccacgggtgcgcatggtttattataatgctgagagtttccaagtgttacatgtttcttctttggcttcccaacttacgctgccattggtgtccacgcagctgtcttgctttcacattcctgtgacctcagttatttgaggaggtgttataaagaagttcttggagttggaccatggaccaaagtctgaaacattatcattttatagtacaacacaccttttctcatggtaggtgtggtccagggagaaggtgcgcatggtttattataatgctgagagtttccaagtgttacatgtttcttctttggcttcctaacttagctgccattggtgtccacgcagctgtcttgctttcacattcctgtgacctcagttacttgaggaggtgttataaagaagttcttggagttggaccatggaccaaagtctgaaacattatcattttatagtacaacacaccttttctcatggtaggtgtggtccagggagaagggactctctcagtttgctcacaaggagcaatatttaattaactgccatgtagaggggaaatagaattaaaattaagttcttatt

SEQ ID NO: 84894 - DNA, 1046 bp, Homo sapiens
aagcagttctcctgcctcagcctcctgggtagctgggattacaggcatgcaccaccacgcccagcaaatttttgtatttttagtagagacagggtttcaccatgttggcctggctggtctcgaacccctgacctcaagtgatctgcccgcctcagcctcccaaagtgctgggattacaggtgtgagccgctgcgcctggcgctaagctgttctgagtactgcgcctcactagtagagagagccatcatagacaagtaaacagattgaacaactccacataggaccatgcatcaaactgtgatgtaatacgtttgggagctttggctcctttagagcacatgctcaggagtggcttcttggagaaaatgaccgttaagctgagaccggcaggtgagtgggaggcagccacaccgagacctgaggagagtgtgctgggtcagggaagagcggtgcgaaggtggggagtggggaagcacagccaagacacagaaaggaagccagtgtgctggagccccccgtgaacgaggggggacgtagcttgtaagaggctgaagaagcaaatcagttaaatggttacagggccttagaggccttgataagaaatttgcatttttgtctgctttaagaagccattgaagggttttaatcaggcatcggagagccatggtaggattcatgtttttaaaagatcccctagttgttttatggacagagaactctaggagggcatgagctgaccagagagcagttaggaggccactgccacagtccgtggtttggaggagggtgatggcagtgggaatggaaaggagtgaacagaatcaggatctgttcagaggtaggactgacgaggttttctgatggatccgatcagacagcaaggaagggagtatgatgtggatgtagaggaggaggagtcaggctcctaatgcaggtcacaggctagaggcaacacggatttgggaaagtcagggagggcgttggacttgggagacgagctgaatctcagatgcgctgaacatacgcgccactagaatcgaaggtaa

SEQ ID NO: 84895 - DNA, 1655 bp, Homo sapiens
ctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaatgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatgattcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttg

SEQ ID NO: 84896 - DNA, 1018 bp, Homo sapiens
agcaggttggcctggccagagcatgggttcccacgggctccacggggtggaagaactttctggagcgtgttcctaatactgatttttcttctccatgtgtacacaactcgtaggtttagatttagttacattgggtgaaaagagctttgtcctttgtggagaaaccagtgtttcatgccagaggaaggcaactgagaccacagtagatgattccctctgtgttgaatccctcccccacctgcgcgacctcagctctcttgcagcccaagctctacgtgggaaagactgtgtcttggaaacggcagctgctctagaattctttggctcgtggccacatcctttattggaagatgctacaggttgtccacagttctctccagagcctcggggcccccgtatgtctgtggggactttgtgaacagatttcctgccagcggtctgttctgcccttggctgtcctccgccctccgtctgtggctgccgggctgggccgggtgggaagtagccctgcgcgtgcttttgttttccagtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctgggtgagtggcccgctctctgctctcacagtgcaagcacagtcgtagtgttgggatcgccatgtattgtattggtgatctttcaatctcatgatgccttaggatcggaaccgctcgtttcctggcagtagctgggaccatttctctgaataagggaaggacttttgagcgtgttgggaaggtcactgtgaacagtctcttttcaaagcactctgccttgtgcatttcccacaccccacaaccttctagaaatgccaaagctccaggcaggccacccttcctgtgtgtcctggccacttacctgcacacctgtcctcttgagactgactcagatcctccagaac

SEQ ID NO: 84897 - DNA, 1069 bp, Homo sapiens
tcagcagggcaggccatcagcctctgtgggtgtcagaagacaagcaggctcggcccccataagggggatcttgattgtggcagagagactgactgttcatgtaatgaacttcaacagcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatggtaactcccagtcattctttagtggcttgaacgatccctccattctaggggtgggggtgcagtgcacccttgggtctgctccccactggggaggttggcttttacaggagcaaagctgtgacaggaagtgctctgggtagagcatccaacctgcgactgcccaggccttgggcagcctccccatctgagtgggagccctggaagcccacactgcctccttgggaaactgttaaatctcacctttgggtaactgctgaagcagaaggcacagcacagagcaatcatgagattgcatttgtgatgcatccttgagggcggtgaagaccagaaaggatggctctgtgcgtggccagtcgctgctgtggccgggtcccatttacagagaggtctgtgagggtgaggaggagtggaggtttttctgcatgtgcttctgggcttgcatagtaagaggatttacttcccagctcttcatcttgctgtcatgcacggccggctcaacaacatccgggttctcctgacagagtgcacagtggacgccgaagcctttaatctcaggtgagcgcgttgggcccgagtaggccccgcggcgcctggcctgctgctcagagctgctggttgctggtgcctcccatcagccccagggaggagctgcaaaaccggccgctggggcacctcaccagcttcgggtactttattttggtacttttggtaccggtatttttgttttaataaaaaatgcttcttaaaaggtttggccgggcgcagtggctcgcgcctgtaatcccagcacttcgggagtccgag

SEQ ID NO: 84898 - DNA, 1044 bp, Homo sapiens
cttggctctccagccagcacctagagtactggcgcatttatcagtggcattcatgaaggtgagatggaacttgggacccgcgtgaagtgagatcctcgcatgggtggagatgattgcttggtgtcttaggcttccgtaaccaccgtcttcagcattttcacaagtgtgactggattgcgtaggtggtgacctcacgtttgctcaggtggtgtgaaatggcctctcccgtttcttctctccagtgtgaaactggactgctgatgaaagcgctttgtggatccgctgcttatgagactggcacgtgccgtgtgtgacgtgtgggcctgtgaagcggcgtgccgtgtgtgtggcactggggtcgccctcgctgccgcctccacactcatgctaagacggctctgggaactacaggagacggtgtgctttgatttcattgagctctgttggctttccatcagcggagcaaagcccgggccctgctgttggctccctcccgcattgtgtatagagcgtagctcagtaagaggaaactttctccacgtttctcaaccctttgtttgactgctcgggtcaggccggcagtgcagctggggcatcaggatgctgggtgcttgttttagccaaagcaaagagactcccaaggcttgtctccattttccctctccatgagtttcctgatatcttggtgcttgcgtttccctatccttcagattgtctttttcttggttttccacatccagttcctactacaggaggctgccacagtggctcccttctcctgaccacgtgggtgtggccacgcacacctggttctgtgcacagatgtgtagagtgggtctgtgggtgggttgggggatggcgtttcatgttcattcttgggagggggtttcctaagactgagggaaggtctccatcgtgacctctccagtggtcagttcagcttgcagatgaagctcaggaggtactctgaaaagggaactaatattttgctttgcacttgttgctgtaggtggataacaagggccggaatttccttcatgtggc

SEQ ID NO: 84899 - DNA, 1050 bp, Homo sapiens
tgggatgggcgcgcaccaccacgcccggttaatttttgtgtttttagcagagagggggtttcgtcacgttggccaggctggtcgtggactcctgacctgaggtgatccacctgcctcggcctcccaaagtgctgggattagaggcatgagccaccgcatccggctggttctcaggctttaaatgtatgcatatcccctgggaagtttctaacaattctgatgcccgggttgcccacccccaagaccagtcacagaagaatctatgggagtggaaccccgactctggtatttgaggccagggaccaaggacagcagacccggccacagcagacgctgttggattggatgaggctcctgctttacatttgtaatcagcatgcctatacgccaggtccaagcgtggcgttttttaaaatgtccccattcctttcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggtgtgtcgtttctcttttccggggagagaggtgtagccccagcatgagggaagcctcctcctatggcagaggaccttgcacagtccccagttccaggcgctgctgcttcatgaacacacgacctccctagcagcgttcatgatttcaggctgactgtgcttctctgtgcctttgtccttactacaacaggaggaagatttgtttcagctctttctctttgcctcctattcccccttagttacagatttcctctgagagtttagtcccaaatcgcatactgtatttaggaaaatgtcccagtagctcacttgagcacccctgagttacgccctttgatgcttttcaacattcgagcctgtgcagatttatatataaggccctatagccagataaggagtggtggcttagagcggagactcactgcagatgtgaaacacatgtttgtgctggtcctacggtc

SEQ ID NO: 84900 - DNA, 1077 bp, Homo sapiens
aggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtgagacaggcacaacgttagcctctgtttacagatggggatatgttgtgtcagagatggatctgctgcctgcgtagctgtcacaggagcaagatctgtcaagtaacatagtgggacaaggacaagcagttgaaagcatgttaaagaaacttgcagttcaacatggtcttggctgaccttttgtttttaggtcatctttaccaagaaaactaccaagaagcaagagaatggcggcgtttcctcaggagccttctcctggggttggttgatttgctatggggtgtcctcattatcaccatagtgataatttcctcaatcttaggtttatctcccttgtttgcaagacaggccccaaaagtggaggcaaacctgcacattctcattcagctctccgaagggcctgcagtgtgatatgaaggcgttgtgcacctggaggttttacctagttgttgagattacctgttaattgcaggtgtgtgttactgaggacccgttggtgcatgtgtacacagacactttctgttttctgtcccttctagaactcagctctaaaggacacaaattaaacataacttgtttatacttcccaagtctgtcccacaggacctagtgcacgaacttgcacacagcaaattttaattagtgtttgtaaaataatgagtgatacagattaaagtaattatcaatttattatcaaccgtatcttatctgaaagtggatttaatgctatacatagagctcagacttggtaataaaactgtttgcctttgctcagcagtgtttgtgaataacctatgtttttctgcaggtcagacatggctgtgatgccacatgctggggtccgggacctggtgggtgccttcagacgctcctgcacagagccattgatgaaaacaacgagcccaccgcctgc

SEQ ID NO: 84901 - DNA, 1053 bp, Homo sapiens
ctgtgtccacatacagagagtacctatgtggacttaaatgatacctactgtctggcgtgggcttactgtctggcgtggacctactgtctggcgtggacctactgtctggcgtggacctactgtctggcgtgggcctactgtctggcgtgggcctactgtctggcgtgggcctactgtctggtgtgggcctactctctggcgtgggcctactctctggcgtgggcctactgtctggcgtgggcctactgtctggtgtgggcctactgtctggcgtgggcttgccagtcatagggtggcagggaagagcagggtgttgtgcagcgtgaccgcattttgatgcaaacagaagaatcagcaatgcccattttcttttaggaaactgtttactacagcgggcagctggagcaggaaacgaggcagcagctcttttcctggcaaccaacggtgcccatgtcaaccacagaaacaagtgggtaagtgtgacagggcagccggagaaaatggtgttgatctatggaagaaatggcagtggtggatatgtaggaaaaaggggaataggtggtttttttcagtttttaatcagaataatacatgcatatggttaaaaagccagagtgaaacagattattttgtgtttcttcaaatattggttgattgattcattcagcagccatttcctaagcgtttgtgtaggaaacagtgcttgttcaggttatcagaccccgaactagatgctatggactttaatagaggttagcaaacgcgtgcacaaacctaccgcgatagcatttgattcttgataacacttcacatttgcttgggttttcctctgtggattgtcacgtatgagtctatgtcgcacgctaacaaggtggaatgtgcggtgttatgaataaaagtgttacctttggggttggacgttaccgagtttaccagctttcccatttcctccctatgcagtcttcttctttttttttttttttttcttgagacacagttttgctcttgttgcccagggtggagtgcaatggggcaatctcggctcaccacaac

SEQ ID NO: 84902 - DNA, 1061 bp, Homo sapiens
cgcccaggctggagtgcggtgggactatctcggctcactgcaacctctgcctcctgggttcaagtgattctcctgcctcagcctcctgagtagctgagattacaggcatgtgccaccaggcctggctagtttttatatttttagtagagacagggtttcaccatgttggccaggcttgtctcgaactcctgagctcaaattatccacccaactcagcctcccaaagtgctgggatgacaggcaatgagccaccgtgcccggctgtcacagttctttatcttgttttcagtcctggtgtttggtttatttagaatttcaaatagtatagctgttgacatgagagagtttgttcatttttggaaatggattttaaaagctgagaaacactgttttagggctaaaaccatttagagagaaaaaaaaactcatttttttctttccaaggtttttatttagaaaagagtaacagtgctaaggaaaatatttctaagccaagaacaaacatatttaaagcattaggaataaaactgaagtatttaaggggcattttctaataggacttaaaatgttttcaaaatggtcatccagccaagtggttttcagccaggcacaatcctgcctttattgcctgagaacatttgtcaacatctgtagacatttcttttttttttttctttgagacagagtcttgttctgtcgcccaggctggagtgcagtggcacgatcttggctcactgcaacctctgcctcgtgggttcaagcaattcctgtgtctcagcctcccgagtagctgggattacaggtgtgcaccaccaagcctggctaatttttgtatttttagtagagacaggttttcaccatgtcggccgggctgatctcaaactgctggcatcaagtaatccgcctgcctcggcctccaaaagtgctgggatgactgctgtgagccaccacactggccaacatctacagacatttctaattgtctttaagttcagaggatgctgccgaacattgtacagtgtgcagaacagaccccacaacaaagaatttatcctgtccaa

SEQ ID NO: 84903 - DNA, 1033 bp, Homo sapiens
aataatggtcacatataagcagatccgttttcaggttttgatactgggtcatggttttagaagccttgtagaaatgtgggatttcttgcgggtggtgattctgcctgggattctggttgcgtcttgccgtgagtcatcctgaacaggcctgtcctgaactgacccctcttcttttggatcccgcaggactcctttacatgtgtccatcatggccgggaatgaatatgtgttcagtcagctgctgcagtgcaaacagtacgtagggagacacgcacaagtgagaaggcggttgtgaggggggattgtgagtgaaaaatcattctttttaaacatctttagtgttgcatatattaagaagttaaagtgagctaaaaaaaaatgtgtcattgaaaaagggtaaagagaaagaaccaggttgttgtcagtatagagtgtctcaaaaagattgtatgtgctgttgacactgcttctgcttttcagactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggtaaagcacgtgcctcccgaaggggcgacgctggggtctgcaggcgccaggaaatggcatgtaaatgccttcaccccaaatttagaaactgaacggcatactatgaggataattattttgtacttaattttatatacagtaaaagcctgggttgtcatttttaaaaatcctgtgcttcaaacaattgagcagacatcaagtccctgaaactgaaacttccatttatttaatgcggcgactcgcagactctttggactcaagaattcctttgaccgtcttaaaaattgtaccccagagagcttttctttaggtgggttataacttcagtatttaccatattagactacactttg

SEQ ID NO: 84904 - DNA, 1113 bp, Homo sapiens
taatccccaggctggagtgcaatgatgtggtctcagctcaccgcaacctccaccccctgggttcaagcgaatctcgtgcctcagcctcccaagtagctgggattacaggcgtgcaccaccacgcccggctagttttgtatttgtagtagagacggggtttttccctgttggtcaggctggtctccaactcccgaccccaggtgatccgcccacctcggcctcccaaagtgttgggacgacaggcatgagccactgcgcctggcccagcctagtattcttaaacagtgaaaggatactgaggtgaggaggcaggacaagtggtaacaggtaaccaaaaattgagcagagccttttgaattcgtctgtaactccatgatctcaatgagtttccacttacagatgccccaagaggttccttcagacacatctagttatcgctctcctttgtctgcagtcattttctgctccctcttgaagaagcactggccagaatactttgccctgacactgtttcttctattatttcttttcaaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggtaagctggggagcagacactgtgcccttagcactgttctcagaagatatcttacagtagcatgtaattggcatacggggagttcatgttctttagtttggcattattcagtcttattttcattaaagtcacagacatcgatgtgtagtagtagtgtcactactaaaaccagaggcatttggggaaaacatttctatcctgggtaactgaagtcttcgaggttttttttgtgtgttgtttgtttgtttttaattgtgtcagcatctcactctgtcacccaggctggagcgcagtggtatgatcttggctcactgcagcctctacctcctgagcacaggtgatcctctcacctcagcctcctgagtaggtgagac

SEQ ID NO: 84905 - DNA, 1068 bp, Homo sapiens
gatctgagcaagaagatgagtcttcactttataaaaacagttcttcctgaacttttttaccttaataaccaacatcagttgatgggtttcttttttctttctttctttctttttttttttttttttgttgttgttgttgagacggagtttcgctcctgtcacccaggctggagtgcaatggctcggtctcggctcactgcaacctctgcctcccaggttcaagcgattctcctgcctcagcctcctgagtagctgggattacaggcacctgccaccacgcccggctaattttgtatttttagtagagactgggtttctccatgttggtcaggctggtcttgaactcccaaccttaggtgatccgcccgcctcagcctcccagagtgctgggattaaagacgtgagccactgcgcctggccgatgagtttcttcagtagattgttcctgttatttttagtaaatttgaaaatgatgccaccaactggagcagcatgaaatatggtttgtattaattgaataatgaaggttactggctgaataaaaccatcaagaagctgcattgaaagaaatattatatatggatttttttagtgtgaagttttttgttaggaatatttttatatggacggattgtaatagtcaatagtcatgcctcatttacctggcagtgtcagtgaatgaggtgatgaagtaactgaaacttttaagcaccagcttttattttaactgtttctgatgatttgaaatctttctaaaatgtgttaaccattttcttattgacagaaaccttataaacggtgattgtgacattttctgttccctccctttgttctgctcttctgatatcagttgtccttttcctttatgtaccctctgggctttcttttaatgtaaaactttattaattttctatttctagtaatttctaaatagcttctttgtgtggggtgaatatatatatatatatatatgtgtatgattataagtaaaaagaactttatatttggatcttattaataaagtaaatctgatccaaagtctataattcttctaagaggacttaagga

SEQ ID NO: 84906 - DNA, 1055 bp, Homo sapiens
gctgggattagaggcgtgagccaccgcgtcctcccagaacattttaatcttaatgaattaacttgtcaaaggaaaaaaaaaatactaggtttttgtttgtttttttccatagtcttactaattcatgagtcccaaatggatctgggctgattttgctttgcaatggtcattttagacagagtgaaatctgtatagaggtagagttccagtgagaaatgaaagctttccaaagtgtcaaagcgttagttttgtggagggatggttgacttgattgaagtgcattgccatggccacttttttttacttacacgtagacatcaaagagagaatctacttgtttcgttccatcttaatcatctatattttccccttttgatgatgcattgttatactattattgtctgtgctacatttttgccattcacaaattgctcctagttggtggaatgtagttacatcaagatgtggtcctgtgccagctttgtcctttttgggccaaggttttaatacaagtatccttataagccatgtgctggagtgctgagcttgctggctggtagagaggaaaattttgctcatcactgggtaggaaatccttcgagtatgtcagtgtcaagagcagatgcatcttcctcaagcaccgttatgtgctgtgcaaagccagcgggtgcttagcactgagtgtgattcagtggggaaatctccaccacgtagggaatgattctttcccacactgtttcgtgtctgagatgtttattttggaaacagataccctgttactaaaaaaaaaaaatctgagaattttgtttctttcctcccagggagttaattcttatgtttgatgataaatcatctttgagttattaaatattttggtgattgcttagatacaagaattgccaagaattagtgatacatttttgatgtttattttcagatgatttaaccttccactctgagtttattaattgcttgcaagtatgtggattacagcgtgggtataataaacttgattttgctaactttagagtgttgcatattacggtagacagagc

SEQ ID NO: 84907 - DNA, 1028 bp, Homo sapiens
tggctgtcagccgagggccattcccaccttctagagccctccacacattccttagctcatagcccccggcttttgtcttaaaagccagcagtggtgggtcaggtgcttctcatgtcacatctctctgacttactcttctggttccctttttcactttgaaggacttgtgtggttagatagatcgggccctctgtggttagatagatcgggccctctgtggttagatagatcgggccctctgtggttagacgggtcgggccctctgtggttagatgggtcgggccctctgtggttagataggtcgggcctcctggataatctgggatactgtccccatcacaaggtccttaatcacatcctcaaagtgccttttgccatgtaacgtggtatgtttataggttctggggattaggacatgtccgtctttggggggggtgataattctgcccaccatatgaccttgaaagaaatgtaatggctcttgacagatgggagcgaagtatgttttatcccgggtgtccagtgtatggggagacattaaactgctgggaagaatgaaataggaacgccactgcctttcatgaaaacattagctgttcaccgtaaaactctctgagcctctgcctggcactcgtgccccacagcactctgtccacattttcctggtggcctttaatcgtctcccacattgtttatgttggctatgtggtccccattaattctgtactccctgaaaacatgtaccctgaggaagcctgatagaagtttgtgaataaagttgaatttggggagtaagcagtgttggagcacttaaatttgacatttgtataagagatgatatttaagggtcaaggtgggagaaattaaaataggtcgtattctctactcactgggcgctaatttacaaacttgtttgtgtagctccctgggaagctgaatgaagcggatcataacggagatctggcattagatctagccctctcacgacgactggagagtattgccaccacgctggttagtcacaaagc

SEQ ID NO: 84908 - DNA, 1015 bp, Homo sapiens
atcaacattcaaccaggtttcaaaagtcctgtctttcatacgttctgtggtctttctcccatcagtcctcaccagccccacagcctctaccaaatggctcaccatcaactgctacagcttgctctctgacttcctttcttcccaatccatcctctacactgcagtcatttcgccatgcctcacacaattcctgttctgtcgctaccgtggctgattcctttcggtagtatcgctccatgagtctcagaataaaatccaaatgctgaaccaatgcccttaataatctggcccttaacatactcttccaacttcacatcccactaattccttccacctagaacagtgacctctcctcaatctcatgtccccatgtccaaaggagggccatttttcaaagctcagttcaagcaatgtctcctgcaacaagactttccctgattatccaaaatacattccccattacttccttaaaaaatctctccctgagttttcaaagtaactcctaagcattttttacccttcaccttaaaatatagtttctcatatacaatttcttttatctcccctcctagacttcagaactccctgtgaataagctttagttctggctattcgtatttaactatcaattacttctccctctatacccattccatggttatctcctcctcccgacagtaccttaccagatggagttcaataaataccacaggttcaacaggagattctggggacatagcaatttctcatttggttcagcaaggctgtaaatcatgatagtatctcaaattgcctacagcaaatcaccttgccagtgacagaatcctgtgtatctcagcacaattcagtagctttactttgacataaccactaatggataaattttatttctcagtaaaaataattcacaaggagaaagctaacagctacagctggtgacagtagtcaccaggaaagggagagaaaagaaaagaatggtataaaaggaacagtccttaagaggtctctggactat

SEQ ID NO: 84909 - DNA, 1057 bp, Homo sapiens
cagattaatagaacacttgcaccattgccagaagtgctttggatagtcctgttccagaaaatgcttcattagtggaggctggtagaaataaggaaagaaggaactttgctgtttccactttttttttttttttttgagttggagtctggctctgtctcccaggctggagtgcagtggtgcgatctcggctcactgcaagctcccctcccaggttcacaccattctcctatctcagcctcccgagtagctgggactacaggcgcccgccaccaagcctggctaattttttgtatttttggtagagatgaggtttcaccgtgttagcaaggatggtcttgatctcctgacctcgtgatccgcccgcctcggcctcccaaagtgctgggattacaggcgtgagccaccgcgcccggccctacttctgaaatttatctgtttattgttttacttattgaacaaatgtcccaggtcattgataattatatatagtccagagacctcttaaggactgttccttttataccattcttttcttttctctccctttcctggtgactactgtcaccagctgtagctgttagctttctccttgtgaattatttttactgagaaataaaatttatccattagtggttatgtcaaagtaaagctactgaattgtgctgagatacacaggattctgtcactggcaaggtgatttgctgtaggcaatttgagatactatcatgatttacagccttgctgaaccaaatgagaaattgctatgtccccagaatctcctgttgaacctgtggtatttattgaactccatctggtaaggtactgtcgggaggaggagataaccatggaatgggtatagagggagaagtaattgatagttaaatacgaatagccagaactaaagcttattcacagggagttctgaagtctaggaggggagataaaagaaattgtatatgagaaactatattttaaggtgaagggtaaaaaatgcttaggagttactttgaaaactcagggagagattttttaaggaagtaatggggaatgtattttg

SEQ ID NO: 84910 - DNA, 1056 bp, Homo sapiens
ttcatagtgaagtagcactaggagatgagaaaagtccaggacaggccgggcgtggtggctcacgcctgtaatcccagcactttgggaggccgaggagggtgaatcacctgaagtctagagctcaagaccagcctggccaacatggtgaaaccccgtctctactaaaaatacagaaattagccgggcgtggtggtgcatgcctgtaatcccagctactcgggaggctggggcagtagaatcgcttgaacccgggaggcagaggttgcagtgagccaagattgtgccactgcactccagcctgggcaacagagtgagactctgtctcaaaaaaaaaaaaaaaaagtccaggacagagccacggaatagagtggctgaagtggaagtgagaaggcaggaaaattagatgttgggatttagaggtaggaaaggaaaggagcatcaggagctaaaatctttggtgaatgtggggaggactatacgattagttaagacaattgcaaaatggagggctaaacagtaacatagctgaatagcatgagacctttcttgttttttgttttttttttttttcagagatggagtctctgttggccaggttggtcttgaactcctagtctcaagcagtcctcccaccccaacctcgcaaagtactgaaattacaagcatgagccaccatgcccggcccagcatgagacctttcaaaaaagacttttactcaagggagaatcaaaagaatgcatcaatagttcaggattgcagggaaagtggtggccttggaggacagccaggagtaagagacaaaaggttggaaggaaggatctgaattagctatacctggtggtgcaggcttttagttgtcgctacttgggaggctgaggctgaggctggagaattgcttgagtccaggagtttgggactgcagtgagctctatcctgccgctgcactgcagcctgggtgacagagcaagactctgtctctaaaattaaataagaaaaagaaaagaaatttaaaaagaagaatctgagaacagaataagagtgtcagaaacgaaaagg

SEQ ID NO: 84911 - DNA, 3359 bp, Homo sapiens
gggtttgaagggagctatagtgagttagatagaatttagcaagttgggaagtgtggcaatcttaagttgtttctctgaacatcctcaaatgtttgtaaatttccaaatcacttggcttttaaatcttctcttatggattctagatttaatataagttgaaagacatttgaagtattgaaaaatctaaattagcgctgtccagtagaacgttctgtgatgataaggatacagctgtgctgttcagcttgccagtcactagccacatgtgactactgagcacgtgaaatgtgcttagcatgactcaggaactaaattgtaaattgtacttaatggcaattaatttacatttaaaattaaatatacccacgtggctgtgagctaccataatagatagaaacaaagtgagctcagaatgaaattaaggatttgttgtcaaataaatctaatatggataaaacctacttacagttaattcttttgtaattgatgaattgactatataatgttgtttttgttgttgtaggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggttttttttttccttttccaaagactgtaaaaatagttgccccaaaatgtcagcactgcacaccctccagggacttggaatacaatcctttttacttttttttttttttttttaagaaactgggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctc

SEQ ID NO: 84912 - DNA, 1676 bp, Homo sapiens
agatttctgcctgtatatcctggtagtgtcttgaaaaagtatgtctaactgctttctaccttttcaactctataatgtttctgaagtgtacaaatcaccaagggattacattcaaaattaaaataaatatttgagattataaaggggagtttgcatgaaatcacttgatactgcttttttaatctacagaaagaatggagggaagatagaaatggagaatttaaaagaaaagttgcccgctgtgtaagaaaaagccaagagactgcttttgagtgacatttatttagcagctagtaacttcacttatttcagggtaagtttattttaaatatcatacttttgtttttttgtaagtatcctattagtttttggaaattgtgtgatttgggtatttgaattacattttttcattgacttcattttttaatggtattatcctgtagtctcgttctcaaaactactgtataatctgcttgcttttctcctaagacacccagctgtttttgactagatattctgcattcatatggttagtatgctggtctgtttcttttcactgatggtaaagtttctaatgataaggttgttatttcagtttagtttctttgtttgactttttgatctagcatcctgatcacttgggcactaatgtatcttcatatactgtattatgtagggtataggcaagactattagtcatctacctattcctttaaggttggtcttctggccaggcgtggtggctcatgcctgtaatcccagcactttgggaagccgaggcgggtggaacacctgagatcaggggtttgagactagcctggacaacatggtgaaacctcccctctactaaaaatacaaaaattagccaggcctggtggcgtgtgcctgtaatcccagctactcaggaggttgagggaggagaatcgcttgaacctgggagacggaggttgcagtgagccaagattgcaccgtggcactacagcctggacaacagagcaagactctatctcagaaaaaaacaaaaaacaaacaaacaaaaagttggtcttctatctccttggtctttacagatagggccagtagttaaaaacttcccttttattgtataacatctgtccacagttttatgttaggtctagaaaggagtcaaagatggaaggcacccatccaccttagaagaggaaataatatagattaattgctcacatgtgggttatttggtctcttcttttaaaattaaatattgaaatgatagaaactgaagtgaagactatcctttcagggatcatttctatagtttgttactatagaagttttctgaaggtgtagagcaccaaaggatacaacattgagctggtttcaaattcagctgctttgattcagcaagctgcaacagttaaaaacatagcagaaaattgttattgaatatctatgtctctgaaaacggaatagttctgcaagttggtgaataaagtctaagagttgtccagctacagaaacaagatgccagatgattcgtaagacctattcgtgatatttaaattactcaataaaagacctattgatttgtgggggttgagggagaaaccgaaatacactgtctgaaaaatcacaatccatggcacatcttgagtctacctattttaagaaaatgaacattaccattatcttctgtc

SEQ ID NO: 84913 - DNA, 1048 bp, Homo sapiens
aggaatagtctctgggcctttgactattaccaatttaagtcggtaagttagtggggaaactaggaggccattacatagaaactcagttgctagtttttggaaaaatatgctttctgcaaatgaagaacacatccaatagttgctatttattcatttattatattatacttaagacatgtaaatgttaggcaccatctacgtgctagatatcttcatgttttacataaatgaaaaagatagcttgtattcctattgggtttgtcagatggatcctgtgtatgtagtacaatctatactatagtcttcttaaaaagtcaacacattgcattttggacattaacttctgcgtatgtgtcatgtttgataaaggtactgtgtgaatcaggatcacatttgtaattgatatttcatgtataaccaaattagtaatatatgaaacaagcctcttcttgaattttgcagttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcggtaaggtggtcacacgtcttcccttcccttcactttcccttgtaataaaacctgaactatagttagtatgtatgtaagtatgcatgaatgtatgcatgcgtgtgtgtgtgtgtgtgtgtgtgtatctcttcccatagttcttatttttgacaaaataaatatatttatttacgtatttattttattttttttgagacagggtctctctgtcacctaggctggagtgcagtggcacaatcataggtcactgcaacctcaaactcctgggcccaagtggtcctccagccttggcttcccaaattgttccgattacatgtgtgagccaccatgcctgaccaaaagtgcatatttattgtatacaacatgttgttttgaaatatggatatgttgtggaatggctaatttga

SEQ ID NO: 84914 - DNA, 1048 bp, Homo sapiens
tttacatcatgacgcagtgcatacatatgtatatatagattagtgaataaaacacatacatagattatataactgaaactacttgtgataaactctgttttctatttttgttaacaaaaaaactttgatagtgactcattaaattgcttttgcagccctgtttgaaaaactagtccatgtaatcagtatatcctaagacccattttggcactaacttacacagagcaacaggatcagtagataaagacttaactctttttggtgtaatgcactcttcacaacagctattccagtctctattccctcaagccctcatgcttcttcctttcaatagataacctcatcagttgtgaaaagtaaggcgctatggtgggccttacttcatttctacatttcttcgaatatctcttttaaagcgcttgttttgtacagtttccccatctagttactatcttcaactgttaaattttttgtataaattgtcctgtttattatgcttaagtactttactaccctgttctttaaccctttacagctttttttcctattgctttttactaaaaaaattgtattatcaaggtcactgactttatactctgagtcctgtggcatttcctaattattcagaaatgtttggtgttaatgatctgtctctttttttaaacttaatctgcaccttccccatgtcttatgatcagaaaaagcaataaaaattcatacttgcttgtgaacagttcaagctatattaaaaagagcagagagtaaaagatctcgtaacactaactattgttagttaactattgttatgtattgatgtcctgtttctggacatttttctatgtgtatacaaacacacccccaatttttcacttgttctttcctttcttttcttttttcttttcccaggctggagtgcagtgcagtggtgcaatcacagctctctgaagcctcaacttcttgggctgaagggatccttcccccctcagcctctcaagtagctagaattacaggcatgagccactgtgtccggcctcccactttttcttta

SEQ ID NO: 84915 - DNA, 1016 bp, Homo sapiens
agacaacaatgtagtggtgtgaaagagcagtagaagaagagaaatagagtttaaaaatatttcatgtcgtacatttctagatgcaaagaccacagtcttcttttctgctctgagtgtttgcagactaacttaaatttactagtatgtattgttttgtaagatgcatctgctggcttggtgcgttggctcacgcctgtaatcccagcactttgggaggctgaggcgtgtggatcacctgtggtcaggagttcaagaccagcctggccaacatggtgaaaccctgtctctactaaaaatacaaaaattagctgggcatggtggcgggcgcctgtagtcccagctgctcaggaggctgaggcaggagaatcgcttgaatccgggaggtggaggttgcagtgagccaaaattacgctactgcactccagcctggtgacagagcgagactccgtctcaaaaaagaaaacaaaaccgtctctggtctttggtgtacatttttaaaagtgttggctgttgaattgagatgtgaatcacagcaatatttctggcagctctgctggagtgtgtatatgctgctgagaatactggtggtcacttctggactgtgccttcctgagatcactagcctttgctcaggaaagagagagcatattcctagggcaggacctgagaaaggcaaaggaaggtacaggggaatgaagaaaggtttgttagaagtaagccttttagaatgctaccaagaaccatgtacttcatagaatgcttaaaaaatatttgttgtcggccgggcgtagtggctcacgaggccgaggtgggcaggatcacctgaggtcgagagttggagaccagcctgaccaacatggagaaaccctgtctctactaaaaatacaaaaaatttagccaggtgaggtggcatatgcctgtaatcccagctactcgggaggctgaggcaggagaatcgcttgaatccaggaggcagaggttgcagtgagccgggatcgtgtcacccactccagcct

SEQ ID NO: 84916 - DNA, 1010 bp, Homo sapiens
cttgtttcccaccctgtcatcctttctccatgccacagcactctctttagaggaggagaacctcacgatgctgcagccattctgtatgctccaggtgttactcttaagctgctcctctgtcccagaagctgtggctctcagagggtcgacatatacagacaagacatatggggcccctgctctccttgtgctcagagatggatgggcacacaggagcacccactgtagaagcaggtccccaagactacagggacaagtcaaataggtgtacaaatgttagtataaatgaaagttattaagcgcagtacattccaatgaaaaggtatgattagacactctgaaagtataccctgaagacagcagcataagaattgccaacatgatttgatttccagggctccctctcaatgagaatctctgggggacgggcctggatatctgcattttaacaagcttccttaaaagaccactgtagggccacttagaatgacaagagcctggctggataccagtagaagttgatcttctggatagtttgctttacccagggctttcttacagtataggcatgaaaatgttttggccatcaagtagcattttgcctggcaaggtatatctatttaatggtttaaaacttacataaaacatgtacgctcaagttctgtaatttatctactggatgcaaattatgtgcttaaatgtattgattaaacttttctttttccacagaactcaacaaaaatccagtggaaggcttttctgcaggtttaatagatgacaatgatctctaccgatgggaagtccttattattggccctccagatacactttagtaagtataatggaactgacatcttcaaaatggagctcttttaatacactgaattaaaaactattttggcaggctgggcacggtggctcacacctgtaatcccagcactttgggaggccaaggcgggccgatcatgaggtcaggagttcgagaccagcctggccaatgtagtgaaacc

SEQ ID NO: 84917 - DNA, 1046 bp, Homo sapiens
gctgttctctcagcccagtctccttagtaagatctaataatttttcctttgggagatgactttctctaaactttggaggtcagcaataaattgaaagggactagtttcttatctgattaattcattttcattttgatgaattcgtatgccttcttaggttcttccttaaaatccttaattaaaggagttttgtcttcatcatcatcctgcatcagaaacggcatcagtaattgatatttaatctcataggttgtgatgagtccttacttttgttttacaggttgctcttaagtattgttgggttttcagagtatatcagcaaaggctttagcttaacatcgctcaattttttaaatataaaagcaatgttagcctgacacgttttctttttaaatttcttaccaaagcacaagatggcattctttaagaaaggtctatttttgtcagttataaatttgctttccaatatttctcctttattaatagttttctgcaattcattgggggaaagtttgttgcagtctcgctatcagcagaagctaatttatttatcagtgatatttaatgttatgcatttatgtactgttcttaaacctctcaaacaattcagggcttgctttgcaactgagctgctcaccaaattctcctgtttctctcctttcacctccatcacttcggagatatgaaatgcacattgctgttgccacagtgctcggtggttccatgctgctggtggttatacatttttgtatgaagtattaccgtaactgttagacatcaacattgccttccatttgtatttctgttgcatagaaacagtcttatgtgtgatacaggggatatacttaaagtcaggggctcagcttttggttcccttgcctttaaataaatgcattacttccaattttttctttcagtgtttgtactttcctaggcctcttacataggttcacctgtattttcccaggacaccccattttcttagaagccatttttacttaatgtggagaagatcatgtacaagatgcctttcagtagaagttata

SEQ ID NO: 84918 - DNA, 2182 bp, Homo sapiens
tcttcttttaaaatgatggctgagatacacacattctttacattacttttgatgtgaacgaaggtcatttcagtagacttgcacatttagagtatgccagcaacttactcaatattgcgataggtggaatttacggtctggcgtctgaattgtagcttatcctcaaccatcaaaattcctacccaaatttcttgtgttccaaacttaagaattgttgtgtttcattgccaataacatggctttttcctaaagtgatacatatttttaagtaattcatttcttgggcaaatatttactgccagagactgtcacaggtcctggggctatatcagtaaataaacaaaaacccttgttcttatagagcttgctttgtagttagggtaggggagagaagaattaatagaaagtgtagagtgctgtgtggaaactagaacagggaaagaggataaaataaggagtgtgtaagggggtggggtttcattaaaaatagggtgacagtggaccgaggaactcaggtgaatgagtgaatcatgcagaggttaggtgaggcaagcacaagggccctgaaatggggctgacctgaacgctggagggaggtggcagagcggttagctgaaggttggagagagatgctggttaaagcccctgaacgctggagggaggtggcacagcacttagctgaaggttggagagagatgctggttaaagcccctgcggtggcagagcggttagctgaaggttggagagagatgctggttaattctgaaggaccctataggccatcacacaggccattgctctgagtgagaatgggaagctgttggtatagtgacatgatgtgactcacatttttccaggattacttctgcctgctgggttgagagtagatacaatagggaaggtattttccatagtaccccagcacatgcatttttattaaacatttgtggctgaaatgaaagcttcaccaacaataaccctattttattttttgtttctgttaggaaaaatgagtgctggttatgttccactagatctatttcatgactgtgtgacttacggttgaaaaacactgccaaatagaatatagcctctgacttagtggacaagaagtaaaattgaggtttgtgtatgaaagcaaagtgaacacaatgtaaaataaaaaaagaataaaaacttaaaaatcaacattatgtatatgtatatatacttagctttaaaaaacccaaataatcaaataccagtgattcaagaggcctaatagtgaacaatgcattcagtgaaggataatgaagaattccccagaggcaactgctttttaaaaccttttaggttcagatctcctgggggcttaactccatgcttctaaataatatatttatagtgtttatgttttggtttatcaactttagacattctctgttgacttcttgctatgacagatgttttcagtcccacttctcactactgatctccctcgtacgacggtcactgaactggcgcctctctggggttctgcccagaagattagccttcctccttcgctgcagctcctctgtgagtattctgctctctgctccctccactctgcttactcagttcacgttcttccatccgttttcatctttcagagccatgggcaatccacctggtctttttaatatactttaaattaaaaagttattttttaatttctttagaaaaatttatttaacttcttaggagggaagaggagataagcacatgtgcccgcactgacaccttgaactagaagacacgattaggccaaagctttttgttgtcaaaagtgtgtagtgtatgtgttttaagagttagatatattcagaatatcttatcttttaaaaattgtaaatatttccccatgtcctgaaatattcttgtaaagtattttaaatagatgcatagcattccttcatatgctgctactatcatattccccacatcttgacttctgggttttcaaattatagttgtaaaccacttaaattataattagtgcttctgtggattttccttatgaaaacatttatacataatccttgattatttctcttcggataaatttctggtcatttcttagttaaggaaaataaatatttttgaggttcttcataaatattactgattgccttctagaaaggctttgctaatttgtatttcc

SEQ ID NO: 84919 - DNA, 2514 bp, Homo sapiens
ttttttgagatggagtctcactcttttcatccaggctggagtccagtgtcatgattttggctcactgcaacctccgcctcctgggttaaagcaattcttctgcctcagcctcccttgtagctgggactacacctcaggtgacccacccacctgggcctcccaaagtgctgggattacaggcgtgagctaccgcgcctggcctggacttgttattaatataaacttttagagcctttaagccataggatcatgtaaaaattaccttatgttggtactttgaatttaaagtgctggcagatcacacataatcttcaaattgaattctacatttaacaaatatttgagtgcctacttttgtaaacatagcagtacattaaagaacaggacatgaaagttttgctggtacaaagttttgcagttattgtgggaagacagatggtaaactagataattaaattaaaaatgtggtgtattaggtagtgataagtgccctggagagaaaataaagcggggaaagggaatgaaaagttgagggtggagtactgatgtcttgaagagctttccaggccaagagaagaacagtacaggggcgctgcagtgggagagaggcctggcaatgtcagaggagcagcaaagggtgtggaggggaggctgtgtgattttttacaggtaaggatttaggcttttactcagagtgaggtacccgtgaggtttttcagcactggagtgatatgacctgatttacattttaatgagatcattcttggcttgctatgctgagaatatagactgcacggagagtcagatgagacatgatgctagcttggacctgtattggagccgagaacaaagtggtttaattcttgggtgtatttcctaaatagagctgttggaatttgctggtggaatagaattcttttctttttctttgaggcaggatctcgatttgttgcccagcaggagttcagtggcacaaacatggctcaccacagcctcgaacccctgggctcaagcctcagcttccccagtagctgggaccataggcatgcaccactgcgcctgactaatgtttaacattttttgtagaaatggggtctcactttgttgtccagcctggcctcctaaaatgctgggattacaggtatgagctactgcgcctggcctagaaggaacacaatatttgaagggtagagtgtgtgagagaatgtgtcaaggatgatttcagggtttttggcctgaacatctgaaaggatggagttgacattaactgaaatggaaaagaaagacgcaggacaaggagagataatcaggggcttggttttgaatatgctacttttgatttgtctattagacactgaagtagagaagtcacataggcagcttactatatttgatctggaattcagtgaggaggtttagcttagagatataaagtgggaaattgttagcatatggattgcatataaactatgaagttggatgggctcaataagggagtaactgtagataggtgaagaagattgaggactaagtcttgggacacactggcattaagaagccagataagtaaccagaagctagtgaaggagtgtgagcggcgtcagtgaggtgtcagaggaggcaaaccagaatgctgtggcctttaagccaagtgaagaaagcttcaagggaagagagatcagctgtgtcaaaaaagagtttgggtaagataaggactgatgagtgaccactagaggtgaatggtactttgagaaaggcagttgcactggacggattggtatgagcctgagagaatggaaggagagcagcaagtggagataaggaatgaagacaactcttaaagttgtaccgtgaaggggtgttgagaaatggtgcagtaactggagggcttgtgggcttcatttgtgtatgtgtctgcatgcgtgtgtgtgtaaagttggagaattgctagtggcatgcttgatgctgatgggattgaatttagtagagagaagaaccgatgacacaggagagggtaggaatttctggagcagtgtctttgaggacatctgagtgggaagaatgagatcagatctaattactggccagtttggaagccttattaggagcaagggcagttgatccagagtaacatgagagaaggtagagaagtaaatacatcggcagagattcaggttagacgatatgtctgggtaaaatggggaacattttcatacttatctcatgatttttgtgagtattaagtttaatactttataaagggatgattacagaacatagtacccagtaagcgttgactgaaattgttaagtttgtaatatttataaagttacaatgtgatttgcatgaccagcttctttcagtgtgtgactaatactctgaaaatactggcttttcatttgagccagatggctcagtcagtaatttctagttatgccatctttttttttttttttttttgtaaagacactgggcaccaaaggtgctactcacacagaatatcaacttaaaact

SEQ ID NO: 84920 - DNA, 1487 bp, Homo sapiens
acccaggaggcagaggttgcagtgagccgagatcgcgccactgcactccagcctgggcaacagcgcgagactctgtctcaaaaaaaaaaaaaaaaaaaaagaagaagaaaatgtaagctgtatagatgagactgcagtaactcatctactgtgaaggaccatacaaaacaagtgtattagctatctaatacatatttaggattatttcggtataagtctggataaggagcaacaaagggtgtggaggggagtctgtgtggtttttacaggtaaggatttaggcttttagtctgagtgaggcattcatggttattgttggttagtactaacatttgatgtttatttaattagtgtaaaaggctttcagaaggtagaaagtatgagttaaaattggtcttcagattactggttgtaaatcagactgtattttaaggttagtcatttttataaagaggaagttgtttagcaattctgaatcctatattgttgcaatatcaatagcagatgctagaatcctattagtaatcccaaggtaaaatgaattctaaaagtgcaatcttgaattattcaacacttggtatccaaattatatgaaatataatcatccattttatgattttgaatagaactgtaggttgttttcttaaataagagttgttcttcctccgccttctcattttgagtccctggaatctgttctatttttacttggggatctacatactaaagctgtctctgatttcatgctctgaagatcaacaagagaccttcccttgtaagatgagaattgtgtagtaggtgactattagaagagtaaacaagtcttaagtctgtaaacattttttcagtaaatgcaatggagtaccagatatctctcgttactatgactaaagaaagttcaatggtaaattcagtagctgtttatttgccttgataagtaattgctagaagtaatagtaattgtttttatagtgttaccgaaggtttatttactgtatgtgtgatttttaaagttttaaagggatcaatgaaagttatgtatagggaatatttgtaagttactggaaataagccaggaattgaatttttaaaagtgcctttcagagtaaattatattttcattttctttatagaatgaaagtggaacaatattgtttaaaattcaaattgagcatcatttgtacttttcaggccattagaatctgctcgaggcttgtgtgggaaagattatttgattatttattagattacctttggctaaacattgcagagaaaagttgttgacaccttttcccctcaaacaaagtaataaccccctgaatctaaaataaaagttggaaaaaagtcatgaaaactaagttgctcatgaggggcttggacttccttgtatttctggctgcccatttggtgctgtcactctgcttgtcccttctgggcttcttgctttaatgtgacatcatatcagacttttagttctgaattaatgt

SEQ ID NO: 84921 - DNA, 2357 bp, Homo sapiens
ggcttgggctggcagccgggcgtcgaccttcccaaaatggcggcggacgggacaactgcgctcaaggggcggggttccgccgccgggggcggggcgggaggccgaggggtcgggctagcgggcgggacgcttcccaagtcggcagtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcaggtgagcaggcgggcggcggggcgccgggcccggccgcgatcgcggacagccgcagcccagtccctcttctcctcccgggccagcggccgtactgccgaaggggcccgggcctgcgagggtggggacctcgaggctccggtcccggccgggcccagccgttctcgcccggctcttggagggcactgggggcggggacgcgacccagctccggcccagggactgggcctggcgcccggggggtcggagaggaggaggtcccctcccccaccgttctgtaggacgttgcgggggaggggctgtgtgcgggtccccaggccggggccgccagcttggaggggcgggtcccgggttcaggtgctgccggggccgccggaccttcggggccggctggagcgtccggacccagtgcggctgcgagtccccggctcggtgtctgagggcgggcggaagggaccggccctggcgggataggtgaggcgcacaaaacttctccccgggcggcgctgggtccgcggagttggggccgacaacaaaagcgctggcctcggcggcctccacgcgggcgcgagggtgccggagaccctggcggagtgcggatcgccgcctcgcctgcctccgcctggcacgggctccggctgcgccgcccggctgggggagggtaggagcgggccgcggggagagccgctcgctggccggctccgggctttgtgctcgccgcgattccggctgctgcgcaggcctgcaaaccccggagctgcgcccgcaggctctggcccggggcggcggccgggtcggcctccccgaggagcctgcggcccccctcccccattgtcccggcctccggccgtttgcggcttccaggttgactttttagggggttggctcctactctgctaggactgtgtgcgcggagcatgcgcagtggagacgtccgtgtgcggagtggaaggggggaggcgggttggtggcttcacaatgcagccccacgtgctgccagatttaaagagaaatgaaccagcacttacccctgctgtacaacacccggcgtgtgtcattctcagttcaagcgatcttccccctacccactctaaaaccagtagcctctagccctcagcagaagccaaagactggagtgatgaaatctgtttttgaaatacatttactaagagtttgaggtgttcgttaaatcacctttatggcttcttaaggaaaaggttgtcaggggttcttacagattgtataattgggtttattattagaccatgagcaagcaggtttggacaagtattaaagttctagatgctcagggggagttagcttgcagtaaatggagaagttctaatgatactacaggatactcataaaaattatgtgctggaaaagcactgaggccgggcgcgctggctcacgcctgtaatcccagcacttcgggaggccgaggctggcggatcaccttaggacaggagttcagggccagcctggccaaagtggtgaaacccccgtcactactaaaaatacaaaaaattattcgggcgtggcggagggcgcctgtaatcccagctactcaggaggctgaggcgggagaattgcttgaacgcgggaggcatcgttgcagtgagctgagatcgcgccattgctttccagcctgggcaacagagcgagactctgttcaaaaaaaagaagggccgggcgcggtggctcacacctgtaatcccagcactttgggaggccgaggcgggcggatcacgaggtcaggagatcgagaccatcctggctaacacggggaaaccctttctctactaaaaatcc

SEQ ID NO: 84922 - DNA, 1041 bp, Homo sapiens
gcctccaaagtctgtgtccttcatagtgcactgatccagaaacagcggggcacaccccaggcactagtaaatcccttaatgcttattgactgagggaggggaccatcacttctggctggtgggagctgatgggggctggtggggcctgacctcacagggaggctggggcccaggcagatggaggccccatcaaagctgtccctgtaccagccagctggggctgggggccccctgccagccctgcttctgccactgtcttggttggttctgggaggtgctccttggctgtgttttggggacacagctgcccccccctcaccccctgcaccctgcagcctggcgcatctctagagctggttgtctcatccagaaatgacattgcgtcttggccgccaaagccagctggagaaactcttctttaggcctgccctgggggttggggctgaggggcagaaaggcgggcagggccagagtgcatccctcctctggcgctgggaagctgctgggtctggcatggtacccaccgatgctgagcctctgcggccagaactctaaccctcagaggtgatgccatcccgcccccaccccttggctctgtctgtgcctccgtagaatgctcggatgttctgacctgagattcaggctccagttcttccttcccaacaactgtcagtcacaaagcccttgacctctcccaggcctaccctcctctccgtcctctctgcccttccctggctcatgccttgctgtctttctccagaactgttctagaagccaccttcctggtctccgtgtcttcctgctcacccactacagtctgttcttctgttcttcacacactgccagagtgagctagctagcttgcttgctttttctttcttttcttttcttttctttccctccctccctctctcccttcctctccctctctctctccctccctccctttctttcttctttctttctttctttccattttctttttcttctttctttccttcctccctccctcccttctttcttctttctttctttccattt

SEQ ID NO: 84923 - DNA, 1051 bp, Homo sapiens
gaacctgctaattacggcctctcctccgccccatgagaaccccctgagggcagcaggcctcagagcgggtgaggagggccaggctcctgtgcttgctcttcttaccgagcgttgcttcaattggatgaaattgaggtagcccagaaacctcttctaaatccttccttgcacctccttgcgcagatgggaacacagccatccagagaacaaagacacttacccaaggtcacacggggggcggagcagggccacaccagccagagcggcatcctctccagtcccaggagccccaggtggaggtaggggcatgacccttgcttctggcctgggaacgcagaggctctgctggcttaggcaagagccctttgggtagatgaatttcagtttaattgagccaaggcagtttgagctcccctagggcacatggctcctgctcctatggtccctagcagccacccactctgcattctgagcccactcctagctgcaaggtcaggagaaggagggagtccctcagacgggggtctcacgccccctctaactagctctgcttcctggtgccagagccacctctgccacccaggctgccattcttacctctgtgaaatggaagcagagctgagggtgtaggtggcagcattttgctcctggaaccaggccccacaagagggaggtggccctggccttgtttatgggtggtgaatgactatttgggaactgagatccttccccaacttctgtggggtacctgttctcttctcaagacctattttctttccctttgatccagcctggggcagcctgggcacttggagttgggtggagtgggggctgttgaggaaaggcagagccttgccctgggggagtccttttctgccaaagaagctgagactggtatccatggcaactgctcactaacacaaacccagaaggagcgatgagcatagggacccagctgggaacacaagccgagagggacttgggggcttccccagagcagctgagctgggtgcaggaggagggggtgccaggctggggctcactctcctat

SEQ ID NO: 84924 - DNA, 1053 bp, Homo sapiens
tgtgggtcacgataaggctgtggccaccttatccctggcccctggtggtcttgggagtccctgggccaggacagggctggggaggctgagctggggaaggagtagccgtgcaaagcccccagattgctcaggcagagcctggttccagtaaagctggccccaaatgatagactagaaccacaggccagaggcccggcagcccggccccgcccactcttggcatagagacacagcagggaggagggggacactctgagctccagggtggtgtctctctagggctagcggggtctgcgggcaggactcgtgggtggggaggggtgtttctctaaggggccaaggctctgggctgggggcctcatcctcatggtctctgcagagactgatcagtaagctgctctgccattaatgacccagatttgcagggtggcttgggagtaggggaccagcagatgtagaacaaacccagttgagattcagaaatgaacccagcagggatgtcttgggattctgggccacttctgaaatgggcaacctgaggcccagctgctcctgaagatcacagcctcctgcgggcagacgggggcaggatcttgccctggggaagcctgggggtgagtaggagtgagtgtgcctgagtccagagcactggctcagggactgccttggcccagtccctaggctggtggggtgccagcggggccgggctgtgggttcccagccttagccatccagcgccaggtcagcagagccaggctctcaggcccctgtaattaccggggtgggagctgcagccaagcgggagcaggggtaagactcccagcgtgagccagcactgaggcctccacatggggacctgggtccctctgagagggactggtgaagggcatcagggcccatcctttcagattgctaggccctgtctttccaggcatctgcccccattttggataaaagaaaaccaaggtgggaatgccccattgttctcaggtcatagctggggctgtgtcctgtcccactagttaattacaaatgataacatttatgacattt

SEQ ID NO: 84925 - DNA, 1050 bp, Homo sapiens
tcagcgggggccgggcccgggcactgctctggcacatcgtgtcgtgggggccagctgaccggaggtgctgggcagggacctcgtcagccccagggggagatgggagagcccaggggtggggagaggagagagagaggagtaaagaggaaaggagaaagaagtcagaaagtaagaggaaggggaggggccccagctttgaaaaccactaagtccagagacaaacccaagtctggatccaccagacacccccgtggcctcccacagctccaggctgaccctggcactgggcctcagggctggaccccagcaaccagtgggtgcactgagtgcatgggaggtctgtaccctccccgccccaccccagggcagggctcacggtggctatcacggtccctgcttcccggcggtgcagcagggcctcccctcccccccactcactgctgctcagccctggcgcggtcgctgacgaagaagagcgcagtggcgaggaagaacatgccgcccaggaccacgacgaaagggcagagcatgagcgcgtagcccaggctcaggaactcccagagcggggagtccttagtgctctggcggatcaggtctgagatctgcgaggatttgggggtggatgtcagggcagagccctcctgcagtcccccagcctgccctggccagccccaccccggggctactcacaaagccaatgaggtaggggctcccggcgtcccccagcaggtgggaggtgaagctctgcaaggccacggcagtggcgcgccgcgtggggatgaccacgtactgcggaacaggcgggcaggtcagcggccagaggagaaaggctcacgcgcttggccctggccccgggccgtggcacttctgaagcccccacaccctcagactcactcctgccctacgtcttgacacctctctcccctgggccctgccctcctccccacagtcccctctactgcccaccccaccagcctggctgcttctctcctgccagtcacccttctcctccctgagcccctcccacccacacacagctgcagtcaccct

SEQ ID NO: 84926 - DNA, 1041 bp, Homo sapiens
gacttgggcgcccagcttcatttgccaggttgcgtccaatatccccaaggtccgaggcccagctgagcagtggtccctgcataccaggccctcgcgtgagcctcaaagccgggactgccgccctgaggcctgggccacctgctctccgtatggtccagggtctgttgagtcttcaaagctgcagatcgtgctttgcccagcaagttgtgtgggaaagtccagccccctggcccttcgttccagggagggcagggacttgcccaagatcacataagctggtggcaggccaggctctccccggacacccacttggggctgtcttcttccttggccccaggggccctgcggcccaaacctagggctgggaacctgtccaaccgtgtggctccaacacacacatccttccagggtaactgaggacacagcctcttcttgatgccagggccactcagcaggcctgggccagagagggtgggtgcctagccgtggatcacacagaaagctttggggcagcccagccggtcccggacgctgtaggacacctcccagacgaggtgggagtgtgggttcttcattgtcccaatggcacctggggaaaggggtgtcaggtcagcagtggggcttagtggggcctgtgccaaggctgccctccctccttcccttttcttgctgtttggagacgcaagccttctcctggacctgcagctgtgaccctgggtctcgtgctgctgggaagctataactcccagagggaagggccaaggagtcaggccctggtacatccaggaggatttgggagaacagaagtccggacagagtgaggagttcctggccagtcctggccctgatctatgcgaggccccacccagcccttgaaaggaaggaaaggggagctaatttactggaaggagcagcctgctgtcccacccatggctccatcagtaaattctggcaacatcttcagagacaaagcccagagttggtgggatgtgctggggtaggaggtgactctggaggaaaagtgctccctgttgcctaacc

SEQ ID NO: 84927 - DNA, 2237 bp, Homo sapiens
ggggctgggaacaccctcacgctgctgcacacacacacacgctgcacacacgctgctgcacacgcacactgcacacgcatgctgctgcacacacatgcactcaagcgcattctcagatgtgggagctgtaggaccctcacaggaccctcgcaggagcctcgcaggaccctcgcaggacccaggggcctcgcaggaccctcataggaccctcacgggaccctcataggggcctcacagaacctaggggcctcagaggaccctcagaatccaggtggaggtagcagtcgcggtggcggtggctgctgccctcgatgggcaccttctaaccttgctcacttcccttcaggcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctattttttttttttttttttaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggctggtctttggaggatgccacccccaccccatcctcttgtcaggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccccccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggagagaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccga

SEQ ID NO: 84928 - DNA, 1850 bp, Homo sapiens
ccagctctcgtcctcaccacccacaggcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggtgagcagggcctggcccaggagcagccccaggcatttcacagccagggagtggaggccgggacttccccagggcccaaccctcagccttctgatgaaggtaggccaggctctgctcccatcccagggacccctctcctggcctcacccagctcgctctcccctggcctaggctgccagctgcttggacttgaacctggtgacccgggtgtactcgacagcactgagctccttcctgaccaagcgcaacagccccctcacagttcccatgttcctcagcctcttctcccggcacccggtgagtgttggggcctgccctgcttcctcatggtccctgctcagcccagcctgcacctcacagcccttgtcactccccaccaggtgctctgtcagagcctgctccccatcctggtccagcatatcacgggcccggtgcggccccgtcatcaggtgagagacttcccagctcccagcccagggcctgtctgaattaacccgcttaaccctcttctgactggatattgtgaggccccagagcgctgtcctggtgagcacgggcacagctgtccctgccccactggcttggctgtgggtacatggtctctgaagggggtggccgtgccctggcccctgccacacagtgaacacacaggagctgagggggcagggccagcctcactcccgcagccactgctgcccatctggccacacacaggatgcccctggtagtgtctgctctggtgccagggctgttgggggcaggctggaggaagatggcactaagccaataatgggcaggaattgtcccaacctgaggtcccacctctatccagctgggaggccttggtgtccccacctgcacacaaaggcacaggagcaggtagtcacagagcccagagcagcaggcagcctcacacgctgcccacagcagtgcccagcgggcccccgagccctcatgcatccctgagccgtgagcacccaacgtgccaaggctcctgccacccacctttgcccacccacaggcctgcctgctgctccagaagaccctgtccatgcgggaggtgaggtcgtgctttgaggaccccgagtggaagcagctgatgggccaggtcctagcaaaggtcaccgaggtaacagccggggggcgccctttccccaccccctcagaatcagttctccgggagaccgatctctgggaaagaagtgaggattggagcctgagtccagagtcgggagaactggggttgtcccaggagacggtccctgcctctgggctttacttccggctgggaaacagaaaggctttgagcagctctccggagtgcctcagcctggccacccttccctagaacttgcgcgtgctgggggaggcgcagaccaaggcgcagcatcagcaggcactgtcctccctggagctgctcaacgttctcttcaggacctgcaaacatgaggtgaggcgggggcccagtccgcggtcgtgttcgggttcctcttgggggccttggggcctcccggccagcagtgccatgcccgggctggactgcagggatgggggtcatgtggggaaacttc

SEQ ID NO: 84929 - DNA, 2165 bp, Homo sapiens
cgcctgcaatcccagctacttgggaggctgaggcaggagaatggcttgaacctgggaggcagaagttgtggtgagccgagatcagaccactgtactccagcctgggcaatagagcgagactccatctcaaaagccctcagctcttggggtgtccagctggggtcttctgttctggattgtgggggtgactggccagggcgggccagtggctgggtgttggaggcttcttgatgccactgctgccatttggccagccccttgcctggtttagaagggctggggacagggcctggccccagtgtgtgtcctaccctgcccgcagtcccctgcagagagctgtgacctgctgggtgacatccagacctgcatcaggaaaagtctgggagagaagccccgccggagccgcaccaagaccatcggtgggtccttggtcacgagagggactagagtggtggggtggggccagcggtcccctatccgggctcaacccctccctcttgcagacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgagttgggacctttgggagtggaatgtgggctggggctcactgagcagcgagctgcaccaggggtgccgcttcagcctccagcctccctgccgggagcctgcggccggtgggaggggtctcaacgaggccttggcctggcctggccgcctctcctaggctccgttttcttctgggaaatggaggtctttggtcaaggctgagtggggcctggagaggagggcgggggctgcaaatgggtcagtggctggcacccctccccaggtgctgaaccccgagaccagtgaggatgagaatgaccgtgtggtggtgacggacgattctgatgagcggcggctgaagggtgcagaggtgttgccagcatgggccgggcgggggcggtggggagtgggacgatcggggaggtgtgtgacgcgcctgcctctaccacacaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctggtgagtgggggaggtggaggggggggcggccggggagggctcgggtgtccccatgttgtgtgcctgcccgaggcctggctgaccgctgggcctctgtccctcagggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgagcctgggggcgggccgcacccacccccgcctccctgtgcgcccacccccgcctccctgtgcgcccacccccgtgttgctgacctgccctcctggctgcaggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgtgagcacgggggtgcagggcgggcaggtgtggccggcagcccccaggcgcaggagagccagagctctaggcttgctgtctgcacaggaaggagagagccaagcttccagcctgggcccctagctcgcaggctcactgctcagccctagaggcacacgtcacttagtgattcccacagtccttgcttcatccccgcgttctcccgacacagtgccaacagtgccctggagctggggtccatccctgcccttgacagtctcaagtggggctgtgccaacagtgccctggagctggggtccatccctgcccttgacagtctcaagtggggctgtgctggggtggagggggacagtgggtgcacctgtggcaggggacacccaacccagtcc

SEQ ID NO: 84930 - DNA, 1257 bp, Homo sapiens
ggtgctcacgtcaccctcaacatgcacggttgcaagagggggctgtcccatgttcgcaggagcagtgacctgacttggccatgaccacacagcctcccatctgttggttccttgagaggggcactgactctctctagctcgggttaacccgcgttcagctggggatccagagcagagaaacggccccttcccatcctagcccagcccagccccctccagccttgcccgtcaggcccccgaggactgtacccagggcagaagggcggctcctcctcctcctggccttgtaccctcggtggtaccatccaaggaggggagcctgtaaaaaccaatggcagtgaatggctatggccactctcccaccctccccaggttttgtttgttccactcgttctttgtcacaaagaagcccacatcccagatccctgagacaaagcacccgttctccttccctttggaaaaccaggcccgagaggctgtcagcagtgccttcttcaggtgagtcttgggcagcccaggagaggtccgaaggtgggaaggccttgagggcgcctgctccctccaggtcccctaagctgggaacaacggcagaggcccccggagttctagtaggtcctggagaggcgggagaccgagccctggggagggcggagggaggcggctacattgactcatctggtctgctgaccccaagccccatcccttgcccagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggtgagcacgtgggatttccagggggtgggcaggacgctgcagtctgactggtgcaggggcctgggaatcgcctgtctccccgcaggatgctgcagactctgaaggagctggaggcccactccgcagaggccagggctgctgccttccagcaccttctgctcctcgtgggcatccacctcctcaaggtactggggcctgggagggaggggctgtgagcctggggttctatggcacaatgggccccctaccgagaggcttttgagggctgtgcgggtttccaggaaaggttctgggggagttaagttgggaggtttttgaagccaactttgtcacaggtggaaacatccctccggccacttagcggcaccagctggtgtc

SEQ ID NO: 84931 - DNA, 1437 bp, Homo sapiens
accgcaaagagttgctaaaaatgctaagctgccgcccaaaaaggcggagcgcgggtgctggcactgagtaagcgcgtgagaggtggttgtttttggtcccgaagatgacacggctaggaattggcagcgtgggctttgaacccaggtcagtctcgcctcctaactaccactctgccctgcgttgagccaggaaaacaggccatccccatccagcaaggcggaaagaggggccttctggggccggaggtgctgaagctggggcagtcagacccacagaggccttgacgccagacaaaagcactggggtgactggactgttgcaagttcaggcacagcctagctgtgtacaacaggagattgccggggctcgatttaacctgtagtgggcacaagcctggtgggctgttgcccgcctgcccccgggctgttgggctgttgggctgttgcccgcctgcccccttggctgttgggttgttaaccgcctgcccccctgggctggtgggctcagcgccatgcctaactcttgcagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgtgagtggaccttgggggaggacacctaatttaggagttaacttcctaggcctgcagagccccgcgacccaagcccgccctccacagcgtcctggctctaaaccatgagaggagcgagggggaagagccttagctctcatatgaggcctcagtttacttgtgtgtccccacactggcgatcgggatggggagatcttggagtgttgtctctgagatcaggcaaaggaatgtcctgtttttgctggttcttttttttttttttttttttttttgacagagtctcactctctgtggcctaagctggagtgcagtggcgtgtgatctcagctcattgcaacttctgcctcccgggttcaagcaatcaagtgattctctgcctcagcctctccagtagctgggactacaggcacccgccaccacacccagctaatttttgtatttttaatggagatggggtttcaccgtgttggtcaggctggtctcgaactcctgacctcgagtgattggccagccttggcctcccaaagtgctgggattacaggtgtgagccactgggcccagcctgtttctgccagttataagtggctcacatgacctcgcctcctgccccgc

SEQ ID NO: 84932 - DNA, 1233 bp, Homo sapiens
gatgactctgatacctcaccaggtggccccgtgtcaggagcaggtagaacaggatccaccaggctcaccccgcagaggaagtcacgatttcttctccctccatccttaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggtgtgatggaggtgggcggatttgccctccctggggccaagggactgcatctggccaggcccagatttgtcgtttggcctgggggtgtcccggctgctcttgtcaccctggcccttgcctgtgaggcaagtgttccctgagtcccttgccctccgcaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccaggtgcgggcgacgcgtgtcctctctcggcccccttccctgtccgtgaagtgggctaggccactagtcctgaggttcccaccaggggcaccaagggctctgaccaggctctgtcctgcaccccctttagctacctgtgtttccgcctgctgggcgcggccctgcccctgctgaccaaggagcagctgcacctggtgatgcagggagacgtgatccgccattacggggagcacgtgtgcactgctaaggtgggtaatgcccgtgcagctcgacactgccagaaaggctagacgtggagctctccctgccaaaaaggggagcagggcacctcgggggcttggctagagctatgggtgtcccctccgtctgggtagtgagctgcctgaacccctttccctcggacaaattttttttttttgagatgaagttttgctcttgtcgcccaggctggagcgcagtggtgagatcttggctcactgcaacctccgcctcccaggttcaagcgattctcctgcctcagcctcctgagtagctgggattacaggcgcccaataccacgcccagctaatttttgtatttttggtagagacgggattttgccatgttggccaggctggtctcgaac

SEQ ID NO: 84933 - DNA, 2555 bp, Homo sapiens
ataattatgatctttttaaatgcatttggctccgtgttcctccacgagagcagaggctttgttccaaccgcctagcacggcacgccagcaggagcccagtaattgttgaatggctcaatgttcggagcgcaggggccgctctgggacgagtcggatcgaagtgctacacctaggtttgtttccgagatgggcccttagaaatgcccccctggggctccaaaggggcagatgccacagccgccagggcggagcgggtgtgagcagaaggctgggaaagatgggacgccgctaggcgagggacttccgctcagagctacggcggaaatgccgctcttttaactctgggccggtctctcttggttcccccgcccctccgggttcttccgcctccgagccgacacaaaccggtgcgcatgcgccgtgccctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggtggagtggcggggtctggggcagaggctgcgcatatcccggcaaggaagcggcggcgggcccagggagttgagactgggggcacgtggtcgcgaacctggatgccagggtgcgcgggggcgtgcaccttgttgtcaccattgaacacgagggtgtgcttggttccgcaggggtccgagatgaaatatgccctgaagcgtctaatcacgggactcggggtcgggcgagaaacagcccggccctgctacagtttggccctggcacaggtgaggtggtgctcctggcagggtcccagccatccaggtcaaaatggtggggtatgaggagggcgggtgtggtgtctcagctgtggcggaggggcagcccgagagagaggtcgggagtggcagagcagactggaggccaacctgagggaggcctcttcatgaaagtggagaaggtgtgagcaaggcctggccaggttttctatttggtgcttgggttgcccggcctcttaggtacactttctgggagcagtgagcgctgggtgggctcccttaggcctgcagaggcattcagctgattggagtagaccactctctgaggcgccttgacaaggggcagagcaataaagacccaggcctgcaggatcagcctgaggggagctcagaccacgtgcggagagaagacccagtggctgagcatttcagactagtaatctaggggccatagaaggtacatagaaggtgggactagggacctgaggcttcttgggagaagttgaagggggaagggaggttaaggtttgtgaagacgtagttgggccactctcctgaaccctcttcctcctgccacacaactcctggcagctgttacagtcttttgaagacctccccttgtgcagcatcctgcagcagatacaagaaaaatatgacctgcatcaggtgaagaaggtgagagtggggccagggaggtcagcagccccaggggtgggaggcttggggaatggggagttccagggcccctcatgcctgtgcctggaatccttttctaggcaatgctgagacctgctctctttgcaaacctgtttggagtgctcgccctctttcagtcaggtcggctggtgaaggtaagagctttggagggactgggggaatgtaggctggcttgggatgggtgggggacagtcgtgtgccctgctcataccctctgtccctctgtggggaccaggaccaggaggcactgatgaagtcggtgaagctgctgcaggccctggcccagtaccaaaaccacttgcaggagcagccccggaaggccctggtggacatcctctccgaggtatgagctccccagctgtgcgggcccaggcaacactttgttacagagacatcaagggggctcggatgagaatctggaacagcactgttccatagaaatacaaagatgtataatttgaagcgtttcagtgactttgttgaaaaggtaaaaagaaacaggtgtcatttagtaacatttagtgacatttgactttatctggtatatctaaaatattatttcagtgtgcattggtataaaaaagtgttgagatatcttacactctttttgtcaggtgtctccaaaatccagtgtgtatgttacacttaggcacacccctgttcagattagccacctttcaggcgctcagcagccctgtgtggctgtggctaccgtattgggcagtgcagctctggaactgtgcctggcacgtggcaagtatataaaacgtttgccattgttatcctggtcaaggctggccccttgtgggcctccactgccctacttgggaaggtagcaccctaggcccttttgtcaccgaagagaaaggcaggggtagcaggtctccaggccaggg

SEQ ID NO: 84934 - DNA, 1019 bp, Homo sapiens
agaggagttgggctttgcccggcctgtaagaagttcttaaacatgtcatggtagcagaacccgggagtgtcccagtgctccgtgtgaaatgtctggaaatgtggatacacttaagtctgtcttatgaacatgacactctacgtgaccatggtctaaaatcaccactgtgagctcacacgtgcctcatcaactgtgtcatcggttgtttctgaggttttatttgaacatgcatttgctatttgtctgctcatagcagcagctgtccaaattaaaaaaaaaaatgtcaggttcacatatacatgtagatgtgtgtgtacacacaaagagagagagagagagagagagagagagggaattctctccagtcgtgatttttgtcaatggagattagccattgttcactggcaccaagctagtccactaggttaggagttggtggatgaagctcaggatgagggtcttctttgtgtctggcaagccctcttcggggtggatggaaggtggagggtggctggaggtgggtaacttgattgtgatggtccaaggagaaaggaaaggtctgagctgggccgtgggccttggtgtgtagaggggctgccttggacagggtttcagagggggaatgagcagatggggtagtctcagaggggagctctgacttgggggactgctgggtcacagatctggggtgagatgctgggttccacccgggtcgtgctgaacatgaggggactatgggaactccaggtgaagctgtcccagagcaggtggattcatggatctggtgctccacacagtgagcaagcctggagattagggagctctctgggcagaagcaaagagtctgaaggaattaaaaaccagaccggggaactgccagggagtgaggaggacctgagtgcactctcagcaaaccagagaaggagccctcctggaagaagaggctggggtcagtgaagatgcgtcggcctgttggggagtgaagatggagacccaggcacccaggggcatgagcagca

SEQ ID NO: 84935 - DNA, 1063 bp, Homo sapiens
gggaaaatggtttcaccctcagcctttccccccagagccccgcctggacctgtggaacctgtcagacgagagcagggtgggtgagggggcacggagaccccagagcctggtgactgtgggggccggggttccagctggactggctggttctcctccccctgccgacatggtctacacggccgcagcgtggctctaggggcacccgttctgctctgcgtgctgggagacgccctgtgcttttcttgcgtttctgagagtgggcctggcctctcctcctcccactcttgaatcaagagctcaggggtcgcctcctctccaaggctggctcttcccaggctctgggtcctgtctgctgtgagctccccagtggtcccgctctgcagatgctcccctcacctttctcaccctatgaatgtggtcttgcctcttccttctggaaaaacccctcagaccctttcccctggcttcgctcagggctaaagttactgcgctgtcttcatttctctgggacccctctgctaggccatctcctgtcccccaaccccctgtcccccgccccacgcttctgatcacccatgacctcttcttttgctgaacccaatggatgcctggttggatttcctcttcaccttttcctcaaccccaggctgcctttggacgcacctggcttttttttttttttttttttttttttttttttttttttttttttttgagacagagtctcgctctgttgctcaggctggagtgcagtggtgcaatcttggctcactgcaacctccatctcctgggtttaagcgattctcatgcctcagcctcctgagtagctgggattacaggcacccaccaccatgcctggctaattgttgtatttttagtagagatggggtttcaccacgttggccaggctggtcttgaactcgtgacctcaagtgatccacccgcctcggcctcccaaagtgctaggatgacaggcgtgagccaccgcgcctggccccgtgcctggcttcttgactcccttccttcctggccttggctttctcaccattcttcaggggctcct

SEQ ID NO: 84936 - DNA, 1035 bp, Homo sapiens
cactgtactccagcctgggtggcagagtgagacgccatctctaaaaaaaaaaaaaaagtggtcctcatgggcttgttgggttaaaggagcctcaccccaggcctcacctgccttcctcattcctttcccagcccaaccaccaaccacctggccccggccccagccccggccctggcccaccaccccggcccctgagcctggccagggaaagaatcagagccagagggtcttgtaacctgcacttggtattgtaagtctcgctttgacctgagatagctgcccctctctggggcagcaactctctctccgagggcagaatcgagactggctctgagctccttagcctgagtttttggaatatcggtatcagccctgttatgttgccttggatgacgcgcttggactcagccccctggggtcacaagaactccttgtatactttaaaagcctttctgtcttggctgcttggggttagctgtcatcctaattgcagaaacagctctggacgagcgtgttgtgcaactggatccagacgatggtgtggtggagccaaggggaatgggtggtgcagggagcgggcagctcatgaggatggggcccagctgccgaagcccagacgtggcaaccgtcaatcagactgtcagaggacacagggtcagggtatcggggtggataccccagcacccaccccagcggcaaggtcactccagcacccactccagcggcgaggtcacccccacacccaccccagggtgaggcgacactgtcttgcaggattcttccttgtctaagtccagtgatgcccgcttatgccctggtcaccttggtcaccctctgccctagaccaggctaggctgtggcagggagagggatgccccgggccatggggtggtggccccatgccccagcctgcagggaacacagctccccttggcagccagaaccagagcgattccgggctgtgcttccccagcacgaggtttgagttcagggagcttctagactccaaacagatgtttcttctattcccagctt

SEQ ID NO: 84937 - DNA, 1049 bp, Homo sapiens
acaccattagagcagagacattgttggtttgtctgttgctgcatccccagttccaaattcctgttatgtagaaggggctcagtaacgaatgaatgaatgaaccaatgaacaaacgaatgtctaattgtggttcctcctcagttctttgagctgaacgtgggagataagcaaaccatcacctgcagtaggataagctctgcaagaacccggggaggctccctctccagcggggtggatgtgcattgctggagcagattgagaaactgagttctgatgggagcttagctgctcgggttcctctcacaccgtctgttgcagcctgctcccttttgactgaatgcaacaaaaaagaatgggctggggtggtagggcacccctagcatggcacaccctccccccacttcaccccttgcaagccaaggagactttgaggggcagttctcagggcacagatcctagggagcccacagggtgccattcttaggactttgtcactgtggggtctcatggatcctcagtcccggggcctgggtcacttccacttctagtctttgacctgtctgggtccagtgcaaatctgttttcaaatactggatgagtgacctccctacaaactgcccagtggatttccctaaatagcaacttatctgtagaccccctggacaagggttgtgtgttaggccttcttttctccatgtggttcctggcaaaagactcggcataaagagatatttgtgcacacgaagtcaaggaaatgctcccgcatgggatccagagctcaagaggtttcttctcgttttcagtcctttgcaaagacccttggtctgccttatctcatgctgttctaatgtttcccaacacttgaactaagtgttgccccagatttcttcacctttcggacatctaactccctgaagtctcccatgtctttggtttctcagcctctcctgtgaaacatggtgctgaagccacacttttgggtcttgaacactaagaacctgcactcatttacactctgaccagttcagttcctgccaaccagccctgct

SEQ ID NO: 84938 - DNA, 1088 bp, Homo sapiens
gtctcttgtttccaagagactcccagtatttctggtgctcacacttgccctttcttctttcctcaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaaga

SEQ ID NO: 84939 - DNA, 1222 bp, Homo sapiens
tacatatgtaaatggtcattccctgtttctgtctctctctggctctcactttcttcctccactctttatctctgccccttttttctccagagcttgcatggagatggtcccctgcggctgctgctgctgccctctatccaccttgaggccttggacctgctgtctgcactcatcctcgcgtgagtgggattgggctggctgtggtgaagggatagggcgtgccagaaacgagggtcaccattccttctctgccccaggtgtggaagccggctcttgcgctttgggatcctgatcggccgcctgcttccccaggtcctcaattcctggagcatcggtagagattccctctctccaggccaggagaggccttacaggtgaccatccaggaaggcaggaagggaataaagaggagaggggggtgagggggtgcaggtgggctggggcttctggcatgttgaccccccattcataactgccatctttgctcatgacacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaaggtgaggaggcctcagctccgccttaggactcatcctgtgccctttgaccaagtgtgcctgctcaggaaacactgtctgctgtggctgtcttgccttgttgtttgcctgtggatgtgatttatgttttctctgcctccagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggtgggtgaggcctgtgccctggaccactggggctcaaacgggaccccatcctttcccctagtgggactcccctacctactatacccttaggtgaaacttttgtggggagagtgcctagaccagccttcgtccactgcgataagtgatcccccaaacagcaggtgaaggggaaggtgcctgtgaaatgcagagccaggcggaagcccgcagagaggccaggaggaggcacccaagcagccgccctgttgccagggctgcaggcggcctcgggtcctgcgg

SEQ ID NO: 84940 - DNA, 1321 bp, Homo sapiens
gttggagtgtggagactgttttttagtactatgtccttttggcttgagggaaaaattttgcaaaaactgtcaaggaggaagcccagctgtctctgggacagggccaggcccttttcgctcccaagcaggaagccgaggaccagagctggcgttgaggagtcttttaccatgaaagcatgtccgtgcccggtgttgatgccccatagagggctttgcttcttgtgtctacaggaaaaagagacctgggcttagagtctgctgctgggaacggatgggatgtacatctctggctctcagagctggctcactggcctcttccttttttcctccacatccagggcaagctggcctcattttttctgtctagggtggatgccttgagccctcagctccaacaggtaaagggcagggagggagagggagagcccggggatctgagcctggattgtctcttgctgctcctcctctagcttttctgtcctgccttcatatgcccatctgtgtccttcggcctcattgtcccatctcaggtttccctcagagctctctctgatctccatctcttttgggtgtcagtggggctgggggttctgtggctgggctggattcccatctgaccaggtttctgtcctttctcccgcagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactggtagggaccagggctgctagttagtggaacaatagtgaggaagcgtggcaggaaggaacaggaggggagcccagagacatggggcagttggtttttggggaaaatgggttagaatacaggcaggtcgtccaccagaaatgacagaggaggggatggaagaaagacagtgtacagggtagttgtgcttctgccagctcctgtgcagaatgaaggccctggggtggagatgctgctgtcctcagaagatggtgatgcccatgtccttctccagcttcggcagaggttttcgggactggcccgctgcctagggctcatgctcaggtgtgtgtgggtattggagggagcggaggcgtggagcaggagggattgatgagggagtgtcgccttcatcaggagaaaggagatgaaggtgggtgtgggagttatgccagggagcctgctctgaaggtctccctgctctgattctctttagctctgagtttggagctcccgtgtccgtccctgtgcaggaaatcctggatttcatc

SEQ ID NO: 84941 - DNA, 2135 bp, Homo sapiens
tgatccacccaccttggccttccaaagtgctgggattacaggtgtgagctaccaagcccagccctttttttgttcttttttttttaagacatggtttcattttgtcacctgggctagaatatagtggtgtgatcatggctgactgcagccttgacctctggtgctcacatcagtaccccccaccgcacccaccaatagctgggactacaggcgtgtaccaccaccccccgctaattaaaacatttttttttgtacagatgggttcttgctatattgtccaggctggtctcgaacttctgggctcaagcagtcctcccaccttggcctcccaaagtgttgggattacaggcaggtgctaccgtgcctggcctggcatcttttactagggggaagagtcttcagtgtttagatggcagttgaagctgaggatgaggtgatcaaaatgagcccttttacggactggattttaaagcacaccacacttaatggtcaggtagaggaagatgaactgactaaggagactgagacaggccaacagaaagaagaagataaccgggattgcgggctgggggggccaagcgaagactacttgagggacgagggaggagttatttccgtgtgtgcctcctgaggtgggacaagacgcagactgagaattgttgatcagattagcggcacgggtggtaagaccatagtgagagtggttttgctggagcagtggacactgaagccagactggcacgggataagaagcgaatgggagaagggaaatggaaggagagaagatgggaaatcttttcgagatgctgggctctaacgatgagggagagaaattgggtgattactgggatttggcaagtgaagtatgggctcaagaaaagacttttttggtggctcacccctgtaatcccagcactttgggaggccaaggcaggcagataacgaggtcaggaattcaagaccagtctggccaacatggtgaaaccccatctctactaaaaatacaaaaattaactgggcatggtggcatgtgcctgtaatcccagctaggagggaggctgaggcaggagaatcgcttgaaccaggacctgggaggcggaggttgcagtgagccaagatcacaccactgcactccagcctgggctacagaaggaaactccatctcaaaataaataaataaaataaaaaagacaagatttttttaagatgggagagacttgagctgtataaatgtcagtgggaagagtcatgtggtggggactggttagaaattcaagggagataaagcgagtgacagtgtaaggttctgagaggaagggaggaagatagtattgaaagcacagcggagggactgtctttgggtaggaagagggcaggagagggtgggtaggatgaagatgaaatttcgaagtttgggagtgggaagcgaaggctgttttattaggttggtgcaaaagtaattgctgtttttatagttacttgtaattatctctgggcttcagttttttctgtgaagttatgggcaaggttaaacagaggtgacagtggtgggagaagtagcgatttggaaattggaggagaaaactttagtagcagcgttaaccagagaaatgtggtaggattactggacagggatgagggcctgtgtcgttggtaggcctgcctgtttttgcttcataagtattttctttttttgacacatggcctcgtctcgtctagcaggagatatatgctggatgtttttccttagatacatattaattttctaaggaagtccttttaaattcaaattgttttttctccatgggttccagggtgggtttgagccagttagcaacaacctcgaagagatggcacagtcttgttatggttgaggcttatttttcagtctgaaaagtgctcttctccctttctagcagggaacattagtatgatatcatcggaaaatctttccagggctgcggtgagccaagattgcgctactgcactccagcctggatgacagagtgagaccctgtctcaaaaaaaaaaaaaaaaaaaaaaaaaaaggctgggcactgtggctcacgcctgtaatcctagcactttggagtctgaagtgggtggatcacttgactcccagagttcaagaccag

SEQ ID NO: 84942 - DNA, 1027 bp, Homo sapiens
ctcagcctcccaggtagccgggattacaggtgcctgccaccccgcccggctaatgtttgtatttttagtagagatagggtttcgccatgttggccaggctggtctcaaactcctgacctcaggtgatctgactgcctcggcctccctaagtgctaagactacaggtgtgagccactgtgcctggcctagacgccctttatttctttctcttgtctgattgctctggctaggacttccagtactatgttgaatagaagtggtgaaagtgggcatccttgtcttgttccagttctcaaggggaatgctttcaacttttccctgttcagtataaggttggttgtgcgtttttcatactttgttgctcttttaacgttttaatttttttcccctacttttacatcctttgataacatctccacttagttatttaacaagcattttctgagcacatatagcaggcagtgtaccaagctctggagagacagtgagatgtacatggaccctgctttcatggtactcagagtctagcgctttttctatgaagtaaatgtttacaaataggaaatgtttatgctttgtgaaccacatatagtttctattgtatattgtttattttccaatcctttaaaatgtaaaagccattcttagtttgtgggccatgcaaaaacaggcacccatagaccatcatttactgattcctgttctagttgaagatactttttttttttttttttttttttgagatggagtcttgctgtgttgcctaggctggagtgcagtggcgtgactgcctcagcctcccaagtagctgggactacaggctcccgccaccacacttggctaattttttgtatttttcgtagagatggggtttcaccatgttagtcaggatgatctcgatctcctgacctcatgatctgcccaccttggcctcccagagtgctcggattacaggtgtgagccaccacacccagcgaagatactttaattgaataattatataaatgaatgtgaagtgataaactga

SEQ ID NO: 84943 - DNA, 1373 bp, Homo sapiens
tattaattttattcagctctgtattccttcacgtaacctcatgcatagtgtatgtgttggaagaaggaacgatgcacgccgttagggagacgcgggtgccgtgagaggaggctggccatttggggcatggagaggttacctggggggctgatgaggaaacatctttcgtgggcttccagaatgtgagagaaggggagaactggaaggaggattcttgttgactcggtctgtgttggcatttttacagctgtaaggaagccaggaatagggggaggaggatttgtttgagggtgaaggaaggataatggatgagttcagtgtccattcagcaagcatttatggatgtctcctattaggtgctgcccagacatatagaggtgaagcagacccatctttgaagtctggtagtgggattagttgggctgtcctgtgtttggcactacttgggtggggcatggagggaaggatcaggcaaaatataacttgaggaaaggccgagaaacagcctttcccacaggaaaaaaggggaaaagctcaaggcttctagtgggatggccttttggcctcagaggagatgtgacttcagaaaggcttcataggtgctgggacagagaagggcttgaagaatcttctgcatttttaacatcccgtttgtgactcgcttccctgttttctttcctccagaacctttcagctcttggggcattggtgagtctcagtaatgcacgtctcagttccatcaaaactcggtaagtctttggcccttttttttctccaggggcgtgttcccttaggaagtgggcatatgtacatctttgctttcattgtcaccgtccccaggattcaagacctctctctattcccaagagtgtggagagttacattccttttgtgagctcacttgatttgaaccctaccttttccagctcccagatgtcctattccaccctgggattacctctgctcccttctttctttgcttcttccacctcattccaagtatttcaggagttggaaaccacagtggatctggggatgaagtcttgctgtagcctagtgagaataaaagagcagtcactttctctgaagtctagcctccgcccacttaacatgactctcttctttctttgaaggtttgagggcctgtgtctgctgtccctgctggtaggggagagccccacagagctattccagcagcactgtgtgtcttggcttcggagcattcagcaggtgttacaggtgaggtttcagctgctgccctacttcctcctcctcccccatcttattccccatcttggatgtggcatgttcttttcaacttggacatgtagttctggggacagaataattggaaacaattccctgatagcaga

SEQ ID NO: 84944 - DNA, 1019 bp, Homo sapiens
agtgacctcctctgtggtgtaagaggaggctttcctccccgcttccaggagcccaggccccgtgcgggggaggagtagggttggggtgtgtgaggaatgacccctcctgcccctactctgatcccaggaactctgtgcggctggtgatccgaaaggtgcagttcgccccggagaaacccggcccccagccttcagccgaaaccacacgccacttcctcatgtctgaccggtccctgcacctcgaggcttccctggacaaggaggtggggcgtgagagggtgacacggatgccacggtgcagtttagaccctgggggaggggcgaagccacacatcaagaggacatttgtaaaggaggttgccttggctgggtgtggacagttgccgtgggcttgggtttgaggggagggggccagaacaatgtgtctgtgtttggggacacactgatgatgggaacagtgaaaaccagttccaattcacatgaccccctccccccaaaagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccataatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagagtgagtatcgggagagacccatgttccaatctaggggagaagagcaggatcaggagaatgtgaggtggaggaagaattcttcctgagccatctcc

SEQ ID NO: 84945 - DNA, 1228 bp, Homo sapiens
ttgtagcatcaaatcaagatgccttagccttgtgaggctgcctcttgctgccttttctttgtcccttcctgtaaatacctctggtcccactgctgttcgaacgcctctgtcccagaggcctagcttcggggagggcagggagtgggaggctgggacaagagtcagaagccctcacctcacaaccctctttcccaccaccaagctatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatgagtgtgtgttttctctgtagtgtttagagagtgtatggtgtgcttatccatgattctgttagcttgtgggggaggacccagtctctcttctgcacccaaaagccacctgacacggaggctatcagcaaatgtttattggatgactgtgctgtggctgtgttccagggtaaacatcaaaacttgacttagtccaaactcaagggtgaggcttgataaggccacaaagtgaacttagtcatttctagaggtcacagtaactaaactaactcgcctgcacacagatgctcacgggagctagccagggcaggcccttccctgttgcggccgacgcacatgaccacctgtgacctgttgtgaccgagtcgcgttcatttccactgctccttatggctgctcgagccatctgctcctgtggctcagcggtgccacaaccgcaggcctcaccagacaagccacgtgacgtctctggagt

SEQ ID NO: 84946 - DNA, 1034 bp, Homo sapiens
cctcactgggtaacatcacatgtgcctagcagaagatgtgtaaataatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgctttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaagatcagactctcactggggtaggcaagggactgaggaggtgaaaccaacccgtat

SEQ ID NO: 84947 - DNA, 1403 bp, Homo sapiens
gggacgcctggctccgggcgggattatggatgttgtcgggggcgtgatgatgtgtgggttgagcctggcgctctgaccctgggtccaccgagaggctgtcatggggctgtggattggatgccagggaacagcggagtggggaccctgggcctgggaatgggtgccgaccacctccgtcccgcgcaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggtaattttacctgcctctgcgagggcagcgcctgggcggcccctccttgcaggtgcctccaggaccctctctggtccagcctgaactccttcccggctcaccgagccccatctccgggttccgtttgctctcattccccgaaacttcatgactccgtctcacctactggggagtttcccagtcccaggagaaagggctctttcttggtggcaacttcacgcctctggaatgaggaaggagccggggaaggaaagaaggcgccgcagctaagcccaggtctctcctccgcaggttccagctcctttcctggagcgtgtgtgggggcaacaaggacccatgggttcaggaattgatgagctgtcttgatctcaaaggtgagacttttccactgctcttcaggctctgcctccagggcttagcagcttccacctgacagttttctttacctgagccttttcccctggggccgcacattcctagaaccttcttctgatcctgtccaaagtacttagactcgagtccctgtttgccaaacggggtgatcattcaccatcaccttcatgagttttgccaattcattctaccacgtgtgctattgtctacttattaatatttttcttgaaatcaaagtactattttattttatttttttgagatggagtctcactctgtcacccaggctggagtgcagtggcacgatcttggctcactgcaacctctgcctcccaggttcaagagattctcctgcctcagcctcctgagtagctgggattacaggcgcgcaccaccaagcctggctaatttttgtatttttagtagagacagggtttcaccatgttggccaggctggtctcgaactcctggccttgtgatccacccgcctcggcctccaaaagtgctaggattacaggcgtgagccaccacacctggcctatttttcttttccaatattttattatgaaaatttacacatatacaaaagttgaaagaatggcacactgaatatccagtgcctccacctagattctacaattttatttatatatgtatattttacatatttacataaacatatatt

SEQ ID NO: 84948 - DNA, 1045 bp, Homo sapiens
gtggggggcagaagggcaggacccaaccaggaggtcactggaggggtcagggctgaaaagcagggccccctcagccctcaccctctgcagggtaaaatgctgctcgtcgctttcggggggcaggccatcacctacaaactgcagctccagggccacatgggggagcaggaccaaaagctcctgaaggacagaaagaaagaaagatctggggtctaccctgtgcccacccccataccaaaatgcccaaccttcaggcctggggtgacttacccaaaacaccatgacaaggtcaaactccttcccggcctccaccacgtggatcttcagtgactgtttgttttggatgttgagctcagggactgggtgaaaaaccagcgctttaaggatgtggtccactctcactcccccatcctgctccaccccccactccgctctccttacaggactggggcaccaggtgggtgatgacgtagtacacggtcagcgggtaggtgagaagcacggctatgggggagtccaagctgaggccccgccatgtgtagtaatcctgccatgagcctggcaggagagggttgctagaggacctggccctggacccccaccccctctagtctaacaaacctcttcttcacagccacccaggctctggttctccagtccctggccctacccctagcttccacagggcccctccagctcaccaaaaacaccccggggtggatgtgggggcacaggaggcatcagggcagtcccgtctccctggagaagctggtaggggtctcctgagaggatgaaagaaggaggggcctggggtcagggagacccccacctgacccatctctttcttccttccaaaggggctgtattccctgagacagccgcagtaagaggaatgggggtttgcatagggatggggtttctgggtggagttggtaggggtgattccattgagggctgggaaaggcctgaaatggccctggtgctgttggtaggggtcagtgtgtatgtggagggatcatctgggacccagacaacttcttcccag

SEQ ID NO: 84949 - DNA, 2885 bp, Homo sapiens
tttgttttgtttttgcttttgttttgagacagtcttgctctgtcgctcaggctggagtgcagtggcgtgatctcggctcactgtaacctccgcctcccaggctcaagcgattctcctgcctcagcctccccagtagccgggattacaggcgcgccccaccacgcccggctaatttttgtattttttagtagagaaggagtttcaccatgttggccaggctggtcttgaactcctaacctcatgatccgcccgcctcagcctcccaaagtgccgaacggtttttgggttttttttggttttttggggggggggttttgctgactttcttgttttgtttgttgcttgccacgctgccatcaagtgctcactgtcgcaaaagaaccgtccccatgcagtactgtacttttcttttcccttctgccgtcaacctcggagtagcttcgctcccagaaggcctcaaagcgcgaccaaagagcgtgacagagcgctttacgacagttgctttgaggcagtaccggaggagaaagatggcggctaccttactagctgctcggggagccgggccagcaccggcttgggggccggaggcgttcactccagactgggaaagccgagaagtttccactggggtgaggaaggaatcggggttcataggacgtgcacaaggcctgacgcgatgggaagataaagcctgagtggggttgagagatctggcaggggtggagaggaggtggaatgtgttgtgctccaggaatggggagaggtaccccgaagatggtggagtggtgcggtagcttcgtagtgggaggtggagggtgggctgaagtttgaaattctgaaatcctgcgaggctagtgaggatcttgggcttaagtacgggatgagtcttttgagatttgagggttggcattctggtattctgcggggtgctgaggcccctataagatttgaaaatggttcagcgacggacagattttgtatttttggaactaggtagagagatcattgaggtttgtgtctgctggagaatgtagacttactcctttttcccttttcccagaccactatcatggccgtgcagtttgacgggggcgtggttctgggggcggactccagaacaaccactgggtgagctcaggacagatttgtgaaaggtcttcccatcttccttttcctttcctgcctgccagcccaccctgcctgcctccacagaccactgtgggaagagaggtttcttctctctctggagataaagatttgtcccaacttttgttactttcagttcccctcactcgttagtggaatccttacaaaagtctgttctccagcccgcttcagtttggatgagaataagcaatactggaggccaggcacggtggctcacgcctgtaatcccagtactttgggaggccgaggcgggtggatcacctgaggtcaggagttcgagaccagcctggccaacatggcgaaaccccgtctctactaaaaaatacaaaaattagccgtgcgtggcggtgcgtgcctgcagtcccagctacttgggaggctagggctagagaatcgcttggacccaggaggtggatgttgcagtgagcagagatcgcgtcactgtactccagcctgggcaacagagcgagactccatctcaaagaaaaaggaaaaaaaggcaatactggacatcctatccctgagccctaagagagtgggtagtgatgggatggaggtggaagacaggtgggctcctttcctcactattctgccatcctgcaggtcctacatcgccaatcgagtgactgacaagctgacacctattcacgaccgcattttctgctgtcgctcaggctcagctgctgatacccaggcagtagctgatgctgtcacctaccagctcggtttccacaggtgcttgtgggcaggggaggggcaagtatctgaagggagttggaagctgaggagctaaatagcctgacttctaggtcttgaaactttctctgtgacttccctgaccctctagcattgaactgaatgagcctccactggtccacacagcagccagcctctttaaggagatgtgttaccgataccgggaagacctgatggcgggaatcatcatcgcaggctgggaccctcaagaaggagggcaggtcagatccccacccgaccagagcacacttgagccaggacttttatcctctccccagccattttctttttctttccagtctctacctcacttattcttactattaacgtgcctcagaccaatagcagaatggacaggtgaatgtacgtgtgttggagggaggatacgactggtgactcctctccttctatctggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatggtgagagcttaggcttctgggcctatgagcttcaaccccaactacccaagccaggccagcattcctcattccttgcagtgatcccggcatctgaatctgaacccagctttcttcttttatccacagctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgtactttggggttcttttttttttgacttcaagtccgaatttgtctggccca

SEQ ID NO: 84950 - DNA, 1410 bp, Homo sapiens
actacaaggcacagtacctgccatggagggggcatgtgtggtgttgatggacaggaagaaggatgcatggatgatgcagggtggctgggcaggtggatggatagaggacagaaagggtgatggatggaaggatatgagttggaaaggtggagggctaggagggtaggcaggtagatggatgaatgatagacggtacataaagggatgagtaaatgcttgggaagatggatggatggatgatgaagggtgggtggatagatgtgtggatgggtgagtgggtgagcacacagatgacatttagtctaagtctgtggcaagcagcaaagcagggcatatgtggcagagcctctaggatctccagacaagctggagggacacacgtggaaaaggtttgggagtgtggaaaggggctactctgggagaggcactaggatctgattccccaactcaccaccaggaggagggtgtccgtgtgtctattctgctgtttaaagaagtggaattggccttgggcatcaacagtggctatagcaagagggcgctgatgctgctgcaccccaacataaaggtgactctcggcctcagagaccctcccacatgacagcccttctccccacactgtcccagcccccagcgctcccgctccctgatggtctcatctttccatctttcctctctccctcccagtacctcctgttttccttcacctaaacccaccctcatgaaccctccatgcctgctccaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccaggtaatccccctgaggccttcctgagcacccccaaactcagataagctcaatcaacaccatttcccagctccagccttaccccctcagtcattccaggccctgccaacctcagggttcctcagactttctgggactccaagaacccactttgaaagtgctgtaactggccgggagccatggcttatgcctgtaatcccagcactttgggaggccaaggcgggtggatcacctgaggtctggagttcgagaccagcctgaccgacatggtgaaaccctgtctctactaaaaatgcaaaaaattagctgggcatggtggcagttgcctgtcattgaagctactcgggaggctgaggcaggagaatcacttgaacccaggaggcggaggttgcagtgagccgagattgtgccattgtactccaccctgggcaacagagcgagactctgtctcaaaaaaaaaaaaaaaagtgctgtcacccacccagtcctttccccat

SEQ ID NO: 84951 - DNA, 1590 bp, Homo sapiens
ggcccagggggaggacgagcctctttagaggctttgtttgagcccttcgggctgtctccttctggcactgcttggctcagaaaagtaggaacagaaagttctcccttctcagaggccctttctcaccatcacctgctgactccctccgtccaggtccctttggccccaattgcctcaaaccctggcctggaagccctcagtctcagggggactgggaagagggaaggacaaaaggatggtggccctgaaattcctgctccctgctagctttcctcatccctgcttttaagaagtaagataataataatggtcattaacttttattgggcacacgctctgatgccaggaaccatctgaagcatttgatgggcatttcttcacttaaaatgtgagtaccaaccccagaggaaggtactcgggcaccctcattttgcacatgagggtacagacgcagtttctcggtgggtttgaaatcgggaacatgtctttgaaaagccatctgcgctctgacttccatgttctctcacttctttttttttttttttttttgagacggagtctcactctgtcgcccaggctggagtgcagtggcgcaatctcagctcactgcaagctctgcctcccaggttcacgccattctcctgcctcagcctcccaagtagctgggactacaggcgcccgcaaccacgcccagctaattttttgtatttttagtagagacggggtttcaccgtgttagccagcatggtctcgatctcctgacctcgtgatccacctgcctcggcctcccaaagtgctgggattacaggcgtgagccaccgtgcccggccactcacttcttccaacttttcccgtagaacattcactctgaaccaatccaggaaaagggcagccagccaccagggttcctgccacgtgccctcctgatatgctggtcttcactcccatatcttgactggataccactttacccccctctagctctgtaatccttttctaaagtcttgacacagtattcttctgtctcctgcccctaggaccctgctgggatctttgagcttgtggaggtggtcggcaatggaacctacggacaggtgtacaaggtgagacgaatggtgtggaagtatgacctccacatctgcagggcagtcttgggaggagtggaaggaagtagattcctggtctgcaggtctgaagggggctatgggagatgctagagtctagggccctggaaaggtagagtgggggagaggaaagagcacccagaaggaggtactgttgatgcctctctctacctgagtgcagagccagtcccggacatggtgggaacaggccagcagccaggcagggtggcctgcagcagtgagagcaggtggaagggcatacggccttgtgtgtcagaactctcctgggattcagagagagctaaggccagagatgtgggtttggcctctccccagaccacaaagagacccaggactttgaggtagtgggacctaatgggtggccttctgcagaggggatgtggcctctgctcccacagctggcctgctggggccagagctcaggcttttggcttttgagctgcct

SEQ ID NO: 84952 - DNA, 1050 bp, Homo sapiens
taggtctctgagagtgtgggctctgggaaggaaggtccctggacaaggccatccccaccttcatgccctctgtgctcaggcttggatctcaccagagaagagattctggggggcagagggcggtgactggtgttgggatatgaagacaggagggacgtcaaggtggcttgtggatgaatgatccaccctcttcctcctgcacccatcccttctgaggggaccctcccagtgtgagccaccactgtttccaggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaaggtcagtgggcaggctggagggggcaggtactaggggacactccagcctggctcctctctgccagccctgctcgctcctggcaccccttcctgctcccctccttggccccagctctccctgtccaaggagatcgttctcaaacttgcaacccccaaggggttttccctcctttccctcccagtctgaatcagccttccaaaggaggaccggcctttcgcatccttacaaaaactccatgctaagcacatgtgtgtgcgagcacaagcacaggctctgccacacctcagctgccctgggacccagtcccggtcctgtccaggcccacacctgagacccgctgtcctcccattgcccccaggaagtgggtggggcccctcatgcttgcccagccagagagacctggttatccccacccaaggtttccctagcccacggcgggtctggggcgctgggtgagataactgcagtggcctccccctgcagaggagacagaatatgagtacagcggcagcgaggaggaagatgacagccatggagaggaaggagagccaaggtaggcctggcaggtggagtgggggttggggcggtcatcgctgagtggggggactacagtggtgcttggc

SEQ ID NO: 84953 - DNA, 1356 bp, Homo sapiens
ccatcccttgttcaggcatcagtgaccttcttccaccctgccgtccagtctcctccaaaccggacagctcccctgtgctctcccctgggaataaagccaagcccgacgaccaccgctcacggccaggccggcccgcagtgagtcacctggtggcaggcatggcctgcctcatcctggtttggggcttagcctcagggtgctgggtgtcaggggtggggtctccgctgatctaccgagaagggctgtggggatggagggactggtgcttctcatggtgctaacctttcctaacctctctcctaacctctctcctaacctctcttctggctctttcttcccctgcggcccctcccagagctataagcgagcaattggtgaggttagtgagatgggcctgcttgtgggagcccctcctgtcgccctgctggggtgtcccggcaccctttgtctacctccacccaggcccagcttctccctgcccctcacgtggctcctccctgcaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccggtacggcatcgggagtggggccctcccactccaaggcacagggagggaggggaagtggcagtggggaagaggtggggctttggggcaagtctgagggagagcggctcccttctctagagagtggggtgagggtgcaggttcctgtctctctcccgctgccctgtgtgttgtggggtggcctcttcaagtgcctgtctgcccctgtgccagcctgccctgtgtgccatgcagggaagcacctcacggtggagcaggggctacaccgtgagggtggagcaggttgtgttttgaatagagacaaaagcctgggctctggctgccatctgctgcctttggcacttctgtggccacgggcaggacctggaggggccccaccttcctctctcacagcagcgatggggatacagacagcgtcagcaccatggtggtccacgacgtcgaggagatcaccgggacccagcccccatacgggggcggcaccatggtggtccagcgcgtgagtgagcctctgctccctcccctgtacctgtgtgtgccctcctcagccccacgccaaccctgccctctgtcctgtagacccctgaagaggagcggaacctgctgcatgctgacagcaatgggtacacaaacctgcctgacgtggtccagcccagccactcacccaccgagaacagcaaaggccaaagccc

SEQ ID NO: 84954 - DNA, 1063 bp, Homo sapiens
gcagtcagccactaccactgccctgcgctcccttcagattccgaggacttcccagctggcccccagggggcgagtggtgcaccctctcccctaacatcccagcctgcctttcctccgggtgaggggcactgtgagtctcctcctgcagtctctgtgtctccctcaactcttctgccaccccttcttcccttctttccctctcccagttgagacacccccccaacctcagcccttggtgacttcttctcctgccccacccaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaat

SEQ ID NO: 84955 - DNA, 1077 bp, Homo sapiens
gcaacagcctccttgctggtctcccaacttcccaattccctttcttctctttattctccactggagtggtctttcagaactgcacatttgctcatatccttccactgcttgaaatccaccaatgggccaggcacagtggctcacacctgtaatcctagcagtttgggaggccgaggcgggtggatcacctgaggtcaggggtttgagaccagcctggccaacatggtgaaaacccatctctactaaatatacaaaaaattagccagacgtggtggccggcacctgtaatcccagctactagggaggctgaggcaggagaacagcttgagccccagggggcataggttgcagtgagctgagatcacaccccctcactccagcctgggcgaaagagcgaaattctgtctctaaataaataaataaattcaccaatggctcctcatagatctcaggagaaagtctaaagttcccaacatggcctgcagggtcctgcaaggtctcccctttgcctgcctgtccagccccatctgttcccactctgcccttactcttgatcattctctcctgtgcctgaactttttcttcaacccttatccccttctgcctaacttttacttatttggcaagttccagctcagaattccttcctctggaaagccttttctgacttccgaagaccaggttaaatgtctattacagaaagtcagacaccatgccctgcctgttggtccactgccccttctgtgatgagaatgtggccctgcactgttccccagtaggagctccatgcagccgcctgagcctgcccctatctgcttccagctggtgaccggacaagggatagacacttaagccagatgcagttaatccatagatttgccatttatataatttgcccgctgcaaaggtattggaaaatgtggggaagacgaggtagtatagaaagtgaggtgggagtttgtctggagagaagccatgaaattgaataaggaccccgagcccagaggctgttgatttttttttttctttttgaccctcacccaggctggagcgcggcggcgccatctccgctcactg

SEQ ID NO: 84956 - DNA, 1747 bp, Homo sapiens
agtcggggtggagaaaagggtcatttctggagctctccaaatgcccttggagcaccccacggagctttggtggctgatcaagttcagggatggtttttttggtggattctaagagtgatacgggttttgtggtagttaaaaatgtgctttttggagtgatcaggcttgtggcagacaccaggatggtcgggcttgtggcgatggtcgggattggggtgggctccggggtggtcgggctgggggcgggctctgaggtgggctctggggtggtcgggctgggggcgggctctgaggtgggctccggggtggtcgggctgggggcgggctctgaggtgggctctggggtggtcgggcttggagtgggctccagggtggtcatgtttggggcgggctccgggacgggctctgaggtggtcgggcttggggttggttcagtagtggattttggagttttggagaatgtgatggattccatgtgaagtgtgaaatttggggtccatctaggtgggaatgtggtctgctccttagtggattcttgtgttggatgcaaggaggagggcatttggctgtctagagaagcagtggaccatgagtagaatagaccccagggggttgtatgggctttggtggggaacttgaccacagtccttgtggcacgcaccttatcgccctcagtgtcctcttctgggtagtaatcatataggtctgtgtcaccttcatcaccaagggtggggcacccctttcctgggtatttgtagacgggaaacttgtctgaattgtcacactgcacactggccacgttagaggtcatggccttgacgtccacaccttgcttccatacgtagacattttcagcattgtcctgcagccagcgacgaaaatagaggatctcacagttgcataaccaggggttcccgtggagaaaagcaaaaggcaggaggtgggacccaaaaaagccctttggtattgtatacagcgagttctcttggaggagaagggtgtcgagattctccagcccattcaggagcccagcggggagctcagtcaagttgttgttagccagactgagcttctccagcttgggtgtgggcgtcaggagccctgggggcagggtcttcagctcattgcctttcaggtagagctcttggagttcgccaagaccacgcagggcaccaagaggcagcgaggtcagccggttgaaggagacgtccaggacggtgagagcaggcagtgtctgccctagcaagggcaggctttgcagctgattgtgggatagatccagggtccccagcactggcagcgtcccatcgacctggagcttggtgagctcgcacctatctaggttcagctgagtgaggcgagtgtaaggcatcagggttgccagggagaaggtgtacaggaggttctcactcaggtggaggatggttgtgtctttcggcaggtctggaggcagcgctgtcagattcctcttgtcacagttcacttctaggtggctggccactttggagacctcacagatggggtgggggtgtaaggggcttggcagcaggagcagcaagaggaggagaggcatgaggacctgtgggcaagggagccttgagtggatccccctgcatcccctggaagcatccccccaggccccagcccccttccccctgcagcttcgcttccagaaacagcatccacacctcctgtcctccctactcccatctcccacccttgcctgcagaacttaaaactactagct

SEQ ID NO: 84957 - DNA, 1040 bp, Homo sapiens
tgactgcttctgcagcctaaagagggaggaaataaagagacttagagaggaagtcagaccactgtgggctggaggcagtgcaggtggaaggccagggcttaagtgggtgggcactggaagcttgaggaaaggggaatgctggccagagacctgatctgggtccttggctggggagagtgagaaccttgtccatttctttagaagatgtgtggttcccaggccagccttcaaggagccttaaaacctcttggggcacaagagagtttgggaaggtcaaactgaggagtgcttgccaggctaggggacaggcaggcagcaggtgggagctgtccctttggcagagcctcatcagcagaagaggtggagctcagcatcctggcgcccctgctgctgcctctgtgtacactgtcctgcgccttggtggctattgtgagatgcctgaagcctagaccttgtccttaaggagttcctggtccagaagacaagattatacaggagcagttgggaaactgagtgtagcaatagtgttgcagggtaacttggagcacctggcctcgcctgggagtagtgacttgcagactgagtggttagactggctggggatggggcaaggatagcacacctggctggactgagggcaaaggcttagagtaaaacactgttggggagcaggtgatctataggcttgtgatagttggagcacagactgtgaggtatctcccttgagatgaagctggactgtcagatggggtcagtgcttggcactccctgactgccaagctcaggagttggtcctccacctggggagagattcggtcagactttcaggtttgggagatcttcaggaccatctggagggggatgggggtctccatagtcccattctctgggccccaagccttggattgggctggagacaaggcaggagaggaagccacaccagtgtgtttagagaatggcaggatttatgagaaaagaaatggggttccatttgcctgtgtcccagcctgagagcaggaaacccaagactattcagtcac

SEQ ID NO: 84958 - DNA, 1151 bp, Homo sapiens
ggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggtgagtctgagggacggatggggaaagggcgctgaaaggaagggttgcaggctgaaggggaacatcgccttttttgtccgcagacctcggaccacaatgccagcatggactttgcagaccttccagctctgtttggggctaccttgagccaggagggcctccaggtgattttctttcttttcttttcctccttccctcccttccttccttttctgtcttttttctttttttagtatttcgcaagatcctccatcctaggctggggttggggaggtttgtcctgggtgaaactggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggt

SEQ ID NO: 84959 - DNA, 1016 bp, Homo sapiens
cgtgcaccatcacgcccagctaatttttgccattttagtagagatagggtttctccatgttggccaggctggtcttgaactgggattacagatgtgagccaccgcgcccggcctcttcaattttctaattacccatctcacaaacaactcgactgctactaaggcccaactgagttcttgctatgtggcagtctttgggatgaaatactaccaaaattgcgtatctactttgatcttcacaataaccctaggaaaacttctaatatcccattttacagtaaaacaaactaaggctcagagagattaacttgcccaaagtcatataagcaataactagcacctgagaccttcctgataaggaccgttgatcctgccttctgtcttcgtccactttcagtctccctgataacctcggagttccaggggtggacactctgtcttctccctctagattctgggttctacactagacgtgctcagttcctaacttcattttcctacctccagtttcacccaggacaaacctccccaaccccagcctaggatggaggatcttgcgaaatactaaaaaaagaaaaaagacagaaaaggaaggaagggagggaaggaggaaaagaaaagaaagaaaatcacctggaggccctcctggctcaaggtagccccaaacagagctggaaggtctgcaaagtccatgctggcattgtggtccgaggtctgcggacaaaaaaggcgatgttccccttcagcctgcaacccttcctttcagcgccctttccccatccgtccctcagactcaccgctcgaatgagcccccgggtcggggccgctccccacagcacagcggccacaaccacaggaagcgggaaggctgcagggtgcatggcagcgggaggaaagaggctgaggaggccgcgcgtcctggtagcaaggagcagaagcggagttctgcgccctccctgcccctcctttaggatcccaggggtccaaccacccccaggtcccacttcccagctaca

SEQ ID NO: 84960 - DNA, 1048 bp, Homo sapiens
ggtggaggttgcagtgagccgagatcgcgccactgcactccagcctgggtgacaaaacgagactccatctcaaaaaaaagaaaaacaaaaagaaaactgaagggaggggagtgtgtctgtatgagtatgtgctggagaggggactgtgaaacagaacttgagagaaagtgacatgggtggtttgagaattgaattacaattggaatattagaaggcaaaaataattgcattagcttgcagtatagggtacagattagcccatctgggacagcgagagggatgatgggagagtttggtgaagggatgttttatgtcattgccttttcaagaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctgaatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccaatcctttaggtggggtggggccaaagtgcaagatgccagggttcccagaggatttgagtagaaggttgtgagtccccagagtaacaccttgatccctgcagaggaaatccagcagcagatctggatcccgtctgtatttattgg

SEQ ID NO: 84961 - DNA, 1050 bp, Homo sapiens
catgtgcctccttcccattcttccttcagcaagcagttccatgccaacctggagcccaggcctcctcattacccgaaccattcagcctcctgtccttccttccctgcctctttgactttcttcccattcctgtccccacctatgggctttgtccagagccagttactttgtccctctttttttctccctttgcctttctcgccctgctgagactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaa

SEQ ID NO: 84962 - DNA, 1754 bp, Homo sapiens
gcataaatacaacgaagacgggagaggagatggaaagcaaagatgattaagtgaaataattgtgggaaacaatagagggatagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttcccttcttacctctgcttctctttgcttgtcccttctagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgtttctttgtggactaaggaagggtaagatcattctcacacaggtgaacttaaccctttggtggaatcacccctttagccataaggagcaagggaatgctgagagacactaacctatagtcatggggacagccccagccggcatttgctatgactcagaagggggagccccacccacaaggatgactcaactagccctgccttgcctgcaggcctgcacccattctctggtccagatggctctattccatcatccaccaatttgaccagcacactgaggacttaggcctggaaatgccactgtggaggggcagggccacctggccagaagctcaaattcctgcaccttgtagtacctcaacctccctgctcccaagccacgataaaggaggcaagtcacagtgcctatcccccattctgacacccaagctcaaatcacacagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaa

SEQ ID NO: 84963 - DNA, 5387 bp, Homo sapiens
tgtgggattcggcgtggacgccagggatgcgcgccgcgctcgggaggagagagaaaaccaaccccctttccgcccgggccgcgctcggtgaccccttgcccctagcccaggctccggaagccgcccagccctcggcggcgggtcggaggaggcggtttcaccgcggccgccgcacggccgtcccgcccgtcccgccctccccaggtggctgtgagcgcacatctgactgcgaagaaacccaaagggcccgaagtgggactttccccttcttgaaaaagttgccactcttgcaacttgagtattcttccgcctcgaaaaatagccccgcctgttaagccccgcgggtgtccgcgctctgtgacctctgcagacacaggccaaggggcacggccggtgatccagacattgcctgcctggggcgggcggggctgggatgtggggtgaggccctgggctagagccgatccagagaagggacaatcctctagactgagaatgggccctggtgaacccaacctgcacgacccgagaagacgctggggacagaagtggccccggtgggtgccttcagctatgagagcgactagaggatttggccaaactcttctttgctttcttattacttgaataagtaaaatcaagggtggtgaggcggcagcgcgcacggcttcgcccccgccccttccgccaggcgggagacacgtccccagcccgccttcctttcccgcagggtccacacgggtcgggccgggcgcgctcccgtgcagccggctccggccccgaccgccccatgcactcccggccccggcgcaggcgcaggcgcgggcacacgcgccgccgcccgccggtccttcccttcggcggaggtgggggaaggaggagtcatcccgtttaaccctgggctccccgaactctccttaatttgctaaatttgcagcttgctaattcctcctgctttctccttccttccttcttctggctcactccctgccccgataccaaagtctggtttatattcagtgcaaattggagcaaaccctacccttcacctctctcccgccaccccccatccttctgcattgctttccatcgaactctgcaaattttgcaatagggggagggatttttaaaattgcatttgcaaagttcggtgtctgggctggcgagtgggggagggagggaatggggagtaggccccgcccctaccgtcctttgcaaataaaaatctagcggggcggggggggggaggagcaggaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacggtactgcgaggcctgcgcggtccggggcactgctccggtttggaccctgagggagggacttgggtgggggcgggcgcggtctagggcgcgcagcgagaggccctgactgggtgcttgccctggaagcggcgcgaatggcggctgcacgtgagtgggtccctcagttgcccgtaggtcctatgccccaggcggcggcgcccatcccgcccgctaccccgctttccgcgacggggcgttacatccggggcacagggcggggaggggcgcggcgcccggtgcggcggcccacttccgcctctcccagggcggggcggggacgcgcctcagtttttactggggattgggattgagaggggacccggggatccttggacccccagctccccgtccggctgccagcccgcgtccctctaccattgtttctcctggtgcggaagggagccccaggcgcgtggtcttggtcccttgcccaccctctgtgggcttctggcccctcctaactccgttagagagggcgaggccaccacacgcccccccagctcagcacgttggattcaacattcctgcgaggccaatcccggaagtcccctcgccctcccttcccgccatccggcggggcctggagcaggggaactttgtgagaagttctgagacagcataagcgaaagtatattggtttactaccgctgctcccaccaccatctccctgtccacactgcccggaagtggggagggggagcggaagttcaaaaggggggggaagggggtttccgggcgggaggggaccggatgtgggggcttggggtgaaagggggaggggggaaaggttcccggggtacctagacccgagagctggcctgccgggtctggcccctgtccaccttcaaaagttttccaactttcccggaaagcccccaggggtctgcttcctcatctcagagcagagatacctggagctaaactctaggttacttggagacccaggcgtccgggccctaacagctcctgcagaacctttgaccaaataagggcaaagttgcttctcttgcctcgcccgcccccctcccttcccctctccgcttctgcttttcctgaaggagagttctgagcatccaaaggctcctcacttacctcactgactccctttatttcctgggtttactttccccattaacactgacatctaaatctctagaggagtatgtcatcccttcctccctggttccatattctaagtttcagaatcatgatctttttctgcactaacgtcccacagtcctcagagtttctcacagttcattgatgtgtactgagtatataatttatacttagcccccacggcggggtggttctcagaagtggaagacaggtgggtctttggagaacacggtgggaatcttggtgcactgactaacttgatgggcgcttggttcctcttccagccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagagtgagttcctgagtcttacccttcctttagctccaagatctctaatgtaccgccttctggtaatcttgagggtgcttttttgtgtgattccccaacatgaagggagtcagaccagtattgtgttccttgtctgctggatgctggaacacgggatagtccctccattctgtctcagttcctcatcttgtaattcgaagttgctgaactgcattacctcttaaattacttactgccttgagctcggattagaaactgttttctaggagtataggtagattgttggggtcttgaatcatcgagttcatcgtttgagttcttttgttagaacctggaggtggcatgcacatccacagccctttctagcctgaacacatgaatcaacagtctatgagcctttgacccctaagtttttagtctgttcctctccagcgtttaagcttgattttcctcttttgaaaagccttattgtttcagggtgactgacagcctgcctgtgtgtggtgggggggcgggttgggagagatgaggttgggttacagcccccagggctggacagctgctgaacagctggcagggggtggaattgtgacacctggatcctagcctcctttctctttcctcctcctccagcgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaaggtgctgtgtgatttgagcttgggtgtcagaatgggggataggcactgtgacttgcctcctttatcgtggcttgggagcagggaggttgaggtactacaaggtgcaggaatttgagcttctggccaggtggccctgcccctccacagtggcatttccaggcctaagtcctcagtgtgctggtcaaattggtggatgatggaatagagccatctggaccagagaatgggtgcaggcctgcaggcaaggcagggctagttgagtcatccttgtgggtggggctcccccttctgagtcatagcaaatgccggctggggctgtccccatgactataggttagtgtctctcagcattcccttgctccttatggctaaaggggtgattccaccaaagggttaagttcacctgtgtgagaatgatcttacccttccttagtccacaaagaaacaattttattagcccaagaagtgaagacccagtccctctgcttgccccagctccaccccaaagcccctcaaaaggataggtgtgggtaagggagaagcttgggatggaatgtcccctatccctcagaagactggagggaagacgacggtctgtgcaaataggtcaccagaggtgtatgtgtggggggttattagaccaggataacaggggaagagggaggggacagtgggggatctgttgaaggcccaggaaaaacaaggggagctggggctaaggaaccaaaggaggtgggaagagtggggctagaacccaaaagtggggtcctttctgaggcagggtggtcccttggctccccttcatcaccctcctcttgcccttgagtttcttcctcttggtcttcgtccccaggaccccgatgaacaggctgcttgcaaatggggcaggtcttccgggtctgagtgagccaggggtccacgcagcggctgtggtaggctgcagagaggaacaaggtgaagcacctggtggctgctggtggcagaggggcatgggcaggcagtgagggcctcaccatgagcacaggggagtacccgcagcttgtccccatcctcatattcatccaggcaaatggcacagacatcatactggtctcctgggacagaaagaaaataatctagtccttcactgagccacaatgacccagggctaaggcttttaaagccttgcaaaaatttcccctcacctacaaagccagtggaagagataagacaggtaggcaggataaggtc

SEQ ID NO: 84964 - DNA, 1018 bp, Homo sapiens
ccaggtatctgggactacaggcgagcgccaccatgcccggctccattggcaactctgcagcttcattttaccatatagcatctgcttcccctacctcctttggaaatgtgaacacctctgttgttctagaaccacccagcttcctctgtgagtccctcacctcctctttgtcctagcaggttacatatctatttgcctcccctccccgcccccatctcgccacctcctgttttccccagctcagcccagaaaccagcatcccctagctcccacaaagaagcacacagctgtcttggttggcaccagtgtttatttcaggaagcaggtctggaagacctgggtctgtccagtggagtcctggagcctccagcttctcacttggccttcgggttacggaacttgcgtccagcaaagattgccttgtccccaagagcctcctcgatcctagaatgcaggcaaggttagggctgctgaacttccaacctaacagcctccagcaccccaatgcccaggcccactgttcccgctgtacctcatgagttggttgtatttggccagacgctccgagcggcagggggcgccagtcttgatctgatgagggaagaagaatttggagggttaggtgaggctggaaaggaggggttggacctggccccaagggagcattaacctcaaaggcaggaggccagggaccccaagaaaacttggtgagacactcagtagagagaagctacaagtacctgtcctgtgcagagccccaccacaaggtcagcaatgaatgtgtcctcagtctccccagagcggtggctcaccatcaccccccagccattagactgagccagtttgcacctgagtggagaggacatttgatgtggccttctagaacctcctcagtgggaaagcaggggttgggtggggcctctcccttctgttttgggtagcaagcactctgcagggagggcagtgactaagttctttgggaagtaggagaggaaaagacttatcttgatttcgggct

SEQ ID NO: 84965 - DNA, 1369 bp, Homo sapiens
ccaccaccacacccggctaatttttgtatttttagtagagatggggtttcaccatgttgaccaggctggtctcgaactcctgaccccaggagatctgtctgcctcggcctcccaaagtgctgggatataggcgtgagccaccatgcctggtctattattcttaatctcttactgtgcctaatttataaattaaactttatcataggcatgtatgtatagaaaaagacatagtatgtataggggtcagtactatccacaatttcaggcatccactgagggtcttggaatgaacccctgtggataagggggactattagatagaataaacatcaataaatgcttgatgaataaacgctaatcctaccttcccagcctgacacctcccagtggacaccacacttcacttgaagccttagaaacctttcccacccatgcttccagccctggcttcatgttgccatttctcacccccagaacaggccgcccgcctgaagaaactacaagagcaagagaaacaacagaaagtggagtttcgtaaaagggtgagaacaactggagtgatcaaaggcagactcaggaaggacttccaataagttaaaattggaaggttgaggactcagttttgctgaaaatgtcttgagagaggtgacgcatggaagccagtggcttggaggctggggagggtgctggggaggcgtagaagggcccaggctcagctagggagaggggtacttgggtggagccattgtctcatatctgcttcctttcccctctcccaagatggagaaggaggtgtcagatttcattcaagacagtgggcagatcaagaaaaagtttcagccaatgaacaagatcgagaggagcatactgtgagtgtccctgggctgggggaggaaggaaatgggtggctagcggggcatgaaagggccagcggggggctcctccagaggagggcactaggcccgctcctggctcaagatgctctttcccctctgccatcccatcccagacatgatgtggtggaagtggctggcctgacatccttctcctttggggaagatgatgactgtcgctatgtcatgatcttcaaaaaggtaaagggcctgaattcctcattctctcctctcccctttgtagccttatcccccctccccgaccaaggaatgaaatgaaacatttgtatggactctgaccccatcattctgctcttcttcaggagtttgcaccctcagatgaagagctagactcttaccgtcgtggagaggaatgggacccccagaaggctgaggagaagcggaagctgaaggtgagctatgctttgcagcccttggggtccagaagcccaccacctgggaggggtgggggtttg

SEQ ID NO: 84966 - DNA, 1064 bp, Homo sapiens
tccatcttttgtttctttcaccagaggctcctttctcaccaagaagcaggaccaggcagcccggaagatcatgagattcctgcggcgctgccgacacaggtactcatcccttctccccctgggcttttgcgttgccacccgtcgtgatccgccagtctcctctgactcctatctttctctctgcaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggagg

SEQ ID NO: 84967 - DNA, 1046 bp, Homo sapiens
ggcatcgcatgccttcggcccccccaggaaccctaggcagggaatggcagtgaggcatgatgatcaagaggatgagtaagggggaatggcgtggatgcagtgggtgggcacagagggctggggctgggccctacttgttgcgggcaggcagggtggccgaagtccggtggggagggccgggcctgcggcggtaggagcggtagtgctgctggatgagcacagccgctcggcggctctgctgaaatcgcttctgttcatagtagcttcggaacttgctctggatcaggatggccgcctgggtcatcttcttatagagtgcaaactgcaggggtggggaggagggacaggggctgaaatagagggacggagacccaaagccctgaggctcacccaagttaggctgatgcaagactctctgtaacccacacactcaaggaaagactgaatcatcacagacctcacactcagagctcatgcctaataccttaagtgcaatccaggtcagcttgtggagagagaaggggagttagggctctggcaacattctggaatggttaggcgtgggtgtgggttggtgggttgctggttacacttttgagggagaagggtctcacctgcttgtacttccggtaacagcgctggattacagctgctgctacctcctgctgctccttcagccgccggccctgaagggagagaagtctcaccacctcatgacccacataatggcatatctgacttgtcccttcaactttcctggggttcccctgaccctttaccccatccaaggcctgtctgcacgactactcatcctccaaaagccctgggagcccagtctcccctgactggagattgtgtaattcatcctgagacccctgcccctgaccttgtactttcggaaggccgtctggatgactcgggcagcctcatacagttcccgctgctcgtgatctgatagtgtcagcagggcaaaatcactttccatcttgccactggtggatgcagagagaaactctgcccaggagggtgctgaagggacagccagg

SEQ ID NO: 84968 - DNA, 1099 bp, Homo sapiens
gacttatattttggggaactttcatatcctgacttacaacactttgacttcttgacctccttaagctagtgtccttgactgcctcttcccaccggccctgtacagcttgcctcctagtgcctttacttctgatgttcctgctttgcccactttttccctcattgggctctgctgtctctctcccaaaccctccaggagtgtggagactggaagcttggacttagagcaggaggttgacccgctcaacgtggatcatttctcttgcacccctctggtgaggatgacggattcctgagcgcatatggggcagggagcaatgggaacagcccttgaaaaggaagatcctgaggaatgcagggagtggggtgggctggggcctgaagacctgactacctggaggaagagcccctggcctcacctccacctccgtctccgcctgtcccgcccccttcctcagatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtgagggtggccctaatcttttggagagagggatgtaggtaggaggataggccaggacaaagccaaagggtgtgggaaacgagtaagagaggagacaaaccacagaggcagggatgggagataacagaagcaagaacagacggggaccgagaacaggatggggaaggcaggagacttgagcgagggatggccgtggctccggctgccctcactctcttccctccccacacaggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatgga

SEQ ID NO: 84969 - DNA, 2117 bp, Homo sapiens
aggctggagtgcaatggcacaatcttggctcactgcaacctccgcctcccgggttcaaacgattctcctgcctcagcctcctgagtagctgggattacaggtgaccgccaccacgcccggctaatttttgtatttttagtagagatggggtttcaccatgttggccaggatggtctcaaacttctgacctcaggtgattgcctgcctcggcctcccaaagtgctgggattacaggtgtgagccaccgtgcccagccgccaatctctttttttatgtagagtgaagctgctttcctgtttccagagtcctcagcaacttaaccttttttctgttcctctcccttccatgtgttagcatggtttctggagtctcctaggacctcattcccttcctgactgttttcaggggtagggaattggggctgtgcagcctggagaagaaaagaaacatcagggatgtgattgcagactttgagtagctgaaagactgtcttcagcagtggagaagttctgttttatgctgcctttgagaggaaaaggaggaagtacagtgggggtgaattagcccaagaacagaacttccttctggtgacagctctgtggtagctttgggggaggccctgaattcccagctactggcagattcaggtagagaccaggcaaccacttggcaggaatgttggggagagatagactcactgacctcaccccactgggtcctgtctatccctggacccccagactctagcacaggacctgccatatagtagataccctgtaagggtctgaataaatgaatgagtgaggggatgaacgcccaactccagtcacatggtctctgacttctgtctgcagggtggggtcaaggtgctcatcacaggtccttggaccgaagccgccgagcattactcctgtgtctttgatcacatcgcagtgccagcctcacttgtccagcctggtgtcttacgctgctactgtcccggtatgaggattgggaaccgtagggggagggactgacatgtgggcagttaggacagatcaggacctccaggcttccagaaagcactgggaacaaatgggttgttttgagagcacaaggacttcatccagtcctgaggttgagccccaagctctcccagcaggcagaagagcccagacttaggtgtcagaagatcgaggttctggtccaagaagtctactccttagctaaccagtgacctcagatgagtctgatccttcctgaggtccttggcctcctctcctgtaaggttaggcattgaccaaagggatttctaatgtctgtccaggctttctggcttagagccagagtctccaactccaatccagggggaatgagaaagaagaaatgtgggtttcctctaaccagtcttgggactgaaggacattggcttttagaactgtgctgtccagtatggtagccattagccacatgtgcctattaattaaagttaaagaatacttaaaattcacttccccagtctcactgaccatgtttcaagtgttcagtagccacacatggctcgtgttaccctattggatagtgacgatatagaacattcttgtcactgcagaaatgttctattggacagcactggtctagacttcattgccaaggttcatctctgcccttttgccaccagctttgcccttaccctacactcaaaaatcagccttactaggggacctcaaggaccaccaaagtgacaggttggcagctttgctgtctacgagtgtgttctcccccagtctctacagcagcatccagcatgtgtgtaaggaaaggggatgagaccagagaatctggggactgggagaaaaagtctcagcacctggtcttaggatcagggcctgctggttccatgcttatggccactggacactgttcatgagcggctagctcccctttcctccatctcagtaacagggtcataacttccagactctgatccggggatcaagaggattttccaacatcaaattgttcataactagtctcttgaccctcagtttccaaaccttcttgctgaataacaaatatcttcaactacagggtctagaatccaagggatctctggcccatagtacgtattaagttct

SEQ ID NO: 84970 - DNA, 1046 bp, Homo sapiens
atcttcccgagcctgccctcctccacccttagctgggctctagcccgacctgggcttggtggcattgtccacctcagtcccctcccagttactcttcccttctcactcactttgggtcggctgacattgctttggccactctccacttcccatttccctccgtgactcaactatccaggccgtaggccatgcctcccttccagaacactgatgcccaggcccctcactgctcttgtgtttccctcagggatcccagcaatgatgctctcagcacaggtttctcttccccaaatcattgcccctcatctcagatgcattcttgctctgccctctggtttctagatagtcccgtatctcaaatctggtcctcactataaggccccagccccactgctcatctatgactcagggtggctgggattcaaaaggggtggggaataggtgggggcgagggtgggggaagggttgaagaggaactggtggaaagattgggattcctgcaaagggactgaacagaggaagagttggggagcagactagccctccccccaccccagcctgtctcctggcagtgtctctatggctgctacgttcactcttccatcgtccccacattccatcggcgctgctactggctgctccaggtaaggacggaagagcccagggagccaccctcttcctgactctttgagggacacgggtctgaaagaaggaagtgaaaggatggctgagttctgagtgaggaaaggagcctgggaagaagagaaaggggcttggggatggagagagtcagaaattgggggcgaggttaggagggtgcccaggaagaaagtgaggattaggaagccaagcccctggacctcaggaccccatggctctgtgtgtccccttatactctcagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctga

SEQ ID NO: 84971 - DNA, 1030 bp, Homo sapiens
ggctcactgcaacccccgcctcctggattcaagtgattcccctgcctcagcctcccaagtagctgggattacaggcatgtgcctccacgcccggctaatttttgtttgttttttttttgagatggagtctcgctctgtcgcccaggctggagtgcagtggcgcgatctcggctcactgcaagctctgcctcccaggtttacgccattctcctgcctcagcctccggagtagctgggactacaggcacgccaccacacctggctaatttttgtatttttagtagagatggggtttcactatgttggccaggctggtctcgaactctagacctagtgatccgcccatctcggcctcctacagtgctaggattacaggcatgagccaccacgcccggctggaacctttgttattaaccaccactgatactggctctttctggaggaggcacagtccttgtgttacacattttctgtattctgcatacttactgccttgtatgtagttggttgttgatatttatcaatttgatgtcagaagaggactgtcagtaaaacgatgcgtgtatgtgtgtatgtgtgattgttgtaagtgctatagagcgtttaggaaggtccagtgtggtcagcagggcttcatggagcatctgaaaaggggtttggtttatagaatggctatgatttccagatatggagaggtgtgcacatggtacctgccttgtagggcactaacatgcaggaggtaactattcaaagcatgttcaggaaggaatcaatggatccatctggcaggaattgtaggagcaatatgggtaaatagtgggaacagtgaaagtttgatcccttgttgggaagaaccttggagtcaggctaaagaatctgaaactcctgccaggcacagtggctcacgcctgtaatcccagcactttgggaggctgaggcgggtggatcacgaggtcgggagatcaagaccatcctagctaacacagtgaaaccccgtctctactaaaaatacaaaaaattagccgggcgtg

SEQ ID NO: 84972 - DNA, 1702 bp, Homo sapiens
ctttagctgccctctgaggaaggaaggactagggtcggaggattatggaacagagacctggctctgaggccattggtgatgggagatagaggttgactgcaagctggacaaccctctggggtgggagggtcttcgcccctatcagaggcaacgagcctcagtgagtagagcagggctttggcatcagtgagccttgggttcgagcgccagttttacgacttactactgttttacttggtttcataataatttgtgagtatagttctcctgcaggcttgtgtaccaccagcagagtgttaactgtagaaacgccaattgggataacggagttaaccataattgtccctggctgtccagcatagcaacctggcacacgggcttgggagtcagaactcctggggtttgcaccctggctggctgaacggtagcctgtgatcttgggcaagtggggacctctctgaggttgttttcccatctgtgaaatgggaataacccctccctcaaggctgtagcaagggttaaatggggtcacttgggactgggcctggcctgtggctggacactttaggtgtgccctgaacaggagcttctctgtatttccctgtgtccccctccagctctgtgaggacctcttctctcgcgttagtgagaaccagagtgctcagctatcctactctgtggaggtaagcccgggtcttggtggcagggctgagaggggtccagactgctgagggctgtcgctggaatcagacagcctgggatctaatcctggctctgctggttactgactgtgactttggggcagtgattctgtccttcagcttcgtatgttcatctgggagacgctgttgatcggacacacctcctggcttgttgggcaggtcgctgagctagcatctgcagaatgcttcgcactgtgtattagctgcagtcacctggatcgtgtccagtggagtcagattaagttgcgttgtcattgtttttgctagttttgttacttctcatttgcttctcccactcaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggtgaggcaggctgatggagcagagggcaagggggccagggttgggaaggtgagaggcaggatccagtgactgctttctttaccctaaggactgtggctgccaccaacatgaatgagaccagcagccgttcccatgccgtctttaccatcgtcttcacacagcgctgccatgaccagctcacggggctggactcggagaaggtgggatcgcccccccccccactcccccaccggatgcaacctcccctggcaacagggacagtgacatggtagaagggtcttgggccctccctgcccatgctgggttgagtgcctcctcaggactaccatgaccgcgccccacccctaccctgtttttccgtcagatcagtctgtccccctctactgtttgcttgtcttttttttttttttttaagacagagtcttgctctgttacccaggttggagtacagtggtgcagtggtgcgatgtcagctcactgtaacctccacctcccgggttc

SEQ ID NO: 84973 - DNA, 1031 bp, Homo sapiens
gagctgggagggactaattctctaggagaggatgaggatccagaaggacctgtcaggctcctggaagtaatgaaatgactgttacaggaaaaaatggcaatatatgcttacaggtcaaacagtaaattgttaagaggctaggctactgggtgactttcttgacagaagttcttgcaaaacgtcagagttgaagtggaccatagcctaacagatctcagtggagtgctttctggtatgtcatgctcagcctcactgatggaaatagtgtccaaatcagaggatgtgtaatccatgttgacggtcaggaatggaccctgcattcagtcttgagatcatcccattgaggatagttagggtgctgaagggcacagtgtggggagtatgagtgttcttggaaagagaaggataaggtagctagtgatgtttgccttccaacatttgagggattttcttgcagaagagaaagcagtaaggactttttatcccagagggcagaactagaaacactagcacacatgacgtgggaccagtttcagctcagcacagctaagaattctttttttttttttttgagatggagtcttgctctgtcgctaggctggagtgcagtggctccatcttggctcactgcaacctccgccttctgggttcaagagattctcctgcctcagcctcccgaataactgggattacaggcgcccaccaccacacctggctaatttttgtatttttagtagagacgggggttttagcctggcacagtggctcacgcctgtaatcccagcatttggggaggccaaggcaggcaggtcacctgagttcaggagttcgagaccagcctgaccaacatggtgaaaccccgtctctactaaaaatacaaaaattagctaggtgtggtggcacgcacctgtaatcccagctactcgggagactgaggcaggagaatcacttgaacccaggaggtggaggttgcggtgagccaagatggagccattgcactccagcctagcgacagagcaagactccgtctc

SEQ ID NO: 84974 - DNA, 1664 bp, Homo sapiens
acgctctgtcacccaggctggagtgcaatggcgtggtctcggctcactgcaacctctacctcctgggttcaagtgattctcctgcctcagcctcccaagtagctaggattacaggtgcctgccaccacaccaggctaatttttgtattttagtagagacggggtttcaccatgttggccaggctggtctcgaactcctgacctcaggtgatccacccgcctgggcctcccaaagtgctgggattacaggtgtgagtcaccacacctagccccacctaagaattttctgatggtgcaaatcatctaatagtggaaaggactggccgcctccttcagtaatgagctctccacccctggagttcaagtagagagactgggtgcccatttaccatggctgcagtaggagggctccttgcctggtaggaggctgaccagcagtcttctgtagtccttacagactggtcctctgtgaagctcttggtctcctggatgtctctcatcagctccttctttccttagcctcattctttttcctctttctccctcccaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggtgggaagctggagctggcaagggctgggggtctgggcattcctgggagtttacttctccaaagtcaagcttgagaaagaaggaattctaggagtagcatggccccagggtaggttgtccctaccctgggtctgcttgtcccagaccatcctgaaacctacccaccttacgcccccaggagacagagaagattatagctgagctgaacgagacatgggaggagaagctacgcaagacagaagccctgaggatggagaggtgtgagggccgacagttggggtcctgggtggagttggaggccatgggggaggtcaggccccacagggaaggaggtcacgggcagtgaaggtaagactgacatttgcctctcctctgcccacagagaagcattgctggctgagatgggggtggccgtccgggaggatgggggaactgtgggcgtcttctctccaaagaaggtgagtgaggaatcgagcgaggaggcctagagagctctctggatgcctagaaaagaggcagcaggtgcagggtagtgagtgctgtccctgatcgctccctttgaggtccccggcttgtccctccatcatttctgtcccctcccctgccacctcctctccgtcttgtttagtcatccctgccttctcccttcagccattcaacagtcagcctcaggagagggagaggacctgggaaatcggaggttggttgcaatagagcatgcttttgtatcatttgagttttgtattctgtgcatgctcaaaaagataactaaagaaatctatttttcagaaggataacttgggaagacaagactaaagggaatagaggaggcatgagcactacattgtaagacagtggttgccagtgcagcgaggggttggttatagatggaggcacccgtgtagcttggagctatgctgcaactggtttcctggagaaggtggt

SEQ ID NO: 84975 - DNA, 2395 bp, Homo sapiens
ccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccatattggccaggctggtctcgaactcctgatgacctcaagtgatccgcccaccttggcctcccaaagtggtgggattacaggtgtgagccaccgcgcccggcctcccctgctttcatgtttgcttacccagtgtctcagtctgtgccagcagcaccactgtctgttatggacaaagcacagaagcggggatgcgaggggaggtagagggaccgccagcctgtcaatgcttaactggctgttgctgacagatacagaaggatttgtggggtacagaggagttctgctttaagtcacctaacttacttgaaaggtctcccaagcagccagtttctcttgatagtgaatgggttgggcaagcatactgcgcttacctgattgttttcatcctggttgtgttacctgccttctggcaggctacatcattgttcccagtcgttattttatttgtgttaagactgtttgttggccaggcgcagtggttcacgcctgtaatgccagcactgggaggccgaggcaggtggatcacgaggtcaggagatcgagaccatcctggctatcatggtgaaaccccatctctactaaaaataaaaataaaaaaattagccgggcatggtggcgggggcctgtagtcccagctactcaggaggctgaggcaggagaatggcatgaacctgggaggcggagcttgcagtgagctgagattgcgccactgcactccagcctgggcgacagagcgagactccatttcaagaaaaattaaaaaactgtttgttgcctgcttgttttaatgttctggcttgaggcagcgagcccttgactatgccacattgccaggattttgcaggttagattgtactacagcactgcctttggcttgccagactctggagtccccacattttcatcctgttctcaggaaaacactttgacccacttgaagctctgagctactgcttcacagcttcctggggtcagtctccagccaaaaccatagatatcccaactgcagccaaaccacggctctgggcgaaggaacgattaggtttactctaggtttccacaccctgatgctcctgcctttactttgacacctctgactgccaggttttcacagacctgttgacagtgactcaagatctggaatgtaatggatggtttggcaacagtgtttgcttgagcagtttaaaatctggccagggagactcaatgtgagcaagaaaatgatagaataccaagttttctggaggtcagagggagctgagttgagtgttaccgagaatgctgtggggtttgagatgagaaaaatagcttgctaatttaaaagacggattatttttccctaaagaccttgacttatgtaaatgtatattatccataattttaaaaatccacttatggctgggcacagaagctcacacctgtaatcccagcactttgggaggctgaggcaggaggatcagttgagtccaggagttcgagaccagcctgggcaacatagtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctcaaaaaa

SEQ ID NO: 84976 - DNA, 1034 bp, Homo sapiens
atgtaatgaatgtgggaagacctttagggttagttcacagcttattcagcatcagagaattcatactgaagaaagataccatgaatgcaatgagtgtggcaaagccttcaagcatagctcaggccttattagacaccagaaaattcatactggagaaaaaccatatctgtgtaatgaatgtgggaagggcttcgggcagagttctgagcttatccggcatcagagaattcatacaggggacaaaccctatgaatgtaatgaatgtgggaaaacttttggccagaactcagagattattagacatattagaattcatactggtgagaagccctatgtatgtaaggaatgtgggaaggccttcagggggaactcagaacttcttagacatgagagaattcacactggagagaaaccctatgaatgctttgagtgtggaaaggctttcaggcggacctctcaccttattgtccaccagagaattcatactggagagaaaccccatcaatgtaatgagtgtgcaagaaccttttgggataattctgagctgcttctccaccagaaaattcatattggagagaaaccttatgaatgtagcgagtgtgagaaaacatttagccagcattcccaacttatcatacatcagagaattcacactggagagaagccttatgagtgccaagaatgtcagaagacttttagtcggagctctcacctcctccgacatcaaagtgttcactgtatggagtaatctgcaaaataggaaagcttttagtggaaaagctaaagtccaacttattcatttgttcataatatgcaaatatgcaccccaagtattcaaatccaatgaatggacagaacctcctctgtcctcccactgattttaaatagttggttgaagaagatgaggcacttttttttttttttttttaagcattggggtcttgctctgttgcccaggatgggatgcagtggcacagtcgtaactcactgcttccttgaactcctgggctcaaacagtcctcctgcctcagcct

SEQ ID NO: 84977 - DNA, 2200 bp, Homo sapiens
gtgaccccgccgggcggaggcgggggcgcgcgggctgcggcgcgcgagggcggcgcgggcgccccggctgccgtcgctggggagggggcgggaggcgcgggtgcagcgcttgcgggagggcagagggaagggcgtggggaggctgctgggtagcgtggggtagtgtggggagggagcggttctgggtagcgggggaccggcacgtgggttctgcccgtgggggaggatggaaatcgggaacatgtgctatattcgttaaagaaaaaaaatcttagcttaggtagtgtaccctccctgccgccccaatccttgctatagaactctttgcacccagttatgtgacctgaaagtagttgtgtacagtaactggatttagtagcattccctgaatggcagtgtggcttaatggttaagtgttggggcctgggagtctagaggacctgtattcttaaccagcaagctctgggctcatttcttagcctcgttgagcctcagtattctcacccacgaattaaccaagaggttaattcatgcctttatattttatctataaaaatagcaacacgaatgtgtatatacaataatagtattatggaggtattaggaataatgagaatagtgtttgagaatgctgaggcctacttgcactacttgaagatatttgcttgtggaactaaaaaaaaaaaagtgaagtcgaagaaatgtgtcatttatattcttggaaggaaaaaagggccccatcctaaataatcaaagttggttgtcagagcccttcgtgaccttctgggaaattggactaagctgtgcttcacagattgactacatggttccaggttttaccacctagaatagatgtttggaaatagtgtgcttgggcttttccaaggtcccactgtatctagttgtgaaagtactttctggtgtatttctataatcagcgtgtgtgcttagcatctttaagtgtgagtagagtagaatgttgggaaaaggggcttggtacggagtaggtactttaaaacttggctttccttggggttgtctcaaaataacctttcgtgaaacccttactttttatttttgcctttggggaacttgaaaccatgttatcagattttaaggttctggctgctctctgggaaatgtgcttcagagcctgttagcctgtagttttgggtgttgttgcttgcctaaggggagatgtccagtaagcatttagacttttataagaacctgctttgctgtttctgttccaggagaagggaagggaagcatttttggtgggctgtcagagagaggaaactgggatgtcttcaggctgcattttaatgatcaccttttgcatttggtgtcaggcaagaaaactttgttcttccacaatcccactttgttactgcacacagaggcaagatacagagagcttgtggttctgaacaggagtggtaggtatgcatagctggctgctgccttctcttgagttgcatggaaagaaacgtctagggcagctcaggtgacatgaccgtctggaatcaaaattccctgcctctttgaagatatgaaatggtcttccttgtaaataggcagaagtgactaagcacttgaacgaggctagggaaaactagctttaggaaatcttgtattcttggtattttagttcaggtttctttcctatttctcaaatcttgtgactctaggatgagatttagtttgcatagattgcaatttttattttaaattaatgtaggtagccatggctactttttacagtaggagagagataatttggtacgtttgagtgccttgtgtcagtgccttagaagttcatcttggggattttaatttttttttttttctttgagacagtatctcactctgttgcccaggctggagagcagtggcgcgatcttggctcactgcagcctcgacctcctggggtcaaagcaatcctgctacctcagcctcccaagtagctgtgactacaggtgcatgccactattcccagctaatttttgtatttttgtagatacggcgttttgccatgttgcctaggctggtcccaaactcctgaactcaagggatccacctgcctacacttcccaaagtgctaggattgtaggtgtgagcccgtgagtccggcttttggggatttaatttgtgtctttagctgaactcatgtagaccattttagctttaggcacgtttg

SEQ ID NO: 84978 - DNA, 1044 bp, Homo sapiens
tgtgtcattaggaataactgtctgagaccaactggaaagccaacccctagtagcttcaaaagtgaagggttcagtttttctgtgtgttacacgttcacaagtagagcattctaaatttggttcagctgctcaaggatgtcaaagatctgagtttcttcagttttctgctttcttcctctgtgggcctgtttgccacatcattattttttgtagatttagttctgatttctttttgggactatttattcctttaaatcttctactgttttcttagttacatttgttgggttctctacttcaggcacatggatcatccttatattggatagtctgtttctcatagctgtttcctctctaattcctttacttttctttaaaattcactgagattatctcaggtctttttgatgtgtttaacaaaacggattgcattaatggatttctggatgtttgtttttgcgcacttcagatgaactcaacttggttgtgatggattgttattgtagtatgtagctagatctgatttgctaaggttcgagaatttttgcgattatattcataagtgagattggcttgtagttttccattttggtactgcattgggttttggtatcttttttttgtttgtttaaggcagagtttcattcttgttgcccaggctggagtgcaatggtgctatctcagctcaccacaacctccgcctccaaagttcaagtgattctcctgcctcagcctcccaagtagctgggattacaagcatgtgccaccacacccggctaattttgtatttttagtagactgggtttctacatgttgatgaggccggtctcaaactcccaacctcaggtaatccacccgccttggcctcccaaagtgctgggattacaggtgtgagccaccgtgcccagcctggttttggtatcttgattatactagcttggtaaaacgggaaacatttcatttttttctatgttgaggacagtttaagtagtatagaaaatattctctgaacatttgatagaatttatgttctctttcaagatt

SEQ ID NO: 84979 - DNA, 1017 bp, Homo sapiens
catgttagccaggatggtctcgatctcctgacctcgtgatctgcccgcctcggcctcccaaagtgctgggattacaggtgtgagccaccatgcttggcccagattagttaatattctaaatgtgaaatagtgatgactttttccaccgtgtttgcaattgtgtatcactttttgccttagtgctctttataaaaaggcaggtgaggctagccctatttctgagtgtatagctatggcctagagattactctaggcttcatataacaaacccaactacagtggcttaccaaattaggagttcctttttctcccagaacacgaaatccaaaggtagataatctaggcctggttttgtattggttccatgatgtcaacaatgcctcaaactccttcagcccttctgttctttcatccttagcatatggttttcaacttaatctttgcctcagctgaaaaatagctgcttctccttcagtctgcatcagaaaagcaaaaattttctagaagtacccagcatatccctttcgctttgttgaccaagtgtgtggtcactcataactacaagggaaactggacaatgtagttttaaaattgcgcacattgatttcctaaacaaaattggagtcttactggtaaggaagaaggagtggaaattaatgggcaatcaacagggtctgttacctagtggtttttttttttttttttgagatacttaggcttgagtgcagtggtgtgatcttggctcactgcaacctccgcctcctgggttcaggcaattttcgtgcctctgccttccaagtagctgggaccacagacatggcgacatcacacccaaataatcttttcttttttttccctttcccttcccctttccttctcttttttttgagacagagtctcactctgtcacccaggctggagtgcggtggcatgatctcggctcactgcaacctctgcctcccgggttcacgtgattctcctgcctcagccttccgagtagctgggactacaggtgcc

SEQ ID NO: 84980 - DNA, 1038 bp, Homo sapiens
aactattccagaaatatatcccttttcgtatactttcaggtagtgggattggggcgacatgttatatttgccttgggagccatagtatagtgtctaagaacatagattttggagttggccttaagttcgaattctagctttgcttcattctgggcatgaaacattggccagactatttaatctttcctaaggttttctccttcgtaaaataatatatgacacaggtttattgtgaagattagaagtgatgatttaaagcccttatttctgtatataataagaactacaactagtttgtcttgttttttagtgaattaaacattttccagaaattagacgtaagctttttatataactttaaaaaatttagtgtgccaggttatttttttttcataatgcttagatgtgaaatatgtggtgatgttttgtagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggtatgaaggaatgtgttcatttgtagaaatatttgaattcaaatgcaaaatgctttaatattgttgtgtaatagaaagtaatagaagtactttgatatttcctgtgagaataattatttggacacagacctaaacatagtactaaataatgttatatctatggctaactctctcaccttcttcacatttttgatcaaatatcactacttcatggggtttttcccgaccacccgccatttaacattgcaacctgccaacttccctctgccacctgtcactactctcctctcccttatccttctctagtttttctctttccatagcacatatttccttatactacacagagttcacctattgtgtttattgtttactgtctttctttccttgctaaaatataagctctgtgaaggcaggagtttctctttctctctttttttttaata

SEQ ID NO: 84981 - DNA, 1103 bp, Homo sapiens
gctgaggcaggagaatggtgtgaacctgggaggtggagcttgcagtgagcggagatcgtggcactgcactccagcctgggtgacagagcgagactccgtctcaaaaaaaaaaatttatttattatgtgtatttccttttatatatgggatattttcttaattgattaagaagtcaaatttgttttagtgaatcaattttcccatttactcccgaattctaaatggaatatttgggaaaactcagttataccttgacattcaaagtaatgcactatttgaaagttagacattagttcagttttgcgaatattaatatagtgtctggtcaagttacttgttataataatttttagcaaatggaagggttagagtttcttagaaaagcagtaaatgaataagtcgtagcatttaattctttttaaccataggcccaagaggatgctgagaaacttcggtccgttgtgatgccaatggaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgcaaaaaactgctttgagatggttttgctcttatggacatttaaaataatcacaataatgatgttttatcacaagtggctgctttgtcacaaagttaatgtt

SEQ ID NO: 84982 - DNA, 1547 bp, Homo sapiens
tgggtgacagagcaagacactgtctcaaaaaaaaaaaaaaaaaaaaaaaaggaaaaacaggtaaagtatagctaggtggcgcatgcctgtaattccagctacttgggaggctgaggcataagaattgcttgaacccaggagccagaggttgacgttgcagtaagctgagatcgcggcaccaccctccagcctgggcgacagatcgagactccgtctcagaaaaaaaaataaaaaaaaataaacaggtaaagtgtatgagctgtcggttaacaaaagaggaaaccagaatagtcaaggagtgtgaaaagatagtcaacattcaaccacactagaaattggggaaatgtaaatgaaagtgggacatcattttaccctaaccaggttgtaagggttatagagaaattggttgcattcaccgactactggtgtatgtgaaactcttccgtttaaggcactgttgtcacattgtcctcccagttgactgtttttggtttctcatgaccctcattgcttctctgtattttctcctgcatagatcctgataccacgtacatttttctgaataggtggctttcagtggtttgtttgtaccctctccttgtcacctggctttttgtagatgtccatttgttgttggttttggtcattccagggtatggaactcaaagtaattcaaatagtatgtcactattgccatcatcttcccagggtcctgctcagtagttttcaaatattagaaattcattattaattaaaccaaatgtttattccaaaaagtaataactggtagaattagtgggttatataccaccattttaaatctgccatacggactcttttaccatcagctgaattaccaccgtcctcaggtgttagagaaagtatttcatgatagttgcaactttaccattctttgttcatatcatgtgctggactgtcaaccttcagtgaagcatcaaatgattgcttaaatggtcatttaagtctttgactattattgcatgatggcctaggagtaaagataactgaaaacagataagccactttaagtttgaagaaataggaagataaaaggcatgaaaaggaccttgaatgtgatattagatataaccatttgaaaaagttgaaagttaactaaagggttagaatttagaatggacaatttatgtgacagtctaaagtgacgtaatccttgattttctggggaagaattgtattttttttggttataactttcctatattagactatattgttactattttgagtattacacttaattgatcaacagaaaaaaagtattttttttaaagatgtggttttattttattgttattttttggaaacagggtttctccgtgtttcccaggctggtctcaaactcctgagctcaagcattctgcccacctttgcctcccaaagtgctaggattacaggcgtgagccaccacacctgggcaagatgtgattttaaaaagtattctgcatttgcctttaagtcattacagtgtgagactagttatttgttccattataatttcctctttt

SEQ ID NO: 84983 - DNA, 1027 bp, Homo sapiens
ctttttatacatttaaagcatttggaattccctcaccagaagtaaaaggaaagcaaacttaaaagtgtatggtatcgtttttgtccttagaaattaactaccgatttaaaaaagcaaaacatacctggtgttactgttatggctgaaacagatacatgcatatgttgatgtgggaatacaaattggagccgcctttttgaaaagcaagggacaaagctgttatgtgaaatctcaattgtatattttattctggtggtgtgattatggataacatctattaagttattttcccagttttctatagtacatattttataattaaaaattataaatgttaatttatgtagatgtaaaagtaagtgtaaatttttttgaggcatagccagaacttaccatcattctgtatctaagatagaaactgttgtaaatttcagtttaatggaattgcatcttctttcaggttaaagaactgaatcattatctggaagctgagaaatcttgtaggactgatctagagatgtatgtagctgttttgaatactcagaaatctgttctacaggaagatgctgagaaactgcggaaagaattgcatgaaggtaaatatactgtatatttttatctttgtctctaagaaccatataagttaaattgatgttgactaataacagtgacaaatcttaaaataacaatgcaacatgttagtgattcaatttaagccttgtagttggtttaaatgtactcatgcaaagctgaaattatggtttttccttcgtgagctcagtaataacttcacaaggtggctgggtacagtggctcactcctataatcccagcactttgggaggccaaggtgggcagatcacctaaggtcaggagtttgagaccagcctggccaacatggcgaaaacccgtctctactgcaaaaacaaaaattatccaggtgtggtgatgcgcacctgttatcccagctactcaggaggttgaggcacgagaatcacttgaacccaggaggcagaggttgcggtgag

SEQ ID NO: 84984 - DNA, 1050 bp, Homo sapiens
gatgtggaccattggtcagacctgggctaggagccctgtgctaaagaaattgcctaccattggccgggcgcggtggctcacgcctgtaattccagcactttgggaggccgagacgggcggatcatgaggtcaggagatcgagaccatcctggctaacatggtgaaaccccgtctctactaaaaatacaaaaaattagccgggcatggtggcaggcgcctgtagtcccagctactccggaggctgaggcaggagaatggcgtgaacccgggaggcagagcttgcagtgagccaagattgcaccactgcactccagcctgggcgacagagcgagactccatctcaaaaaaaaaaagaaattgcctaccattaaaattcagtgtttttgatttgtggtgggggggttcctaaacagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggtgaatagaagtttttaggactgatttgctttgtcagtaatgtcccccaccacatgtgattgcattaccttatgtgtattagagactgacttaagctgcaacaaggtgataaaggtgatatgtgccacttttaaaaacataacagctacatttgaggggttttgtttttcatctttagaaatggcctcctctcgggggtggggaaactgatttggaaatgatcttcagtgactgcaggatgcagcagtgcgtatttcggagaaaatctttctctcctgtgctgaccagttctcccaggccaagtcttgaggtcaagcttgtccaacctgcagctcttggctttgaatgcggcccaacacaaatttgtaaactttcttaaaacattatgagattttttttgcaatcttttttgtttgttttagctcatcagctatcgttagcgtcagtgtattttgtgt

SEQ ID NO: 84985 - DNA, 1050 bp, Homo sapiens
atgtggagaggatgaggtgggagaattgcttgaacccaggaggttgaggctgcagtgaaccatatttgcaccactgcattccagcctgagtgtcagagcaagaccttgtctcaaaaacaaactttttcatatttattttctacagtaatcacaaggaatgttctgtgtaaattttttttttcaaggatcatttgaagaggcggttttgctttcttttattttgccttactttatacagtatacttttcttggaagctgcttcctgatttcttctttataccagtgttcttagtttgtgcttataatattaaaatattttgtaatggccagaggcccttagatgggattacaaaacaaagaagcgtaagtatccagttttctcttatcataacgctctgttctttatttgttttgaatggttaaagaactgtgtcacttattaagtaggttacttgggtcatatatatgtttttttcttccttttaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggtatagtgagtctataattaaagtcattaaatacacaatgtcaacaattttagcttactcatacatcagttaattacattgttcatatgagaagtgagaagtgcatagctacgaggtgaaagttagataaaaatgacagtattttcagttgtttttatggcattataggtagcactatttgaaacatgttgcagcttcattcgctgtctgaaatagatgttcttttttccagtatttccaaaatttaatacattagaataaacctttaaataatgtctgcaaaatcttttttgatgtgaatagtacatgttgctaatacttgtcttttttgtttaaaaagagattatctaaagcgctgaaatgcttaactccctgtagcatatatgagagtattaaccagtattaggttttcatccctgacggccatgggtg

SEQ ID NO: 84986 - DNA, 1051 bp, Homo sapiens
gggaaaacaggaaagggacatttgttgtgatttacagagaagtatttttatttttgattctctcttaacagatccgtagactttcagagctggtgttttgcagtttgaatgttgaatataattgttttgtattgagaataatgacacaactcttggtttagagttaatctgaagcctagctaacatggtgtgaaaccctatctctactaaaaatacacaaattagctgggcgaggtggtggatccctgtaatcccagctactcaggtgactgaggcatgagaattgtttgaacccgggaggtggaggttgcaatgagctgagattttgctactgcactccagcctggatgacagtgagatcctgtctcacacacacaaaagttaatctgagatgctttggagagttggatttatggctaaagatatttgaaatttgtagacctcacattttctttaacctgatgcttataatatgcttttctctctacaaaatgttcattatggaaaatttgggaagtatagaaaacaccattcaaaataaaaataactgatagatcatcctacccagaggtaacaactaatattttggtatgtatctctttcttcctttccttattttcttttccagagataatatatatgttaacatatgttaacatatttcttttttttttttttttaatttgagacagggtctcactctcacccaggctggagtgcagtggtgcaatcttggctcactgcagccttgacctcccgggctcaagcggtccttctgcctcatcctcctgagtagctgagactacaggcatccgccatcgtgcccagctaattttttgtagagacggtgtttcaacatgttgccccggctggaacacatgtgtttctatttgcacttttttttttaaatttgagacagggtctcactttcacccaggctggagtgcagtggcgtgatctcagctcattgcaacctctgcctcccaggttcaagcgattctcctgcctcagcctcctgagtagctgggattacaggcatgagccaccacgc

SEQ ID NO: 84987 - DNA, 1731 bp, Homo sapiens
gaaaataccacattcttgggccgggtgcggtggctcacgcctgtaatcccagcactttgggaggctgaggtcgggggatcacgaggtcaggagagcgagaccatcctggccaacatggtgaaaccccatctctactaaaaatagaaaacattagccgggcgaggtggcgggcacctgtagtcccagctacttgggaggctgaggcaggagaatggcgtgagcccgggaggcggagcttgcagtgagcggagatcgcgccactgcactccagcctgggcgacagagcgagactccgtctcagaaaaaaagaaaatactacgttctcgtcatttcctttccactactctggcttctcctttgctcatccccaagatgttaatctttctcagggttctgcccttggccctctttgcctacacactcatcctacgtgttctgatttgctgctgtgactttaattatcattatacgatagttactctcaagtctctatcgaaagacttctgtgtccctctgtcaagggaatatctctgcttggattcatgataggcacctcgcgcttgacacacgccacactgaattgcaggtgacgttcctcaactgttcgtatttgggagctctttgagctaccagagcattcagcacatagctccagcccatccttttatcacagtattataacagtctgcttacttatcttttttttttttgaagccgtatgtatctcgaggtcagggattatatcttgctcacagttgtatcctgagggcctggttttgtgtccagcatgtagaaatgacacttagtgtttgttcaatgagtctgtgaaggtagcacattaatgattatcatgtgtaatgagtggcggaatacatttattatagtttttgtctttaaaaacgcagagaattgtctaacttggccatatgtattttcacatttcaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtgagttacctttctcacgtttttcctcttgctcacgctgaggcacactgggaagctctgggatttagcgttcattcaacagacggttcctggagtcagtgcaggcacatgttgccagcaagtggatattaacgtgtgtcacctgacccttgtcatagtctgccttgggtattccaggtaattgtgacagagaaaggagctagctagttaatcacagtgaatgtgaacctccccacctgaactcacagctctcaggttggagcaatctgcctgactagcattgcggaatttaagttagagcaacctggatttggtttg

SEQ ID NO: 84988 - DNA, 1213 bp, Homo sapiens
attataatgaggcaagtggggcatggttatctcccatttacaggtgagaaaactggctgggaaagataaagtgagttgctcaagtgttccctttgacttagtcgcaaaacctgactcctggtgctttccttgactgagggctgcttccctttaaggaagccaccggtcagtaagtggaacagcttactgaggcctgaaagaaactattctcattggtcttatgtaacacatacgtgagaaggtgctatttactagtttggtacctattttataattggagctggtgaaacggtgacttggcactgtttttatttgtctttccttccctttggttgtttagtattataccatgagtgccatgggatagtaccttttgcttgctttgtgttttcctcacatgtgatgttttgtgcctcttggcgataaattgtgtcccatgtgtcctatcatacttgtactggagagtttgattttttagaatctgaccctatattgtaactttttgccgtaaggccctgaagaaagtgtttactgcatgttctactgactaccattggtaagactatgcacgtgtacctcaagtgtgtgatgtagaattgttttgcctgataagaggtaattttggtgcccttcaggtacataatgctggaaataaacttggtagacgttgtgatatgtgttccaattacgaaaaacagttacaaggaattcagattcaggaggctgaaacgagagaccaggtgagtttcttctggatgcgccaaattggatattgtcgttttcattggaggtgcagaattaattgcccccctctccggccccagccccatttacattatgaagcatatccatcttgttaagttatgaaataacctggtacatgcaatggcagttacatttccagtgggagctcactaggactctgctttttttttttttgtttttgtttttgtttgttttttttgagagggggtctcgctctattgccaggctggagtgcaggggggatctcagctcactgcaacttccgaccccctggttcaagtgattcttctccctcagcctgccgagtagctgggattacagggacacgccaccacccccagctattttttgtatttttagtagagatggggtttcaccatgttgcctaggatggtctcaaactcctgacttcatgatccacctgcctcagcctcccaaagtgttggga

SEQ ID NO: 84989 - DNA, 1079 bp, Homo sapiens
tctttgttaatgtatggctgcatgtgactcgggttttggcactgccttgtgttatctgaaaggccaaggctttgcacatagcagatgtgcatgcagctgttggatgatggtcagtggttcccatgaacaaataaaatgtcaattccagacactaaatagttagaagatggaagagttagtttcagaataaccgatttcctaactatgtttctatacatgtgtttttttaaagatctctgcactcgtcctaagagcccaggcctccgagatcttacttgaagagttacagcaggggctttcccaggcaaagagggatgttcaggaacagatggtaagtttacattttaagtaaatgacaactatgttactatatattccttttttgttctatcttgacatcatctttgataggaatttatcatcctgtccaaagtagttactgttgtcttctcccgggactgtagaacattaataatggacaaaatattgtaaagacattattccttttttaaacctactttctggccaaacaaaaattttttctcatcgtttaacttatttttctgatttgggaaacctaaacagaataaactatggacctaatttaatttttaattccaaataaaagctaaaaaattgaatgtctgagagccctagctggtacagcttttgaccagtcattttgtgattttcctggatggctaatttatttagaataaccttattagggctgggctgaggcgggtggatcacgaggtcaggagattgagaccatcctgtctaacatggtgaaaccccatctgtactaaaaatacaaaaaactagccgggcgtggtggtgtgcacctgcaaatcccagctactcgggaggctgaggcaggagaagcgcttgaacctgggaggctgaagttgcagtgagctgagatcgcgccactgcactccagcctgggtgacacagcaagactctctttcaaaagaaaaaaaaaataaccttattagtttcacaggggttatgaaaaaaaacatgtaactgttgtggtgctggggaccttccagaaggccatctatgctgagagggat

SEQ ID NO: 84990 - DNA, 1050 bp, Homo sapiens
ggcctcagcctccctccctagttgctgggattacaggcaccccgctgtacccagctaactttctgcattttagtagagacagggtttcactgttttgcccaggctggtctcaaactcctgagctcaggcaatccacccacctcagcctcccaaagtgttgggattacaggcgtgagccaccacacccaaccaaaagatagaatttttaagcggtttgtagaaacagtggagaatgagcctcagatacttgcttcattgcctgtcccttgttgaatatatgctgtaaaccagaaaatctctgtgcagctttttctaagtctagcagaacttcaccataccccgtccatcctcagcactcctttagtttggacttgtttttctctggtgtagctatcaccagaccggatctacctttctggctgtgattagtatctacttctattttaggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggtaacttactttccacatgatcaaaaatgtcaacaagtacgttttctgaaatggccgtatgttctttatgtaaacagttttattcagatataattcacgtgccaattcaaccatttaaaatgtaccattcagtggtttttgctgtactcacagatgtgtgcaaccatcatcacaatcaattttagaacattttcatcacctcaagtagtaactccctgtgacccgactacaccagctaaacacacacacacacacacacacacacacacacacacacacacacgaaaaagtaacacttcgccctttagctaccatccttattccccctcctcccctagccttaagcaactactaacctttctgcctctatagatttccctattctggactttcctatgaatagaatcatacgatatgtggtcttttgtgtccatgttctttcacgtagccttaatgttttga

SEQ ID NO: 84991 - DNA, 1965 bp, Homo sapiens
ccagctaattttgtatttttagtagagacgggtttctccatgttggtcaagctggtctcgaactcctgacctcaggtgatctgcctgcctcggccttgcaaatgctgggattacagttgtaagccaacgcgcctggccgaaaactcgtctttttaggagttctgtggcctctttggcaattattcatagataggattctcagtacttgaacccagaaccaggggaacgtgattcaatgggtggcatttccctgcagagatgtgatacatgatctagaggtagtttatgacacagtgtccatttgcatggatcctgcttttccctgagcctaaatatgctgattgcttggtggtaattttgagacagcccccggaacccatgttcagcatacatttgaatcctttggggggtgctctaaaattttaaagaaaaaaatgttcatgcacaataatagatgaatgctaatacatctcatttttttccttctagcttctatttctagcctaaaagctgaattagaaagaataaaagtggaaaaaggacaggtaagtcgtgagtttcaaattaattctatcagcaaccagtggttatttactgactcctactatgctgcacccaacgaataaaaaatagttaaggcatgggccctgccttaaggaacttttgtcttgtgggaagaaaaccacggggtaagggtgtgctggtgatttattgagagtgccctgtgtgtcaggctacgttaaactggaggaggtaaggctaagatgtgactgtggcctggagtttccagtgtagtgagaagataggcaaggcatggtcataacatgttatatgcttagaggtacagtagaaatatgtataaaaaacattacaaacaagagatgacattttctagctggcttagtcctcttagacatcattagttcctttcatagtaaccccattcaacttcctgacctcactgttccttgatttagagattttcacctccaccctgctctccccttccacacactgggctgcattttgcccaactgtgacatctcactgcagccttaagttccttgaccacaatctgccatccttccagctcttccatcggagtacctcattcagacctccagttctctgaacttcccctttcattctggtttcagcagcttcatggcttgctttctttcccctaggttgcatcttactggcctgcctcttcccttcatctcccaccacacctgtccctatggtctttgactccttgtcctgctgctgccctcacctgaccactgcccaaccttggactagtcttgctgtccccagctgctgatgccacgagacttggtgacactgcatgctcaagctgccagatgggcctccagtgttcctcatgcagcctttcatgtgtcctaagttgcgtctcttccattcctcacagtggcagtttcagagtcacctcacctcagccccctcactctcagcagatgctggcctcactcctcaggcatcaggcagggccaccttcagctactgggctcctcaattacaggttttccttttattcccagtcttttctttttcttcagagaatatcatgacctgcttctgaccacagtgtcattgcataggtgctttgactgagtatctccgacttttccagatgtccccgcgcagtgccgggccttgaacttctgcctcttgactgatcttttccattatgcatgaacaggctcaggtgtctcatattcagaaggaaaaagtctgtctttggattgcactcctctcccgagctaccactctttcttcctccctctgttgccacagtcttgatcatcatcactgcctgacttcccaggcatccctccacctgctgcagtctgcctcctgcctccactttgctactgatattgcaccagcagaaattaccagcgctcgaaataacatctcatcctttccattctagctgccact

SEQ ID NO: 84992 - DNA, 2115 bp, Homo sapiens
tgtgctgtaggccagccgaacatgccactgttgctgcatgtgtttttagtgcgtgccatccattccctcttattggagtatctctccatcttctccccttgtcacccttgtctttgccctgtaaaaatgtaggagtcaaatgtcatctcctctaggaagtcctttgtaacttttctggcagaattaaatgcttctttcttcatcctttacatgtctgtttaccctgatttctccattttgaggccttagaatatagtaggcacctaataatggttaatgaaagaatagttcaggaagaatacagaggggatccacagagctgaaagggtgagaggagtattcccagtgtagcccgagtgtcttggtgtaattctccaggctctaggctcttttaggtagtgcactggggcccagagggagtttctgtgagtttcagctttttcctttttcacagttggagtccacattaagagagaagtctcaacagcttgagagtcttcaggaaataaagatcagtttggaagagcagttaaagaaagagactgctgctaaggtagtgttttcattagtcatttaattttaaaaagcagggctaagaatgcaggatcacatcttgcttgttgaaaaaaaaatattggtgctttgaagtgtcaccttttaaaaagttggcaaaactgacagcttgtgaaaagaaaaaacttaaacgaattgatctattccagctgggttaaatcttttctgccaggtctggaggcctgcgtcataggctagcttcagatagtaggcagtcagggccattgaccaagcctgggcactgcccagttagaagcactgctttgaaaatgtcattccatttgactgatgtatcaaatcctaagagagattgcatcaaaccaggtttgctgcctaaattttgatgagttccgttagaataaacgtgcatgttgtgggggtagtttcctagaaatggtcttagtgagctgagtggtcagacctgaaagtgcagacagtgttgctgaactgcttgtttttggaaaggctcccacacatcctgctggttttctgtaagagagactggggatagctggggcgtattcactaagtttcctggtggatgcttgactgtggaggttgtcagaggaagtcctgtatgtatccctgttggtgtgacagacaccgatcttagcagctgttttggtgattatcgtcactgtcaccagctgctgggggtgggggagggcagcactttaatccatttcttcctttggcttttcatacccagttcatctcaggacttagagcaagtagtctagatggcctgcacgcttgccctatagataaagagattggtcgtgtataggagtgcgacggatatccacccacctttctgccctagtagtaggtaactacaagttactggatttcctaagtaattcggccctttggcattaatcttcattcaaaacttgtattttttaggctaccgttgaacaactaatgtttgaagagaagaataaagctcagagattacagacagaattagatgtcagtgagcaagtccagagggattttgtaaagctttcacagacccttcaggtgaggcatttggggaaccacatacagagcacgaaggcagttttgggggacagaaccttgccgatccctgacttgaccactggcagtagctagaggtttagagactggctgctcctacctccaccccaaatgtctgactcatcattcaagccagaaacctggtgtgttcttcacacttggcccatttttctttttctgtatgccttgccaattttgcctccttatgagtaaagtactgactccttagcataccatgtaagactcttcccaaccaggcccacccctgtattttgctcatctctctgccttgttttacatgtttaactgcttgtggttcctcgcccacagcgtggtgttctgtctggtaagcatcctcatctcatcccctcctgactcctttctttcaaggctcagcgtaggtctgtcccctctgtggagctcttctaggtccctgagctgggctaaagtgcccctccctctgccatgctccctcgggcactctatgaatgcctgtaatga

SEQ ID NO: 84993 - DNA, 1930 bp, Homo sapiens
catggtggcgtgtgcttataatcccagctacttgggaggctgagacaggagaattgcttgaacccgggaagtggaggttgcagtgagccaagatcatgccactgcactccagcctgggtgacggagcaatactccatctggaggaaaagaaaaagcaagcaagccaggtgtgatggcaggcacctgtaatctcagctactcgggaggctgagacaggagaatcacttgaacccgggaggtggagactacagtgagccgagatcacaccattgcactctggcctgggctggcctggatgatgagcaaaactctcccccccaaaaaaaaatcccagtccgttacacggtagctttggggaattatttttaaaatttttaattgttcttgctgtctccctttgaagtgactagtactctggtgagttaatctgctacatctcagctaaaccagtcaaagttcagaaaatctaggcaggagccacctgtagttatctcaccattgtttctccaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatatagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggccattggctactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtg

SEQ ID NO: 84994 - DNA, 1040 bp, Homo sapiens
atgaggtcactatggacttaccctaaagatcttctgtacttctctcttccataggacaaatgataagtactacatacctcatctcttgggttattattgtagtcttgcattcatggttatgaatttaaaaataaataccaattatggaaatagtactaaaggcttgccgcacatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattgacagtcactcagccatttctaagcagatatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggac

SEQ ID NO: 84995 - DNA, 1851 bp, Homo sapiens
gctaggtgtttgtgctgccttgatcttttagaaaagaactggaaatggcagtcagaaatgctttcacaaatcaggggcattggaataataagggtgtagcttcccaaagtgaccttttcaaggtggaaaacatgcattcttgcacttttacaaaagttacactttattttatattctgaaagttctggattaatgtggtttctgctttcctgtaatacagtaaatcactccatggtagaattcaatttacttacttattttgcagaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaagtatgcaaccttgggcatagcggttttatgaatgggttctcttctgtcttcagaattactgtgcatcctttctgtcctcatctgtttcatatactttttactgtgataaatttggaagaaactggatatatttgatcagctagtgaatggggagcaggagggaagtggcacctgagaatgataaacaggaagtgtttaaaaagaagttaggctaggccgggcgtggtggctcacacctgtaatctcagcactttgggagaccaagacgggtgaatcgcgaggtcaggagatcgagaccatcctggctaacacagcaaaaccccatctctactaaaaatacaaaaaaaaattagctgggtgtggtggcagatgcctgtaatcccagctacttgggaggctgaggcaggagaaccgcttgaacctgggaggcagaggttgcagtgagctgagatcccaccactgcactccagcctgggcgacagtgagactcgtctcaagttaggctgggcacggtggcttacagctgtaatcccagcactttgggaggcccaggcaggcggatcacctaaggtcaggagttcaaaaccagcccggccaacatggtgaaaccctgtctctactaaaaatgcaataattagccaggcgtggtggtgggcacctgtaatcccagctactcgagaggctgaggcagaagaattgctcgaacctgggaggtggaggttgcagtgagccgagatagcaccaatgcactccagcctgggtgacagagcgagactgcatctcaaataaataaattaaaaatataaaaagtttaaaaagcacctgtgacttgagtctatttattttcagttgttttactcagctaaggaaaataaaggtagaaactttgtttttaagagcttctgaaaaggacatagcccctcctcctgaagaatgccttcagctcctcagcagagccacccaggtgttcagagagcagtacattctcaaacaggacttggcaaaggaggagattcagcggaggtatgatgtcctgtgttcacaaaccatcgatccctggctggtagctgatgctgtatggtagcctagacctggcttctgaataaactctatttctttttgtttttaaagggtcaaattattatgtgaccaaaaaaagaaacaactagaagatctcagttattgtcgagaagagaggtaagtgtcaaaaataagaagaatacaataggtcagtaagactggaaccatattctcaccctaagatgctgagccacattaggtggtttcagcatcaaggggtggacctcaagagtctcttgtgtcttacatcattaggaaaagtctgcgggaaatggctgagcgtttagctgacaaatatgaggaagctaaagaaaaacaagaggatatcatgaacaggtcagtgggct

SEQ ID NO: 84996 - DNA, 1217 bp, Homo sapiens
gatattatgaatgtcagagtagcggctacttctctggggagtgaaaggctatgaccagggaaggtcgcatgggaaccctgaggccccctgcagtgtcctgattcttgacctggatactggttacatagtgtatagcccagtagtgtgtagatttcacactgataataaaaagttaaagtttacaaccttccagatatcgtctccatgtcttgtccaaaaaggtaaatgggagctatggaaggggaactagtgttttcaactgctgtttaaagactgctggttctaaagggatggcgagaaagaataggttaaggggaactggacattatattgaaatgagagtattttaaatggaagagacatgagtttgcaagctgaggggaagtagataatagggagattttgaaacgacacagttgatggtacaattttcagaaggtgtgagaggaggcggcatccacattcgggggcagatgtgtgttgtaggcatgcaggtgggatgggcatgggagccgctaggagagcatgttggcagaatgacagttcccatctgaggtctcagtttccagtgtcttcactgaagtgggaaggaagactgagagagatacacgctgtgcgtgccaagtgatttcctgtgacattgacattgggcctcattgagagagactcggtagttctgttcattcaacagtttctaagcacttaatttgttagcactgggctaggcaaacaaagatagctggggcttatgtgcaagttggagagatcttcagtgtaacgtgtaacttttgagattacagtcagcagcacgctacagttagggattcctgagtgacttagtcacatgggctctagactttagtgtggagctgcattaaaggtttccaagccaccacttttgaggttatggtactgataggatgtcccaagcaacttcagcccaggcctgagaaggccgcggacctgtcatgtctttgctcttggttccattgcatttgctgctttgtaatttaactatgactgtgtttttccaggcagccagctccaattcgaggattttggattgtacctgacattctgggacccacgatgatctgcatcaccagtacctatgaatgcctcatatggccgttattgtacgtcccattttatattctccacacagctcttgttaattctgcaatatctaagttgggaaaatgcactcagtaaccaac

SEQ ID NO: 84997 - DNA, 1020 bp, Homo sapiens
ataaatgcagcagaaggttaagtgcattttggatttagcaaatctcacaggtgacctttgccacagtagcttcagtggagtggtgaaagcataaaccatagtaaatttagggcaagggttttcaacctttgtactattgacattttggtctgaattattgtttgttttagaggtgctgtgctgtgcgggaatgtttagcggcttctgtctagcctctaaccactagatgctaatacctccccccacattgtgacaaccagttgtgacaagccaaaatgtcttcagacattgccactgtccgctagggcaaaattatctctggttgagaaacacagagtggtgggatctgagtgggaaagcgagaagatggagtattgggaatacactacatttataatgaaggtatgatagctggaggaaaacaaagtcaaagaatggttttatgggatgagcatgcatactgtcaacatttcccaaatatgtttttactccttctttagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacggtaagtgcaggctgctgtggttgtttgtatcttcaacacctggcatagttcctgacccaatatgaatgcttaatatatgagaaggaattttaacttacttatggaacttctgatattttggaaattaaacagttaaaaaagtagctgaagcacacttagcagtctaagtggaaagaagttagaaggttgcccaacttacttggtccaccagtctgcatgttactttctggtctctatattgcaatcttcagggacagatacaaagagccttggaatcactgaattggcttttttcacaaacatcttcctaaaggaagagagacgttttgtctt

SEQ ID NO: 84998 - DNA, 1149 bp, Homo sapiens
tttttttgagacggagtttcgctcttgtcgcccaggctggagtgcaatggcacaatctcggctcactgcaacctccgcctcccaggttcaagcaattctcctgccttagcctcccaagtagctgggactacaggcacctgccaccacgcccaactaatttttgtatttttagtagaaacggggtttcaccatgttggccaggctggtctcgaactcctgacctcaggtgatccacccacctcggcctcccaaattgctgggattacaggcatgagccactgcacccagctgagaatttttaaatgttaacattcttcataatcattttttgtcttttcagtccattgcctacaaattccatacatacccacctcctgttattagacattttgtgtttttgttttgttttgtttttctttttactttttgttgtttttgtttttaacaagttggtttttacatctctttccagaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacaggtaagttgaggtggtcacccacctgaaatgaaaactcagtttgggctccagtagatatcattgaggctggacttgggagccatgtttttgagtctgtggaaatgttgcagccttcacatgcttggcttgcatatttttgagaaagagttagtacaggtcatttggcctttcatttcttcatattatttgggtaagttctatagaattcttggataatcacttatgataggcctggatttgtgttcacaaattctagttatccgaacaagtgcttattgtttatcttatatgaacaagacaccacgtaggcgtggtaatctggtatcttatgtcccagttgtggggagaaagatacatacacatgaaaaaatactatccataccacagtattggtacacagacagtaagaaccccgaggaaggagagatcattctgactgggaggttaaggaaattttcgtagagaaggagtggtgtcatgtgtgacttaaaggtctcatt

SEQ ID NO: 84999 - DNA, 1050 bp, Homo sapiens
attgattgaatagatgccttgaatgtcctctcagcatgatttcagggaaataaatctgaaggaaagagaatcaaagagtgttaaaatagaaatttcttcagggcctggcgtggtggctcatgcctgtaatcccagcactttgcgaggccgaggtgggcagatcacctgaggtcgggagtttgagaccagcctgaccaacatggagaaaccccctctctactgaaaatacaaagttcgctgggcgaggtggcaggtgcctgtaatcccagctacttgaaagactgaggcaggagaatcacttgaacctgggaggcggaggttgcagtgagccgagattgtgccgttacactccagcctgggcaacaagagagaaactccatctgcaaaaaaaagaagttcctttagaagattttcatccaagttgtacaaaatgttttggaaaattattatctttattttagtaccactccagttgcggagagatttttcaccagttccacctctctgactctaaagcatgctgcatggtatccaagtgaaatcctggatccccacgtagtgctgttaacatcagacaacgtaatcaggtaaattttatttctctctcttgaagccttgcgagtgggaaagctctgtttctgtttgccaattaacagctcaacatagaacgaagtgagtcattgaatgagtcagtgcttttattggatggctgttgtaacccattctcaatcataagaattgcctaactgctctaacttaccactattccttctcaactagtcttcctgcctccaggtatctcctctcctaatctgacaccttagaataatctttccaaaactctttcatcattgtcacccttttggtaataatgtagcataaaggaaagagaatgtaagtgtaaatttagagatttgaattattgtcccacctccttttctgttatctttgagatcttgagctttttaggggttggggggctcagtttccaatcttttaaattgagcaggtttgattcaatagtttctaacgccccttccaagctttgca

SEQ ID NO: 85000 - DNA, 1046 bp, Homo sapiens
gaatttataagctttcagtaaatattggtgactatctcaataaccttcactcctccaaaatctcaaaaccttagagatggggaagaaagcagcttatcatgagttgtaactttggatgttaaaagcaagcatgagtaagctgggtgtggtagctgtagcctataatcagcactttaggaggccaaggtggaggcaggtggatcttgtgagcacgggaacaggtgttcagaccagcctgggcaacatgacgaaacccccatctctacaaaaaaaacctttttaattagctgggagtgatggtgcacacctgtagtcccagctcctctggaagctgaggtggggaggacacttgaacccccatagtaaagtctgcagtgggctgccactgcactccagcctgggtgacagcaagactctgtctcaaaaaaaaaaaaaaaaatttgtgagttaatggtacaagtgtgagtacttatccagagttttattatcctataattgtagtaaactaagtattactgtgatttcaagtaactgccacctatatttaaattaaaattaactatgttgactggtttgctctaattttcagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtaggtaagttgtatactatttatctgtataatttattatatatacagaaaattgttcaagactagtggttcttaagcatgtttagtatactactcttaaaacattaaaacactcctcgtggtctgcagactggcttctgtgttatcaatgttcatagtatatgtgtaattgattgtactttattctgcctgaagtaccacgttgctgtctcatttgaggctaggccattctttcgattaggtagaagtaagattttgtaaaaccagttatctgtcagccagaagtttgcc

SEQ ID NO: 85001 - DNA, 1802 bp, Homo sapiens
gctttcccagccaccccaactagcatctccctgacgttggacccagtctgctcccagagctccgcatcagaggaaaagctgctgctgttattcagccataaggatggccaggttccccagcctttgaccctggtcccttatgaagactcctggaacagtcaagctggaaagagatcttgaaactttaggaaagctttgcagtgtacgggtggaggaaaaggcttggaatgttaagggactgatataaactcagttaattggcacatagctgaggctggtatccacatttcttaactgaaaacccagtgtgttatttaaccaagcagggtgccaacagaagtgagatcaagctcttcatttgggaatagtatggcataagactattcaaatggctacataatatcctaatagtggtggccatcagacactctgaacagagatccttgatccagccatccatctccttccagcagcagcatgtattgacttcttgtttccccagcctgaactgacatcaactcccaatttcgtggttgaagttataaagaatgatgatggcaagaaggcccttgtgttggactgtcattatccagaggatgaggtatgcaggatggagtgctagcctcttggcacccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggtgagtgcttgataaggtgggggaaccttttgggccttggaaggaagggtcctagttcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggcctaggtttaaacaggaaaataattagcttaaattgtattctagtcatgaaagatatctgataaaagttgtaatc

SEQ ID NO: 85002 - DNA, 1001 bp, Homo sapiens
gggcagtgtcagctggctgtggccatgagatgcccagtcagcacatggcagtgagccctggggtactggccctgttgggagtaacccatgcatgacttgtttggctgagataaactgaggccagctttggcttccagcagctggtacatggtaggcacacttcagacctgctgagtcactcaggattggatgtaggcacccagcctagtttgaagttctgcatataattcagccagctaggacagagacattgtttcaatacgcctttttaactgtagcagatttccatgtttatgtgttaacctgctcggttaaaaccatgccttgtctgttttgccttgtctgttttcccttgccgttttagaatcacggtcactttcaacattaacaacagcatcccaccaacatttgatggtgaggaggaaccctcgcaagggcagaaggttgaagaacaggaggtaagctaatactataatcagcttttacctcagttctgacaggctgtgcctggggcttagaggaggagcgtttttctttggtctttcaaaaaaaaaaaattcctctaagtccagtcgcatggctcacgcctataatcccagcactttgggaggccgagacgggcagatcacgaggtcaagagatcgagaccatcctggccaacatggtgaaaccccgtctctactaaaaatacaaaaattagctgggcatggtggcaggtccctgtaatcccagctactcgggaggctgaggcaggagaatcgcttgaacccgggaggcagaggttgcggtgagccaagatcacaccactgcactccagcctggcgacagagcaagactctgtctcaaaaaaaaaaaaaaaaaaaaaagagagagagaatggcaggggcataagagactttaactggatcatgcctactcttcaaacatttcaggaagtgctgtgcccagcctagtaaccagccagtatgagggccacagagtccctagacattctgcccaag

SEQ ID NO: 85003 - DNA, 1155 bp, Homo sapiens
caacattatcacagaacattgtaacaagggctataggagttacgacccaggaactgtggatgaaaaccaatacatatatatatcataacaccacagcctcctagaggaaagtgaccgtggaagggtctggtgagagctggcgggagacaagagtgcattccacgcagcccaaaagccttgcgtgctttgagaacagcaggtggaaagtgggtaagcggccactagagggaattaaacagcttcggacagcggactcggcagcgcagcaagaaagctccggaatccggattcgaggcttcccgggctgcaccggagtctccagcagagggcgcgattccgcccgctggccttaggtcgtcagagcgccggcgcgggaagcgcttccgggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggtgaggtttagcgggccgggggtgtggtttgcgttcaacagagggaaaacgtagaccaggaatagggcctgcaaccgacctctgaggtctgggacatttttccattgattggcaaccagcgggctaaacccacgtatgatcatatttcccccacctcccctatccagcagtttcgttttcttttggtagggggtgaataaaattaaatactagggtacctttttccttagtcttattctatcgaaagtggacctttgggaaggcccatggtcgtggttgaaaatagcatagttatatcgtttggcaagtggaagaggattggaaattctcctggtttatagcggaaagtggtaatgcgttcattgttggaaatcacttttccagaatcaggctcagcttcctactactattatggtatttttaccgataaggaaacaggcttc

SEQ ID NO: 85004 - DNA, 1131 bp, Homo sapiens
atgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccaggaactgcctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtatatgatgtgtgtggcttgtttcttgcatctcttttccattattcatagaaaattatttagaaaatattaagtgttagtcttaccatgagttagtaagacataccttcttagtagcttatatgtcctgtatatcctgggaaggtaggattgttgatttttaataaatctgaaccctgtctttgggttatattaatttactggagaaactcacagaactcagggaaacacatttaccggtttcatacaaaagatatgaccaaggatacagataaggagatgagcagggtggggaatggggaagaagctcccagcctccatgccgtccctggaccaccaccctccaggaacctccatgtatttagctatcagaggctctccaaaccctgtcctcgggtttttatggaagcctctggacttatctaaatgatataagctggcttcttgtccccagaaaaatgatgttccattagaacttggatgcaaggttggaggtgcaga

SEQ ID NO: 85005 - DNA, 1018 bp, Homo sapiens
aagttaatggtgagaatatgtttgaagacttctgaatcatccgtgtgtcaatgcggctttttggttttcttcctccttttagggctatcgcaaagtgatcatttcaaccaacatcgctgaaacctccataaccattacaggaataaaatatgtagttgacacgggcatggttaaagcaaagaagtataaccctggtgagaatttgtagttcatgaatgtctctcctgtgtctagtgagcagccactgaaactgtagtcccacagttttcccctgagtgtttcatgtttgtaactaacaaattcaggtggcaggcgccatgagtgagatcacctacactccaggtccgcgaaggagtcctgaggcgggtatgtgagacaggaagtagaggcaggaaagaagagcccaggttgagcaaacttgggcacacagggtcagggacctgggcagagggtctggtaccccatcagaagtcggctctaaggccagggacagctgggtgtcaatcaaagggtgtcatcagaaactatatatatatggctggtttgagctcccaggtttctcaggaaggaaccagatctcctggctgaggtgaggcatggaaggagcactggcttctcctaagaaggtgcagtgagaagctaacttaaggtcatcttgactcatgtctgttttatactttgctttattccacagaggatttgagaccactgaaattattgctcccaattattgaactgaaatgctctagtaaacatttgagggtcctggcttccacaggtgtatctttttgtgatgacgtaggtgaaagagcttgggtctccagtgccaggctaatgatacacctttatcaagaaaatgaacctcatttactgctagaaaacagacatcacattatttctgtcttacagcagaactgggagggaggataaagcacacaagtgatttgaggcatttaatttcgtagtcattgattgatagtatgacccccatcctagtttgctgaaactcccagtttta

SEQ ID NO: 85006 - DNA, 1024 bp, Homo sapiens
agctcactgcaagctccgcctcccaggttcacgccattgcttacctcagcctcccaagtagctgggactacaggcgcccaccaccgcacctggctaattttttgtatttttagtagagacggggtttcaccgtgttagccaggatggcctcgatctcctgacctcgtgatccgcctgcctcggcctcccaaagtgctggggctgggattacagacgtgagccaccgtgcccggtgaaactccatctcaaaaaaaaaaaaagaaggaaaggaaaggaaacagacctgtgtgctctagcagggtgttttcctctgcctgttctgctcagagccttggaagaaagtaaactgtgatgggggtggcacaggcctcaatcatctgcttttggggctcgagagggacacggaaaggccttcccactatttgtttctggtcctcctcttcgttctcttatgcaggtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggtatggtgctgggggcaaattcctgaaaagttctcttttatcttgcagttggtagtgagaacattgagccttgaaaagaaaagctactgaataaaacaactttgtgagttgtgtcatcaagatgaataaggaggccaggtgcggtggctcacgcctgtaatccctgcactttgggaggccgaggcaggtggatcacctgaggtcaggagttcaagaccagcctggccaacatggtgaaaccccatctctactaaaaatacaaaaattagccaggcatgatggcgggtgcctgtaatcccagctactcgggatgctgaggtgggagaatcgcctgaatccgggaggtggaagttgcaatgaggcgagattgcaccactgcactccagcctaggtgac

SEQ ID NO: 85007 - DNA, 1853 bp, Homo sapiens
tcatttaagtagggaatatctgtatacattaatgactaggtaaaacaggaaatacattttgaatatacagcctaaaggcaggcagttacagggtttttgatttctccgattttatagggtgcaagttcccagtggcaggatgccctgctgtgtgactgactacactgtgtcctgagcagtggtaatttcaatcacctctcatcagtttggccagccctacaaccaccattcctagccctgtgttgcttgacaggatacctgtgcttgaatggacataaggaaaagtccttactttctccccaatttacctctcaatcttagttcttccagaacacacttccctttcacaatgcaaataaactgaaagtgagatttgatacatggaattttgagaccaaccaactaaccttacacataatttgagggattcctggattcttctagtgatactgaaaagcacacttgactaaagcatagtgttttttgtttgttatggaaatacggtatacgttcatttaaaaataaatggacatacaaattgcatctccttaggagatacattttatatacatttcggtgcgtttttttccagtatggatttctatttgtttctctcttcctcttgttttttctgtgtcactcttgtatgtcctcatatctttcatacctcttgtgtagtctctagaagcagaacacctaagtcctgggtctggataatgaaaccctcagtctctggggcctctgaaaataaggaagcattggagctattgccatgttgagtaatgggcttcctagaactattgtcatctatcctgccagtgttttatgttgtagctgtttttctttgacaggtgagttccagctatgttgttagtcatgatcctgccattattttctgtgttctgtaggatgtctccaggctacttaaacatattttatgagtttgcaataaaattgttgaatcttgtatgatcaagtcactcctctgctcagaaatccacagtgacttcttagtaagcccctacattatatgcatacttgtttttttcttaactttactcccacttctacctaacagggacctcaacttaagtctcttcagttcttcaaggcctggccttgttcctgattcctcaaaaaatcttgactctaaggcctattttattgtctgtctctgaatccctataaagcttcaagtctgtatgacattcttaacgccaaattatatattgtcttgtactgttcctagctggtacatgtatattagtcttgtctccctcatgagaatgtaagctccttaagggcagggaccatgtcttaatttttgtatccaccacagtgcctagcacagtgcttggcacatgggtgctgaataaatacctttgtttattgatcagcaaagtattatctggtatttttaattatagagggattaaagtgtatgcatgcaagcttgagcctagttgctgaagcttgtggttgtctctgaaagtgggatagagggaaactgaacatgatcaagggcagtaatttggtggtcggaaaagcaaaggtgaccaccagctgttatggtcgtgatcagaccagttaagtccacagaccatcccagacaagttaaaaatgaaatgtgtctgacacttcgtcgtttgaaggaagaaccaggatattctctgaatagttattagcttgtcagtatctacatatgaaagctggtgaaccccaagagacttcttcaggagaaacagcagatttcagtctaccaatgggagaaatgtgagcagcatggcttgatgcatatataggacttaatttttccactctttggtcctcttagctttgaggctatagaatag

SEQ ID NO: 85008 - DNA, 1750 bp, Homo sapiens
gtggcacacaactgtaatcccagctactcaggagaatgaggcaggagaatcgcttgaatctgagaggcggagcttgcagtgagccgatatggcaccattgcactccatcctaggtgacagagcgagactctgtctcaaaagaaaaaaaaaaaagaataggggactgaaagcatgtctgtgtgtcatctggattagttcccagccagggacagtttgtaaaaaatgatgctggtcttgaccttttctcaaatgcttggtaaaaaagtaatcacattaccactcaaacattcttatacaaatgaagacttgactaattacaaataatatggaatccaagtgtacttacaagataacattaaatttttactttgttcatattcgtgtgcttaatattttcttaacttggaacttaagatatcgttactgtcgaatgctagaagaaggctctttccgaggtcggacagcagactttgtatttatgttcctttttggtggattcttaatgaccgtatccttcaacaaacaacacgggaaaatgttgaagaacaccctggctcttcctaaagcttgtcatctgtctcccacagttctctagatcttagcttcagggcactatcatttattttacagcacattttctgtgacaagtttccaaacctagcagtcggacaggatgagcaagtcaaaggaacttttaacccaggtgggttactgttaagcaactcagttatatcattactgcttggcgtacttcacttttaaactaagttggtaagacatttacttggtggctaccaaaaccaataaattattttttcagaaaaagaattttcatctatacaatagacttagatatggtacggtctgacaagatggttttgttccagctagctttattcatctctgtaaaggtgctaatcgtgagcaagctttaatataattattgactgaagaattaacacattttccaaagaggcaagaacttcacgaaagcagagtatttgtttgaagtagctgtaaatctcgataatttagcctaagcagatttttgcctgattgctctgggtaattattttctgggtgtttctccttctattctaaagatgtaacaacttgacttttccaattcaaacttctgttagaacacaatctttagttctcctgctcagtctttcctattaaacttttaatgttgatattttccttaatgccatctgctagctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtaaggctcttctcactattttttaaattattttacctgtaaaagtattttgttactatttttcatgtttattctgtttggccttcacgtattacctattgtaaaataccacaatattagttcattaatttttaataattatgttgacattcatcctaaatataggcaatttgtgttggtaggtctacctgcaatctaaattttaattctctccctcatcctttatttctgcttgactctaggtattgcagttggacacatatattttttcttggaagatgtatttcccaatcaacctggtggaataagaattctgaaaacaccatctatttt

SEQ ID NO: 85009 - DNA, 1027 bp, Homo sapiens
atcttccccaccgtcgcctgccccaccccccacccaccccatttccccttccgccagcaggccccggcggcggggcgggcccaaaggccccccgcccactttagttttcccgcgactgcccaatcaacgccaagcaaccgcaatccgtagagacctaaggaacgcacatccgccaatcacgagttgcgtcgccaccgcccccccccagcgccccatctccccaccctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtaagtgctgcggggcagcattttctctgaggaggagcggggacgggcgagactggcataagcgtcttcgcgagggagcaaggcggcctgtgggtcggcctcaccccggcctccgacctgaagatcccagcatgcagcgcgggcgcggggcccgacggaagccgggagccggccggaagcagttcctgcgctctggcttctgggtcctgtcctgcgcgatcgcggggtcttagacagctcaactcgccgagatgacctgggcacctctgcgttgaatcggcaaatactgatcaagccgcatttattctgctctcaggaactctaagtctagcagagaagatgaggcggtagaagttcatcagtcagtgcccgaagagaggtcctaatgggaattcgaagaaaggagttaatcaaggaagtgtatttttttgttgttgtttgagatggcgcccacctgtaatcccagctacttgggaggctgagctaagaggatcacttgaac

SEQ ID NO: 85010 - DNA, 1046 bp, Homo sapiens
tcctgtcttcctaaccgagcagaagtggatattcagtgccactagtgggtctgctgctgaagcttgagcctccaacctgatcagtttggccagagcactggggaatgagtcacagagctggttccttatggcatcagcctgagcaggcgactcagagcctctgaatccagagcctccaggccctgatggaacccctccgagcagggcctctagggaagtggtgtttctcattatagaagctccaagcttgtactcccatccagctcagacccccatcagccttggtgagaccagctccctgactctttctctggaggtacaatgaggtcaaggccaaggactttggggcagctcagtgtttagaccttcagggccttaggccttaaaatgcaggtgataatcatatacactagcagggccagagctgggccctaacatccagggctgctcatctggggaatgagggaatgaatgtggctttccgctcaccaccttctccctgggcctcctggtctggccttcacattcttcctttaatctctcctcatcatggctttgacaatcgtgctgacatacggcctgaaaaattatcggaagtgtgccacttggagaatgtggtcagggaggaactctgcatatgccctgcctcctggtgtggatgtgagaagtggatggaagaatgggctggattcatttcatcagctatgaaatacagtgcacctgctggtagctgttaaggcccctccccttcacttcgcttcccttcctttgctgccggaagcccctggagatgtgagctcccttctagagagtggctcccttgacatgagggggtcgagagtattctgaggacaaggatgtgcagcaggctgtcttggcctctctcccatagcccgagtgcccagtggcagcatcaagttgggcaggtctgactttggttgggcactccactcacttgtccacctgtatccaactcactccgtggggtttcaacacctgtttaccttccagattctgggatgggcttgagacgacccttaagcttt

SEQ ID NO: 85011 - DNA, 1035 bp, Homo sapiens
tcagagagccttctgccttctcttctctgggtgctcagcctctgtttgcaggtgcacggctcaggcgctaccctggtcctttgattctggcctctggagtccaggaggcctgggaaggctacacaagcccctccctcccctgggccccatcctgtgtgaaagccaacgaccagcctgtgcagaagctccttccaacccaggctcacagttccagtgcacccctgggagtcagctgattgcatgcatatatcaagcatctgcaacatagtcctgcctgggctaggtacatttatatgtggtagtgtctcattgcaggctgggccatgcagtcattgagagtccaggctccgaacacagactcttcaaaaccttggctctcctgtttaccagctgtgtggcttgggaaaaactagctaatatgccttcttttgccagtttcctcatctgtgtaacagggatatgatatctctaggttgttggattggtttcagggttaagtgagataatatgtaaagtgtttagctgagtgcttgacacacaggaagggctgaggaagagcccctgctgctgttcctcctcccccttattgatattgctgtcatcactgactcctcattattcctcaaggggagagctgttgtccccattttacagatggggaagctgaggcccagcaaggttaagcaacctacccagtgtcacacagctggccagtaacaaagctgggatttaaacctggctttgtccagtgctcctgcaacacagctggtccttggataaagcaagcacagggtgaggggtgtcccagcctgggagtgccaggtagtggacccgcctattacatctcggtgctctttctccaccttccagatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcg

SEQ ID NO: 85012 - DNA, 1033 bp, Homo sapiens
ccccgtttgaaagatcttccttaaatttgctaaaatcaaacttgccctaactgatttcttctctctggcccccaaggaggcaacgaccctgtctctcagggcatttgccaaggtagagaggcctctctgagcccagggagggcagggctagagaggaggggtagagtccatgagaggtaatccagccttcccaacttctgagttggggtagtggaagaaagcagtggtcaggccgacgcctggctcctggcagagccgtcagggtggacagtgggccattaaaaaagagaaaatgggcaggaaacaaacaagtgggaggtgtcagatgctcactttgctcagcactgagtgggagggaggtagcctgcagcactcatctcccgggtttctctgagagtggccttggccaggaaggcagaggttcccctggcttttcctaagggtgggcccatgattcctgggcctctggtattagccatgcttccctttctgcaggcacctacattggatgcttcagtgacgatggccacgagaggactctgaaaggagctgtgttttatgacttgagaaagatgactgtctcccactgccaggatgcgtgtgctgagcggtgagtgctggggccctggactgttgattctagaggcaggaaggtccagggacagttccagaatgaggaggcatatcagctaccagttggctgtcatagcataattggaactcactgctcagatcccagttttccagaagaaaggaagtttgttggcagatgacctgggtgccgggagctgggtgctgggtgatggcctgggtgctgagagctgggtgaccgcctgggtgctgggagttgggtgatgacctgggtgctgggagcttgggtgctggtgctgggtgcagggagatgcgacttccagtccagccatagcagggactcagcgtgtgactttgatgagttcttttccttctctgggcctcagtttacttatatattttacaataagataaagggctttaactgagatttctctgagag

SEQ ID NO: 85013 - DNA, 1055 bp, Homo sapiens
aaggaaccaaccaagtagggctgtgcttataagaacatgggctacttgagctgcttgaagctcacatcttgttgatctttgtctcccctggaattgggcacagagcacagtggtggaaggatggtggtcatccctgtggattccatacagatacagctggcaatacatcgtccatgttcatcccattcctgagccctgggaagcatgaccctcaaattcactcagtgtgcttctcttcttatcgttccctggcaggagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaaggtgggttctgcatccccgactggtagtggcatttggtctggggggtggggagagcttccagggtttggagatgccagtcatggccaagcatgcagttatgaggtatggcatgtgtctgtgtaaaggtcttggcatcttgatgggtgttggagataatggggagggtcagttttccaccctccacagaggctgaatcctggactcactttaaaaaacactggaccctttatctaagtctctctggagatgacaatggtaagaggatgaacagagaggggcaggtcctagagagatagcaacagaaaggtggtaggattgggaggcgtgggaagaatgagatcccaggagctgcaggggccactggtgcctccaggacctgggaaccctccttggtgtgagcatcaggtctgcccctgttgaccttaggaactgatgaaaggaagagccggggacgagggatgttaccacctttatcaagtgcctactgtgacccagcatggccctggatgttttggggctttcccctggtgatttcatgtgctccttgtagcagccctggggatgagacataacgaatgacttgcctgtcattagtccagctctggtttattgttggcagtacctgggtgtgttactttgc

SEQ ID NO: 85014 - DNA, 1039 bp, Homo sapiens
ggagcccaatcagtaaccttttggcaggagagggaggtgggttgtccctaggacacccagtttgagtgggttgtccctgggacacgcagtgcaaggcaaaccagctgcacctctccgtggagtagggatcccttcccagcccacccagagaggctcctttaagagcccctcctttccagcccacccagaccccctctcccaggctgtgtgaaaggtgtgggtcacaggacactcggagggacccttaggcctgaagagcctcaatgggccaaactgcaggacatcttgggagtcaaagactcacaccaatctcagctagggggacccctccaataacagaaggaagacggagcccagagagggcaagcaaccagctcaggggctcacagccagcccagctgagccagagcccaaggctgcagcctcccaagggagggcatgaggcagggctccgggaagaggaagccctggcctccagggccacagggaaatggtgaggacactgaggacaacgggggttggggacaatggacagctgcaggacagaccgtcagcaccagaccccacccccgagggctgtggacagagacggcgtaacatgagcccggggatgtgctctcactcccagaaagtggccatcttgccataagagcgccaaccccaaaatggtgacccaaaccacaggaagggcgggcacaaatgccactcacacctccacaagacagcccagaggctgtgcctgccagcggcgcttggtgccgaggctggggctgcccccttgagggcctgcctagctcgctgtgaagcctggggacgcaggagggtggtcgactttgcccaaacgcttcagccccgggcaagcctgcccccaggatgacacaaacatgaaccctgacttgggcttgcggtcgcaggcccgtgggaggcagcagtggctgcaccgagatccccggacctcaccccgtcgcagctcagggagccccccgggctcgggcaggatccctccccgctctggtcggacactgctggacagacacgg

SEQ ID NO: 85015 - DNA, 1015 bp, Homo sapiens
aaccctgaggctgaggctgctgttttcacggcaggagaggaaccatgaggcctcttgtgaggccagtgcaggggcccaacttagagaggaggcttggagtaggacagggggtggaggtgccacagagtggcaagatttgcattacggtgagagcgcttgtggctgtctgcgttgtaggagaaagacgggagcccagtacgtcctgtttcccacttgagtgactaaggtggttctgtgtcctgcacgtgcggaagagcagggctgggcagggggcggaggaaagtgagttttgtttgtaggttcttgggggtgggagagagtgtgctgggctgggggtgggtccccagcccggtggcacccaggccagggtgctccagcccaaacctgtgccccacgtggcacatccacgactgtctgggtgtgtgaagtgtgagctgcctcttagttgctgggacggaaggggagtagaggagtctggaacttagagaagacatcaggattccagataaaaatgtgggtgtcatcagagcttggacggcatttacaactggcgatgagtgccagactaagggtgctcctacagagagggaagttcagggatgagtcctggagctcccccagggagagaaggagaagccactgaaggagagaagaggacatccctgaggttggaggacccagagagtgtagggagaggacccctgagataggcggggtgggagtcaccggggcagtggcaagaatggcttccgtagaggagtgatggagaagaaccctgactggagtgggtggaggagagggggcaggtgaggaaggggtgacagcatatgggctaagtcctctgtcagtgctgctgtgagggacagcagggatgtggcggtcactggagaggcatgaggaatctgagagagtattttttaagatgggcagtattacacgtatttgaatgctaaggagagtgatctagcggagggagtctaatcagctctgcgggattgggaggggagcatggctg

SEQ ID NO: 85016 - DNA, 1003 bp, Homo sapiens
acccctccaagctctcagtgagtagggtgactcacctgagcaggggctgtgagaacagaaggttagccgactcctctgtcttcagagtcgcccacctgtgctaagcacctgcttgtctgaggcatcttggggctcagaggcccccaacaggctcccggacacactcctgtggccagggctggtgtaaacttgagctttcagagctgatggcgggtccagggatccgtgctccaatctattttttttatgagtgcccagcctggactctgaaggggtagggcagagagtgtgccatcctggtgggcttcatggaagaggtggcctttgattagggtccagagaggggaggtgcatttgggcaggtggagaagagctagaggatgagggttgagatcttccaggcagggagaacagcaggagcgagggcaggtgttttggcgaagagccagtggcctccagggtcaagtggggtgaaccgggcatggaccgagtgtatcgtcgatgggagacctgtaatggacagtcagcagcttggaaatcggagccttggctccacgccctacttgaggaaatttagcctaagcctgctcagaggtttgcgtcagggatgggggagttgtgcatggggccgattcaggattaaaaaccatcccttcctcacccctaattcaatggagcctttatttccaaatccctgcctgcctggagcttcaataggtcggctaggctggaaacctccctcccccatggatccctctttggtcaggggactcccctccctcccctgaggctatcctagctctcaggctggagtccccattcccttccagaggcagcctcaattctttgtggcgcaggggaggagttggataagagaggatatggctatgagtcactcctgggacctcagctggtgcttttggggcaacgtcccagaggctccctctgcagctttattggaggtaggggtgatggctgggactccagcttgtgtctgcataac

SEQ ID NO: 85017 - DNA, 1709 bp, Homo sapiens
gtctggggttgcaggtttggaaaggcctgggtttgacactcagcttctctcgtctagtagctgtgacattttggacaagttacttgatgtctctcagcctcagtttactcagttgtggaaagatgaccatactgtcgtgccaggtgcggtggctcatgcctgtagtcccagcactttggcagaccgaggcaggcagattgcctgagctcaggagttcgagaccagcctggggaacacggtgaagccgcatctctactaaaatacaaaaaattagctgggcatggtggcatgcgcctgtaatcccagctacttgggaggctgaggcaggaaaatcgcttgaacccaggaggtggaagttgcagtgagccgagattgtgccactgcactccagcctggcaacagagtgagactctgcctcagaaataaaataaaatataaataaataaataaataaataaataaaagaaaagatggccatatcatctacttcttagagttgctgagggcaccagagatgatatctgtgagatactaggatccgcacaggctggatagaaagttctgatggttgtcacttgttactggacggatgtgccttggaagctggaacacctggtccccatgtgatgatgaatcttatcaagtggggctcagtctttctggcgctctactggtcctgcggctgcctcagttgccattgtcacagcagtgtttccccaagagttggagtccccagagaggaggacatgagccagccagacagcacagggcctcttgggttgcaagtgtggggagggaggtctccatgggcctctcaggcatgcgcaggtatgaggttgcaagggcttgtctgcagtggctatgcggggaggggtgtcttggagactttctcctttgtggctgccaggcagccccagccttcattgtgcagttgggcaggcggcctggcagcctggcagcctgctgtcactggcgtgagcctgatatttgaaaccaaactagaggaagccaagggaaccattgtgtgtgggggcttggtgggggtccagagaagagagagggccttggacttgggggaggagacctgggtgacctactgccgagttgctgtgcagtctcagctcgtgcctggggccccatctgtctgttcatggagtccctcctggttctgacattctcggggtcttctgttgccacctctctgtcccctggcttcctctgtctgtgcctctttctgtttctgccttgttcatgctgctccgttagttagcacagtgaccatttccggagtgctcccactatacctgccatggtgctggctgtagggactcagggatcttgtatgtttccattgaacctcactctttctgtgcttccatccagtgtgaatggcaccatcctccatgaatccaagccagaaaccttctagacttctctgtctctgtcaccatccactatcaaatcagcctctgctagtgtcattcaacctccagcagtgctatgagacccacccactcctccctgtccccatcccttctctagttgaggccctatcttctctctcctggaccattgcatcctcctgtgcactggcgtccctgcctccctgcctcccggcctccctgccttcctgcttcccatctcacccactctgatcctcccttcagcgtgtcagagagacctttggaggaggaaaggctggttctcac

SEQ ID NO: 85018 - DNA, 1044 bp, Homo sapiens
agtatttctttctcttccagagacttttctaaccacacgttaccttgttcttcttattcttatttcttggtccttggtgggttctgagaatatgctttgactctaaccaacagctcacccattttctcttcatcagtctccattctgcaggtcagctcttctgtattttgttttgtttttagagattgggtctcattctcctgcctcagccttctgagtagttgggaccacaggcctgcactaccacacctgcctaattttttgtagagacagggtctcgctgtgttgtcttggttggtcttggactcctaggctcaagcgatcctccggcctcagcctctcaaagtgctaggattacatgcgtatgtcactgtgccaggcctggggtttgtttttttgtttgtttgttttttaaaatcatcttttcattttcatgtgctctgattgattcttttgattagcaatctgatcttaattcatggaagcatgggctcatgctacattttttaaagtctccttctgcttgttttagaacatttcagagttttctgtaggttagatatgggtgggaataactacacacttaagattggattattcagccaaagatcataggtgagattacaacacagagcaggagacatcttgatttgaatgatctaaggaggcacacagctgccattaacactattcaagtgaagcaggtcttgccaaattcttttttagaagttgagatataattcccataccataaaacccacctttttgtaaaatgtacaattcagtgtggttttagtatattcatgaagggatgcaactatcaccattatctagctcaataatattttttcttttctttctttctttttttttttttttttttgagatggagtctcactctgttgcccgggctggagtgcaatggtgcaacctcggctcactgcaacctctgccacccgggttcaagcgattctctgacctcagcctcccaagtagctgggattacaggtgcccgccaccaggtctggctaatttttgtatttt

SEQ ID NO: 85019 - DNA, 1068 bp, Homo sapiens
tccacccccacacttcctctctgcctgccccgctgaacttagtcatgcgtttcccttctggtcggcttggctccccagaatctcccacccacacatcgttcctctgtcttcactgtgggtcttggtgaggtcagcctaaggcctctcactcctggcctgcagagccctgcagaaggtcaccgtgcctgtgtcccggaagcccacagcacattcctgccacctgccacagggaggccctcagtgctccgagatagctctatccatgcctggcaagtcttgtggactggggagaattctagggagacttccggctctgaaatgccgcgatcacgaggggcaggagcattcagatcccagacatgtcggctctgccatctgccctgcagccccagtggtccctaagcctgagctgaatttgaccgaggaagccctcagcggacactgatttctcgagtgcatacaggaagcagggagtccagggagccgtggagatcaaactggccaccaaacttgtgcagccaccgtcctgtgtggccctaaagacctcccgggggagagtggcatctccagggccaggctcaataagagatttggcttttcttaaccataattagccaacacattgcttctggagagttactagaggtcaaaaaagttccctgaatgctttgaacaacagctcacgtattagctggcactttacaatttataaaatgcatttacatatattctttccttacatcactataaccactcctgttttgtataccaacagtagttcagctcattaagaattcgagccacaagttaaattcctgtgtgattttcatgccttggtttcctaataggtgaaatggggatgaaaaaatagcacccacccaaggtttttgtgaggattaagggaaatgcccatgaaaccacttagaataacgctgagcagacagtaagtgctcaataaatgttacctattagactccccactgagaacctcgtaagagggaacctttcagcttgtcgcgcaggcttggttccgaagtgtgtccctggcctccttccacccattgcact

SEQ ID NO: 85020 - DNA, 1267 bp, Homo sapiens
ctataaaggatctgaagaaactctctagtccctctcctacattttgagcttgagtaagagtacctttaacctaatgtttcttaaacagaatgtttatctcccctacttttcaaaatgcaagaaatgtgttatttttcctcttgtggccctacatcatttcacagcatgttttcttactatattactgttctctgaactaaatcttcctgaccgtgttcagttgtccttaatctgtcctgaccaggtggagactgggccctgacttcccagtaatggatgggtgggaacttattagaggaaatgcctttttttaggaaggtgagacacagaccctccactcttattgacctattaagtggtctttagttcaggaaaatgtatgttaaatacagtatgtgtgcccacttaaaagactgagtttatgagatttttgttgatgattaaaatgcttttgaagcagatgggataatattctgaagactatagttaatttctaaaatgatgatcctttaagatttgaatgcctttaaaagtagtcatattcattatgtctttgctattggctttagtgagctacacatctgaaagtactcacagaaattgttactaattaattagatatcctaaataataacatgttttaattaagattgtgttaactgttagagatagccatttaataacacatttccctggagtccttattttcagttttgtgattaaaagtcatacttttgcgagataaactaagagaataattgattgtttttgtggcaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccggtatgtgtcttaaagtgtttattgtaagacattttattcattacaattatctgggctataacagttactgcactgaggggaaagtcaggatttaggacctagcccacaacagatgaactttaactaggatcagtaaatagcaaccaagatgtttcctggggctggaggcattctatagaggaaggttgagaaagtaacatttcctttgctacatcatagtgtttgggctacccaaggcaaattcccatagagctggaagttagaaccctactttaaaaa

SEQ ID NO: 85021 - DNA, 1081 bp, Homo sapiens
ccacttcctgctcggtgtaaggaactgggcagccttattcgccagctttcactttgttctgtcaagctggatgcagacccttctgttcctgatgtggttatagatattctgcaacaaattgaggtatggaattaattccaatttttgttagaggtgcattggaagtaatgcttactattacctagtttcgttaggatttatggagaatacaagacaaagccattacctagtgaattaaagctttgcagagggcagaagaaacacttctttttgttttgctatttttacagtgtagtctgtattatcgtatttcactgcttcgaaaattggtaacttgaatataaaacatgtaacaactttaaaccaggttcattaactaaacagaatgtcccattccctggcccatgccatttgagaaaaaaatttattagcatagaaaaggaaaccagtaaagcattcttagattagaatatcagtgtttaatttagatggattttggaaaagaagaaacacttaaaggtacagtatatggaatcagagcctcaaatcttgtgatatagctagagacgtctagaaatcacagctggcatgtattagacaggaattgatagtgttcttagttttcattggtgacaaagacacattaattttatagctctctgaagtttgcatggtgtttccatgtaattatgccatttgaccctttctatggcagtatgctttgcaatgggttttactgctgttgtacaggttaaatttttttagaaaagcaaacatcggagagatgacagttatttttcttgagagctaggcatcaaattctattttctgactcccatgctagtattagttcccctacgccatacattttcatccacaaatagaaaggtgatctttatgttagcatggcagagtaagctgttagctgtagaagaaaggtggatagtggagagaattctagactaaatgacactccagttctaccaccattaaccagctcttggtggtctttaaggccacttctgccttcacagtttcattatcaagcaaatgtgtttgtgattttcattggttacattcg

SEQ ID NO: 85022 - DNA, 1040 bp, Homo sapiens
cagtcagagtgagagggagcaatttgggagagagttatgtgggggaggctagattgaggggggcgttccagtagtgtgtgtagggaagaagttggggctgtgtgggagggaacaggttcggggtaggtttgtcatgggttgcggatgaaggcactggctgtaagggcatctcagcatgggggagagagggttttcgtggagatgccccagggtatgtagagggacaaattgggacgtttcctggagcagtgggaaagggccagattgcaaggagagtcccagaactttgtacagggggacagtttaggggtgggtgtccctggactttgtgcgtgtgtgtgtatgtgtgtgtgtagcatcacttgaggcatgctggaactgtggggatcacctagtttttttctagtggagaatggactatttggcccttggcacctagaagcagccaggagggaagtactgaccatttaaaagtggcagatctccgggccccatttctgcagccttcattctgcaactccagccacccacctgtgccaacgtcaagccagttgggattgccttgctcatgtgcctcctcccatctgcttttttcatgtgtgctacagccttagaaataaggactcttagacagctgtctttatgttcccaagaagtatctgtctttaagcaaatctagtctgcaaattttggatttattcaaaagcttaaattagggttttttttaaaaaaaccttgaatttcccaattgatttactgtaggattttttgagagaacaaattccccagagatttaaaactagtcagttcacagaaaatcagcttaactcaacaaatgctaaattgtgtactatgctcagagcactttgtaatgggaaatagaagagcaagacaaggcccttcccctcaagtcgccttgtctggctgggaagatgagacatgtacatgtgaaataggtaaataacagtatgagacaatactatacgtgatcagtacgtgagtggcagggatagtaaagtctataatgaggccttcagaat

SEQ ID NO: 85023 - DNA, 1053 bp, Homo sapiens
ggctcctagggtgcctggttctgtggagctggagcctggtgatggaggcttttcaggcttgtcagggaggcagcaaactgcaggaatgcctggcactgtggggctgtctgcagctagtggggtgcccgtggctcccagggtgcctaggcctgtgcaagaggaaactggctcagaattgtggggtgaaagagagacagtgggcggacctgcagatgccaagggtcccacaaggatggaggtgcccacctcgaccaggatgcctgggcccatggcggagaagactggctctgggggtgtctcaggtttgttgggaggcagacagactacaggagtgtccatggctgtggggctgctggggtctgtgggggaggggaccatctttgagcatgtctctggcctgtctggaagaaggcagactgctgggaggcctgtggctgctagaggttccatggccgtgggagtgcccacagctcccgggcttccagggccaatggtaggggatacgggctctggggatgacggctcaggcatatggggaaggagactggccactgaggggcccacagctgccagggttcctggacctgtggagggggagacaggctctgaaggtgtctcaggcctgtggagaaggagacacggtggagccattcccgaggccgggagggtgcctctgcctctgggggtgcttgcagctgtaggagctcccatggcagggcgtgcgcctgctgcggtgtgggtgactgggtcctcaggagcagaagcggacgtgggtgtctcaggtctgaccgtgctgaggagacagtccacagggggagtgggggcttcagaggatgagacaggaggtgggaatattttgggactggccgggggcagccaggctgtggggacatctcacacctgtgtgcctggggccaggttatggagctgtccaaggtctttgggggaagaaacagcctatgagaatgctctaggcatgtcagggacaagaacagctgtgggggtaccctcagtttcaagggaggaaataggccttggccatttcagagacca

SEQ ID NO: 85024 - DNA, 1251 bp, Homo sapiens
cgcctcgggatgtggggaaggaagtagagtcgagctccatcccgtgcctgcaggagagggacctgtcgaaaggggtgttcctggccgagcttcctgggtagagacaagccgcggcggtcttacagggccctgggtgaaggaacaggcaagggggatccctcgggccccctcagggcccacagctctgggcttaggggcagcttacgagagagccttaggcttctgtggacagggacaggctgggagggtgcctcctgcgagtgtgcctggggctttggcgtcaagttctgaaatggccccgcacctgtggaggggagaagctgtgggggttcctgagactggggaggagataggctatgggtttgtctcaggcccttgtgaaaaagaacagactatgggcgagcctgggaccgtggggtggactggggctgtgggagcgcccagagccatggagggagagctcggctgtggcggtgctgcaggtctgtgggggagaggacagtccccgcagattcctggggctctgacacatgaagcagtctgtggggccacccctggcgtatgggggaggggacaggctgtgggggtgtccgatgctgtggaggaggagcctacttctgtgggtgccgcaggtgtgtgttacaggagacaggctgtggaggagacagactctgtgggtatgcccggcccgtggggcacaggatactctgttggggtgccctgtgctgctgaagaggaaactagatgtggaggtgacccagggttcagggaaaggggacagcctgtgtgggtggagacaggctctgggggtgatccagggtcacggggagctgcgcagactgcagagtcatcatgtcctggggagcaggcagcaggttctgggggtgccccaggcctgtgggggatacaacaggctacaggggtacccagggccttggggaaggacacgggctgtgtgagtgtcccagggctgtggggagcgggacagatggtaagggtgccccaggctgtggtggtacctggagccctgggagaagagctgagccacagcgggggcctgggcctgtgggacggacagcaagctcttggggggcccccagccgaggcagtgcctgggcttggagaggagacctgtagtgggaatgttctgagcccgtgggaaaggaggcaggctgtgggggagccagagagtctggggcctccagctttaggggtccctgggtcagtggatcaggaggctggctgtggaga

SEQ ID NO: 85025 - DNA, 1095 bp, Homo sapiens
acgttggaaaccgctagaagggaatagcatggtttgtccctaaattttcactctgcttaccagttactgtgttgtgtggtcttgagcaagttaatttaatctttctgaacttaaaccttctcattttcgaaaatattgaacactgacctttgatgactaatcggggaaaaaaccctatgctaccagagtgtactaagttactgttatagaaatggtaggctacaagatcgtttttaagagaataactgaattataccttggcattatttacctaaattatgttgttcattcacttacaaacttaaacccaggtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggaca

SEQ ID NO: 85026 - DNA, 1054 bp, Homo sapiens
aggattggtttgacctacagatttttttttttaatgcttttcagttcttgcccaaagaggttacttcaaagacaaagcttttgttaattatcttaaatacttgctttactggaaagacccagaatatgccaagtatctaaagtaagtttaatttttataatcctaagcatgtgtatactttattatataatagatttcttagtttcacattggcaaaaatgtatttggaatctctccacttctttttgttatcaccgtcttaatacaagacaccctcatctctaacttgtaacactgcagtaatctactccctggttatctgtgcttccacttttaccttcctgcccccatctccaccccaacccaaaccaagcaaaacagctttctacacagaaaccagcttaatcttttaaaaatataaatcagaacactttactttcttgcttagaacctttcaatggctttccattccatgcagaataaaatccagtcttttttcttggactaaagccttatacgatctggccctgccttttctgaccttgtcttttaccacccttcccatctcaccaggtttctggtccctaagaactcacaatctgtaaatgtagtagcataagccatgggctgaaattaaaagagggtatctgtaaggaaggtgtttctggggttatttgaaggaggtgatcttacctgagtcttagagttgctgtcttttatttaaggcctcttatttgccaggaacagtgctaaatgcttcatatgcattaactcatttatatatatatatttaccattcaggtcgttcagcagacactttcatgttaaggcttactaagttgcaagaaacatattataaccacaaagcaattcccttttaatggttaaaaaaaaaaaacaaaaaaaacaaaaaaaaccaacccaccttgaactcacacccctgctttgtcttaagcaggtagaaagcaataatgaacctttaaaaaaaaaaaaaagtttgagaggaaaatgtttcaaacttctctcaaagtcacttttctgtgtccaataacaa

SEQ ID NO: 85027 - DNA, 1088 bp, Homo sapiens
agtcttgagaggccctctttccgtagaattcagtaggagcatgttgctaggtaggaagtgagtacatggttttctggtcaagagcttcaacaatgcctccaattcccaacaggtagaccttctgcagggggtcccgtggattgggaggctagagtctgagccatgcacagagctcagtcctgacatcagacaccaaatcagtcatgctgcactctgggtctcagtttccttcatgaaggcgttagaccagagggtctctaagggctttccccagagtcacggatcctcttactccagctgaccctccctctgcttgggccagatggagcccccatcccaatctcccatgctgtctcatcttggagcctgttccaaggtcccactgcctgcttccctatgggggttcgctgaaggccatctcaggcctttcccctatctatatcttgcctctgacattttataaaaagggtccaccctgggcctttgagttctctcttcttagtgcttggatcagacatctgggcttgaggttagctgaacacacaatgttgaccaggattgccctcttaattttttttggcagggacttatggctccacaaagattctttgcattccaaaattaagtccctgggctccttagcctttgacctctgaatgagatgctcctgagggcaggacatatgtctcctcccctgttcatcatcagctgagagctttcttggagaaggactggggtctccccatctggcatctacctgggacaggtgaagtcttctctcctccccaccatctcttgcacataaacaaaacaactctttgatctgggttccaagcaggataccagctcactagcacaaagcccaatccttgagatgaacaaatcaggatgttcttgggtaagacctgtaatggcatgttcttgtctgtggaaacaaagtccaaatgctgtattgtctgattacaaactacagctggtggcctggtgaggtggctcatgcctgcaacaccttgggaggctgagacgggtggatcacgaggtcaggagttcaagaacagcctggctaagatgatgaaaccccgtctcta

SEQ ID NO: 85028 - DNA, 1026 bp, Homo sapiens
caccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctccactgtgctgctgacttgtctct

SEQ ID NO: 85029 - DNA, 1740 bp, Homo sapiens
tccatccatccatccatccatccatccatccatccatctatccatccatccatccaacattcctattatgtccctagtgttatgccaggcacagagattacagaggagattgagatacggtccctgttcgtggcagacttcacagactagggaggggcacatatatgaaagggcatttcaggaagtagcacacgagcaagggaaaaatgtgaggtatttagctgaggagaagtagaagatgaggctggtaaggctaccagaagccacttctctgagggccccaagatagaggggtgtggacttgatcgtgaatgcagtagacagccactgaaggactgaggccagggggtgagttggtcagatctgcacatgaggaaatcactctgatgtctggagtgggggcctgggctgggcagggcttggaggagaactagctgagactctgcagccttccatctcactcaggctcagaactttggactctgtggacattctctcctcctttggcccccagctcagcacagtctccagctttacttcggactcagactattcctgctcagccttcgttgctgacttctctgttctccctgaaacaggagtgtctgcccaggctctgtccttggcctctcctctttttacacttcattctctccctggacaatctcttctcagcccaaagccctaaatctaaaccttcaatttctggttgaaatcattctcctgagcttccaaaactgtggagcactgaagaggaggagatggatgtgagacatttgggtgacttggtgactgactgggtataaggaaggaggggaacagagaccggcagcatgactcccagcctgctgggctggatggctggtggatggtgagtccattcaccaaactgggaggcccagagagagaagcagattctgggctatggaggatgaatgcagggtggagcatgttgagtctgttgtgctcttgggacatctggatggacatttccagaaggcatatgggtatgtaaatccacatagtaggccagctggctggaaatacagatttaggagacagcagagtgaggacggggatgaaaatggtgggaatggatgaggtcacctatgaggtgtagagagagagggtcgggaggggaggatgggccaagcttgccctggccctgaaggaactgcaagctgggagcgctgagatgactgccctcctggtgcttcccaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatggtaagtaacctgacagtggggaggagcccttccatttcacaggaacacatggccatattgtgggtccctgacgaggcagcaatgtccaggccagactcagaccaggctttggagacccaggtctgactgtgacgtggatttgtggaccctggatgcctctgcccctgaggcctccactgctttgccactcctctttgtacccctcctgctgaccaaagcaccaaccatggaccaagtgctcaaatttattttataaatctaattggattatttttcaagctggggagacaggacttgggctaaggaggagcaggccagtgccgtggtctctgagcatgtagcacaggtgtgcaggag

SEQ ID NO: 85030 - DNA, 1033 bp, Homo sapiens
agacagaattctagagaacctggtcaagaagaggtcctgaaatacacttatggagaatgcacgctgagagggggaagtaaactgcttaggatcacccaaagttggtggtcaagagtgtgggcatcttgatttctagccaggattcagtctcccataccactcttatttttttatttttttgagacagagtctcacactgtcacccaggctggagtgcaatggcatgatctcaactcactgcaacctccacctcccagcaattctcctgcctcagcctgccgagtagctgggattacaggcgcccgccagcatgtctggctaattttttgtatttttagtagagacggggtttcactatgttggccaggctggtcttgaactcctgacctcgtgatccgcccgcctcagcctcccaaagtgctgggattacaagtgtgagccactgcacctggccaccactcttgaccttgacttttaaggctgtgagcctgtttctttgcatagaagcatttggacacagaactgccggagttgtgatgggtttgttgagtgactgtctctgtcgcagatgagctgtgcttttccccacctaggtatgtctccgatgccactgtggccatctttgtggccaccctgctattcattgtgccttcacagaagcccaagtttaacttccgcagccagactgaggaaggtaagtctcctgttctgatcgcccagtcatcaggactggagccctggaaccaaagggtcactatgggatgccttgggccctagagggagaaaatcccatcatatccaagaggattggctacaaaagcctgggaaacagtggctttcaagccaccggtggtattatttagtgcaaaatatcttttttgctttttaacatttgaatttaacatttgaaattttatttatattacaacaggaacagaaaatgtttcaaattttccataacactgatttccattcagcacaattttttgttttctctcttcctcccagtctttgctaatatgcctgtatatta

SEQ ID NO: 85031 - DNA, 1050 bp, Homo sapiens
ctggcaggggtggaaagatgtggccccatctagcctctgtgtcctggcacccctgtgcccacacagaagccttagagaggatagggagctgatgtcaggggagctaacgtcccagtctgctttctgctatgatgcaagacccaccacctcccctggggtcagggactctggctcagagagggagtgtggattgaactctgagctaaagtcatggcagatgacaatgtacttccagacgctgggtccttggttgaaacttgtagaaaatagacacctctaaaagactccccagcactccctttgctcactgcttttggtggctaatggtgatggccccatggcatccgaggtctacagatggtatgaagggctggggttgggtcattcactgcttcactgcttcgttatagtccccttgtgaggtatcaggtgaaccatgggatggtttggaactttctagccttggccacaaagggatgcaggccatgaggaccccaagagggagagaaacctgggccctgccgcggggtagtcatggtctgttgagggtggcaagatgcctggggcttccaggcatgtctggtacataaatgtactaattgaggtatgtactaattgcagtgggcaggcacaaaaataaggtgatgccatcctttgcagacaggagcctggacaggggtggggagggcagtgggcgcaggagctgggaggtggaaaggacaggtctggagcctggctgggcagaaacgtgaggttcaacaacccgtttgttttaatttcgggagtgttttctgtaatgatatccttacagttctccagtaactttctttgggaagagcagcccgtctgggctgagtggggaaagctctgcgcctgctttgacactcttgagctaaagggggcgcccctggggctagcagagccccggggatgggaggcggggcctgtggtggaagtgaccctcctccagcctccgctctgggaagcttttgagatttcctttgctaagtggggggaccgttctttgcagaaacccacagagcgagattg

SEQ ID NO: 85032 - DNA, 1088 bp, Homo sapiens
tctgtcatctgtgtgactttagccaagtgcctgtgctctctgggccttggtgttctcatctgtacaatggggctaggtggtttggttctgacactttaaggctttgggaatcaaaagggattaacgttagttcctaggatgggggagggggagactgggaggagcccttgggtgggcctagcacaggccctggatgggtcaaggacagcagatccaactgtggaggctgtgcagttgccacaccaactgtgggcagccacacttcctctgtagcaagaagtctggggttgttattgtccaggggaagtagccaggcaggagagctgcgatttcagctctgctggtagggagtgatgttccctggaatgattatagtagcttggctgaccttcctgccacaggagaccccactcacacacacacacatacacactctctctctcacacacacacactcacaaacacacacagacacacacacaaacacacagacacacacaaaacacacgcacaaacacaaacacacacaaaaacacacgcacaaacacacacccaaacacacaaacacagacacacaaacacacacacaaacacacacacaaaacacacaaaaaacacaaacacacacatacacatacacacacacacacacacacaccctgaactggaaaccctaactcagtgtgtgtgtatgtgtgtgtatgtgtgtgtgtgtaagagagagagagagagagattaagctgtcctttgagtgaggaccagggaggggaagaagagaacccagggagagtccttccaaaggctgccttcacgagctttccttctggcggggttgggtgaggaccctggaccttgtcttcttgttttttccctttctgcctgttttggtcaccctgcccccaccctccatggccgccccattgtgcaaggaaacccagagggtacacagcacgggcagggcagctgggaagctggtgagaagctgggaggaccttggcagcctgagcaacacagtccttgccaggaggtgactcccagggcacgccaccctctgccaacacccaggcctctctcctcaccgactgtct

SEQ ID NO: 85033 - DNA, 1316 bp, Homo sapiens
tccattccgctgtgttgattgaggacgttcccttcacggagaaagattttgagtaagtattcgggtgggggaggcgggctgggagcaggtgggaggtggcgaggcctagggtcagaattacgtctgggaggcccggtgcttagggcccctaggttagaggacttggagaggagagcggctttcttgagaatgtggttaggagccagggagtcagacctcagcggccatcccaaacccaccaccttaggtgtgacctctttaggtattttacttttctgtgcttctcagtccacctctgcaaaatggctatgacagatctcaccccataggatggtcaagaagattgaataaagtaatacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttcagccctgtgtctgtgcttgagtgggggcgagcacggggctgagactagaggtcggcctctgcctggaaagtcccgatgtctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctc

SEQ ID NO: 85034 - DNA, 1051 bp, Homo sapiens
atttattttgagatggagtcttgctctgtggcccaggctggagtgcagtggcatgatcttggctcactgcaacctccacctcccgggttcaagtgattctcctgcctcagtctcctgagtttctgggattacaggctcccaccacaacgcccagttaattttggtatttttagtagagacgaggtctcaccatgttggccacgctggtctcgaactcctgacctcaagtgatccaccagccttggcctcccaaagttctgggattacaggcgtgagccaccgtgcctggcccagttccaatcttgactttattacttaactcgatcaagatgctgaatctctcagttggtttccccatctgtaaactggggataatagtacctactattaagcgttgcccaaggggttcagttagaaaatccatgcactaaaaatgcttagtttatgtgctgacatgcagcaggagccaagtaatattagcttagctggtcttattggtgttattttcaacaggggataagctgctgtagtgggaagtgaaggaaggttttagtttagtgtttttttttttgttttttgttttttgttttgagatggagttttgctcttgtctcccaggctggagtgcaatggcatgatctcggctcactgcgacctccacctcctgggttcaagtgattctcctgcctcagtctcccgaataggtgggactacaggtgtttgccactatgcctggctaaattttttgtatttttagtagagacagggtttcaccattttggtcaggctggtctcgaactcctgacctcaggtgatctgcctgcctgggcctcccaaagtgctgggattataggcgtgagccaccatgccctgcctagtttttgttttttgattaaaaaaaaaaaaaatctaatccaggtcatgggtttaaaaagattgagaaacgaccactgcgatggtttgaatgttacctccaaaaactcatattgaaacttaatccccaacttggcggtactgagaggtggaaactttaaaaggtgattggatggga

SEQ ID NO: 85035 - DNA, 1327 bp, Homo sapiens
ggaggacagaaggaggccactggagtggagtagggtgggggacagagagaaataggtgtgtcagagaagtcagagaggcgtggcacacaggacttcccgtggatttttcagagtggtgtagaagctgctggagggctgtggagggaaccgtgagccagttactctgggtgtgaaggggaatacacagcagggggcaatggagagccagctaggctgttgctggcgttaggatgagggacgatggtggagtcactgtcactctggggagagcttaacctctctaagcctcagtatacctagctgtaaaatggaaataactacctaccttggtggatacttgggaggaataaactggaaagtacacgtaaagccctcagcacagtgcctgacgcatggtagaaaatggtagcaattattgtcattggcctcttggtctattttcagatatgcataagcccaaaagttaaagcctggaatcatttggagttttaacaagttttaccctcaaaaagtaggaaagaggcaggcctggcatggtggctcacgcctgtaatcccagcactttgggaggctgaggtgggcagatcacgaggtcaggagttcaagaccagcctggccaacatggtgaaaccctgtctctactaaaaaaacaaacaaacaaaaaaagctgggggtggtggcgggcgcctgtaatcccagctactggggaggctgaggcaggagaatcccttgaacccgggaggcggagtttacagtcagctgagattgcgccactgcactccagcttgggcgacagggcaagactctgtctcaaaaaaaaagtaggaaagaggtatagagagggtcctgggtcagagaatcctggctgtcccaaggttgaaaaggtgtgcctggggtggacagagtggcattgaggaggagagagctggggggagagagaccctactggagacagggagcttgggcccccattcctgcaggccggcttcttgtcaactgcagagatgggatattgaagcccttggggtgggttgtgtcagctcagatttaaacttgtgtgcagaggcccgtctgctcctttcagcactggtggtccccctcttcccttgccctggcgcacagccctccagcccgaaaggttggaggatagccttccttttcctcaacctcccctgcttcatctcaacccaattcctgctcagcctcttctagatatgggaccataggccgccctctttgggaagttcgtgaagagcctctgctttgcccctcctgcctgtttgttcaggtgcctcttttcagatctgcgggtattagactccctgca

SEQ ID NO: 85036 - DNA, 1893 bp, Homo sapiens
ccagaatgaactgccagtttacaggagatacaggggcagaggcataggctaaacaaaccacaggagggtaagcagtaatttccctgttagaatttccctcataggctggtcaaggtggctcatgcctgtaatcccagcactttgggaggcataagcgggtggatcatttgagttcagaagttccagaccagcctggacaacatggtgaaacactgtctctactaaaaatacaaaaattagctgggcatggtggcgcgcgcctgtaatcccagctacttgggaggctgaggcatgagaatcacttgaacctgggaggcagaggctgcagtgagccaagatcacggcactgcactccagcctgagactccttctcaaaaaaaccccaaaaaaacaaaagaatttccctcatagaatgtgggaaattcttttagacaaatgacctagttttttcaacgaatggatggcagagaggtggggggaaaaaagagggagaagaattttatggattaagagattcgagtgacacaggaacccagagaaaacccccaaagcgtaatattaatgctccctttgacttccccatccctggcatactgaggacatataacgttcaaatcctttatcccctaggacaaccagcctctgatgtcacctataaattcctgacccctgatgtcactgtgatctgatatccccttaccaccccaccctggcatctctggcagaatatcttcccttccacctaactttggctcttctggcaccctggggagaaggttgggtggcgggtgctgtttccctccaggcactttcatctctgccctgtcttcctcagcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtgagggaaggcctgcccctacctgcaccaccccctccccacagggcagagcgcagagctcttggggaggggcctggatgggctgcagccgagtcctcttgcgggaccactccctgctccacctggacccagaagtgctgcctcctgtctctggtgacacagcctgtcgtcctctctctaggtcaacggtgtggacctccgaaatgccagccatgagcaggctgccattgccctgaagaatgcgggtcagacggtcacgatcatcgctcagtataaaccagaaggtaccaggccggaagttccttgtcttgtgagctgaaatggcccttagaactcttcctcagctgatggcttcagtaggggaggacaggggtgacagtaggatggggacagagctcagaaacctccctgtccttcctcagagtacagccgattcgaggccaagatccacgaccttcgggaacagctcatgaacagcagcctgggctcagggactgcgtccctgcggagcaaccccaaaaggggtttctacatcaggtcagaggcttcccgggctggactcctcagcccctctgcgttcctgggcactctgtgcctggcccgggcctcagccgctcctcttctccaccctgcctgctctagctccccaccccaggcctgaggcgcagccagggttcatgggcttggctgcacaggttaacatttgaaatactccctgtcgatgggaaaatagcctctgccccaagtatcccaattgccttc

SEQ ID NO: 85037 - DNA, 1048 bp, Homo sapiens
ctcaaagaggcaggctccatcgttcgcctctatgtcatgcgccggaagcccccggctgagaaggtcatggagatcaagctcatcaaggggcctaaaggtagtaactcattttgttcccacccccatcccaactgtcctgtgcccccaagcctgcttcctgggcacccacctctggcctcccctccatccaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtgaggactccatctagcccattttctagcccagatttgggtctcacctactagccctggcaggcccaagttcatcacttcaccccagtgcttctgtcttgggccatttgtggctttgtctgagctttgctttccttgactccaggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctgtgagagcccttcaaacaccaaagttccccatgacccatcccgtttaacccatgacatgcagtcccacgacatccctgtagctgtccctcttcagatattccctatgaaatagccacaacctctgatccttgctgttgttggagaagagatggaaaatcaattaccataaaagaactagaaaagatcgtcaacgatctctctcctggaaggcacaaagcctggttggttttatggctaattttgtgaaattctcaaggaatagataattcttctgctcttccagagtacaggaaaagataaaagatttcacatttcattttataaggccagttcgaatggtcacaaggatagtgtaaaataaggagagtatagacccgttttgcttctgaatagagatacaagagtttacaataatatagtagcaaagca

SEQ ID NO: 85038 - DNA, 1126 bp, Homo sapiens
aacgtggggcggggcccagggcaggagaggcggggctagcggatcccttctgcgctcaggagtttggtcggccccaggccacgccccacccccctgttgtcctgacgacagggcctcctggaggtgggtctccccgggtcttgactggtcctagataccgttgctaggcaacacggtccttagaggaaggggtggattggacggctggttggtgagaccgagggaggggcctgcagctggggaaccccggattcccggggtgcagggtttagggcaaatgtctgtgaaagtgaggggcaagtctaggggagggttatgaaaatatctgggtagatatggggggttggggggatggggcaggaaatggggaccaggacccggtggacatgatccctggggtgtccatgtgtagcacataaggcatgtaacaccctgtggtgttacatccggtgagaagctcccttcccccaagcctacccccctctccccactctttgccatctgctgctcccctctccgtctggctgtctcccttcccgcttctcctacacctccttccacatgcagggggccccgggctgggcagagttagatccttgcgcgtgtgcatctgtgcgtgtgtgtgcgcgtgcgcatgtgcacgcgtgtgcgtgtgtgtgatgtggattgaggctgggcccttgagcagctctcagggtggcggagtgggcttggctaagaggctgaaagggtagccacgctgatgggaccctccgttatgggctccctctcgagtcaaggctcaggctgctttttgtctcttgttttcccaaacaggccaattctcccccagtgattgtcaacacagataccctagaagccccaggatatgtgagttgtttagattttggggctggggccattgcagaaggaaggagggagtaagggagggcagcagatgacgggcaggtggtcagacaggaatgtctgtctcactgcttttgtgtttctgtcccgtgctggagttgcaggtgaacgggaccgagggggagatggaatacgaggaaatcacattggaaagggtgagcaggctcctccatcggcagtccccgtggcctcccgtctgtacctttctttctgccatgtg

SEQ ID NO: 85039 - DNA, 1040 bp, Homo sapiens
gtgggatgctctgggaagggggaggttgctgacatttcaccaagaagatggggaggaggtctctgagcctagggagcgggcaagcaggttctggagttagaactggcaagagaggagttgggggataggaagggtaagaggtcctgggtcaggggccagatagggataagactgtgagatcagggcagtgaatgaggctgacagagcaaggaaaggaaggccctggagacagggatggtacagagtgtttgtgcgaattctgtggatgctaggagtgagggaaagaagactagagatgctttgtgcaaggcagggccattaaatccctgagcagggggaagaggaggtagggagcctgaggggtggtagttagtacagagctgctgctgatcagagctcaggagcagaagggggtggagggagagagtgttggaggccataagcatggggtggaggtctcaggacaaggcctcacctggggaacaggagaagccccaattttcagaagagaggggagttgattgagaagtgtaagattgttacttgagaataatcttgagggtatgaaggtagggtaagggagaatggtgataaactctctggggaatcagaaattgagatggagtagctgggtggggtggcatgtgcctgtagctactcaggaggctgaggtgggaggactgcttgagcccaggagttcaaggccgcagtgagctatgatcacaccactgcactccagcctgggtgacacagcgagaccttgtctctggaaaaaaagaaattgggatggaggatgaggccacattggtaagggatggggctggagggtgcgacagggccagggaagcggatggagaatggaggctggggttggaagatggatgttgaagggcgagacagggatggagatggagcatgtgggatgcgggcagagatagggatgggaagcaaatgaatgtcgtagtggatgaaggtgggtgtgctgggaaggaggttccaggatagggatggggatggggattgaggatgggctatgggat

SEQ ID NO: 85040 - DNA, 1074 bp, Homo sapiens
ggttcggatggaggctgcatctgacccgcttgagggctcggttagacagaaagcggccacagtctcccctgttggggagagagctactttaccccaagttctgatgagcttcaaagtcccctcggcccacttccccatccctccagcaggcagttcccccttaacacctgggagtatccagttcttttgcatgtcccaaccagcacactgtgatgcctccccaaaaccttcccccaactgaaatgctcagccatctgataatctaagtgccaactggcctaatctgtgccaagcccagtgtgccccccaatccctggctctcctagggttgcctcaccagatgccagcttggggaggtatttttctttctgggcctttgtgccaaagagcaggatgcctttgaaaccgatgctctgatgggcccccagggtaatgcccacgccaaggtcatgcatgcccacgatctccaccaaacgggcgtactggaggggaagcaggaatctggggttgtcactggctgcagggggacctgaccttaacaggagagtgtgggcaacagggcagttcctgacctagggcagttcctgacctagggcagtgcctgacctgggccatccccagtgtgtagaaaagaagtggggtgtgcaaagggcacagcagagaatgctggtctgtcttaggtctaggtaggagggtgacttgctactagtcagtctattgttaggcaatccccaacttagagatttgtaaggacttgggaaccagggtgaggcccatggctcaggcctaggggactgcatgtaaattgtgttatgtttggacagttaacatccatcccacaggcacccagggcaggtgcttagaagagaccttagccctagtctctaggtctatggcaaaagagctgagtctgccaagctggggtatggcatactgggatgtggcgatagggcgccctcacctgggtgttgcaaaggcccacaccacccagctcactgggcacttgcagaccaaaggcccccagctccttgaggccctgccaagtggtctcctccaccatctccagagcgtcat

SEQ ID NO: 85041 - DNA, 1093 bp, Homo sapiens
ggggcttgggaggccctcacctcagttacatactgcagcataaccatccgtgccagcttctcctggatcagcccaaagttgtgaattttctccccaaactgggtacgattagtggcatgatctacctggaagagggtccacacatcccgctgtggttcagtgtggttctgcagtctccctaggagaggggctgggcttgcgccagagggatgggttttgcatacaaccagagttcagtctacgctggatggagacctaagctagcaagtcgggctgctggtaggggaggagtttctagtgtagggagtgcctgcaagtgatcagggacacatggcaagggggacagtgagacttctgtttgggttacctagggactcgggcagggtactcaccgccttagcaatgatgcctctcatggtacctgccagggccgcagccatgccaaaccttccattgttgaggatgtgcatggcaaccttgaagccactcccaacctcacccagcacgttctccgatggcacccgtactccatcaaagaacacctctgctgtgtttgaagccttgatgcccatcttcttctcagggggcccactgtgtcagggcagtgtgggaaagcagaggtgtgttcaacaggttgtcactgggggaaaaactgctccttcgctccttatgcaccagggaggaatgacgaccactagactattagaggctacagccaccacttcccctcaggccctgagggctaaggaggcctggctatgtcctattttgtgttggacttggttgctggagccaaaactttagctcagttgcatacatattagtcccaaaggccacattcagtccacctgctttggcttttgcacacgtccccagggtgacttgcaacagccatctgcccaggagcccagtcctgcccctcagtcctaagctcccccaacccaaattcactcactgggtaatgcccccgaagcccctctccaccacaaaagctgtgatcttctccttcacggctcctgtggctggatctgtaactggtgtcttggcaaagaccgtgaagatgtctgctaggcccccattactgtggaagaat

SEQ ID NO: 85042 - DNA, 3495 bp, Homo sapiens
tgccaggacaccggcagcaccccagggttgaccctgggttattgaagggcactctggctccttttcccaccacagacgtcatccttcagcagcgtcacagattccacaatgtctctcaatatcatcacagtcacgctaaacatgggtatggggagagcctgtggctagggcgtggggagggcctggtctctagggttccgggcgtcctgtggcaggggctcctcttttcacatggcctctctccacagagaagtacaacttcctgggtatctccattgttggccagagcaatgagcggggagacggaggcatctacattggctccatcatgaagggtggggctgtggcggccgacgggcgcattgagccaggggacatgcttttgcaggtgtgctggggtagggccactgagctgccctgcacgggggccctcagcctctcccaccgtgtctctgacccacttgccgtcgcttccaggtgaatgacatgaactttgagaacatgagcaacgatgacgctgtgcgggtgctgagggacattgtgcacaagcctgggtgagttgccaagcaggttgccggtcctcagtcctctttttttttctctttcatgttttgttttggaattttaataagtactaagacagccgggcgtggtggctcgagcctgtaaacccagcactttgggaggcccagatgggtggatcacctgaggtgaggagttcgagaccagcctgaccaatgtggtgaaaccgtgtctctactaaaaatagaaaaattaagtgggcatggtggcacatgcctgtagtcccagctagtgaggtggctgagacaggagaatcacttgaaccctggggggtggaggttgcagtgaaacgagatcacgccactgcactccagcctgggcgacagagcaagactccgtctcaaaaaaaaaaaaaagtgctaagacataacgttcaaagtacatgaaacaaatgcatgacatagcaaataatactagagtaaatatccatgtcactgccatctagatcatcaaataggagattgctgataccctagaacttcctcctcagatgtcccttcctgctcccaaatgcctcactgccccaggggtagtcactctcctgacttctttggccatcaccataacaaagaaaagctttgcctcactggatagttaccacccttgcacgtatccttgaacactgcagtttcgttttacctgtttttggactttctgtgaatggaactgtacagcgtgtactctcttgtctcacttggcagtatgtttttaagagttttccatgttgatgagtcatccacattgtggtgccttccaccctcaccttctctagcccagccgcgatgtgcttgcttctccccctctttgtgtctcttaatccatccttgcttcagacccccgccctcctgaggcctcctcttcccctgcgcccttgactggacttctcttccccatagccccattgtgctgactgtggccaagtgctgggatccctctcctcaggcctatttcactctcccccgaagtgagtgacactcagggaggggcctgaagttgggggtgggggctgcccaggaggctggggccgggcctgtggtcatggggaatgggtgggaggagggtccaggcagaggtggaacaggaggctgagtcagggagggactgggctggcttttggggactgagaatgggtcattttggtgccatctttgtcccagatgagcccatccagccaattgaccctgctgcctgggtgtcccattccgcggctctgactggcaccttcccagcctatccaggttcctcctccatgagcaccattacatctggatcgtctttgcctgatggtgagccgccagcccacctcatcccaccctcccagcagaaggctgtcccgcagtggtctgatccattgcccttgtgggagcgatccctgactctggttacccgttgtctcctctgccaggctgtgaaggccggggtctctccgtccatacggacatggcatcggtgaccaaggccatggcagctccagagtctggactggaagtccgggaccgcatgtggctcaagatcaccatccctaatgcctttctgggtatggctgggtcctgggcaggtggctggagaaggggaggaggtggtgaccaaagccaggaatggcacaggcagaggcgagagcaggagttggaagaagaacctgaggcctttttccactgtgggtgctcccaggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtaagtccccctgccccaactctgggagtgtggctttgcctaccttgttctgcctctccaaccctagacctagcccagaaaccgcagccagggccaccatggatggtcgagcagtgtgtgtcccgcactaggtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctgccctcatggcagaagtagatgggagtttcttgtcagagacccttgtgaacccctgttttgagccccatcgtgggtgggtctgggagaactgttcccagttcctctccattcggtgtcttggggccctagcctcttgaagcagtgatttcttcctctcttcccttgctttccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggtaagtcatccccacatacctgtacggccaggatctgagggtggatgagaggggagccagggaggagcctgggtgaggactcagttgcccctcccctccctccacaggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggt

SEQ ID NO: 85043 - DNA, 1035 bp, Homo sapiens
aaaactaaaggaaagtataagagtagaggctttgatgaggaccaaagccttttttggaaggttttttttttttttttttttgagccgcccaggctggaatgcagtggcgcgatctcgacttactgcaaccactgtctcccgggttcaagcgactctcccatctcagcctcctgagtagctgggattatagacacccaccatcatgcccggctaatttttgtattttagtagagatggggtttcaccatgctggccaggctggtcttgaactcctgacctcaggtgatccgcccgcctcagcctcccaaagtgctgggattacaggtgtgagccaccgtgcctgacctttttggaaggtttgtaaggaacaggggtggggttgagaggaggccaccagccagtctcattagataggtatctcaggcagccgcatcagcgtgcgggattgcttttgaaactggactaagaggtttgagtcagactcaaggaagtctttggagcagcactgtgcccctgagggtgcgttagggagaggagaaataaggaaaggggattgagtttggagatttcttaggtgtcggagtgagttctttcaatgtaagagaagacctgaacagggcaggagaaagtcaacatcctggagccaggtgaagattgggagaaagtttgatgggggtcggggtggggatggttggtccagctcactgacctctaccttgtcgcttggcagggtggtgaaggaagaaatttcagatgacaacgcccgcctcccctgcttcaacggaagggtggtatcctgggtaagaggttctgacaccgaggaccaggccccctcagcattgccaagctccctcaagcctcagtctgtttctgtatcctccccaggccgcgcgttagcagccctggctctttacctcctgtctgtttggagagccggcgagaggccctcagccttctccttctggagtctctaatacttgctaggtttttttgctcttctccagctctctgagaccctttctcattctttcactt

SEQ ID NO: 85044 - DNA, 2021 bp, Homo sapiens
atggtaacaaatgaggctatacagaaaaagagctaaggacataacggctccggtctgggtgatacagtgttccacaggccctgggcaggggcagcggtgaggtgtcagacttgagggtagaggtaacacggactggtcaagaggacatgctgatgggaattggggtggggagaagtttttggagtacagtgggatttagtggttgaggtaggacattttggggtaaatccagtcactccttttcaagctgggtttgtggaggggctgagatgacactggggttctgctgaccctggtctcttcccccttttaaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgagaggttcgggctggggcgaggggtttgagggtgttgtggatccaacagctcaggcagaataccaaacaaacctttttttccccaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgt

SEQ ID NO: 85045 - DNA, 1027 bp, Homo sapiens
ctgtgtgtgtctggggtgggggtgaggggcgcgccgggccgcgtgctcgagtagaaggggccggagggcggggagcggttcggcgtggtcatcctggaccctgggggctggcgggcggcgtgtgcggtctcggagggcccgaggcggtggagcgcggccgggtaggaactcggggctccgggcgcgtgtgaaggacgggggcggctggcggcggcccggacgcggccccgggagcggtacggtggggtggggcgctgagggatccgagtagactggagtcgagagagaccgtgagttgggggggcggggcgccgggcctccggttgggggaaggggagcgctatagcgaggcctcagagggcgccgcgcccaggctccgcccctcgcggggcggaagggggagccggggcggatccaacacagctgggggcctgctggcctggcagagggacctgggagagcagggggttcacttaggaacaacggggtttagagggggagttttacacagattgttcctagtgtcttgactcagcttttattgcttttccagatccacctccgacccttaagccagagactcaggtgaggtttgccttacctttgcagcctagtagccctgcctgacaacgccccccgccccccttttctagacctcacttagggactgtgtttctgggaatgccattcttaaactgtgtggctttgcatgtgatccatatctccttcctttcagccaccagagaaacggcggagaacaattgaggatttcaacaaattctgcagttttgttttggcatatgctggttacattccccctagcaaagaggtaggggcaagagaattactgacttgaggctggtgtggtgggactatagagtgactgttgttcaaacagaactgtattgctttatagaaggaggcccttagaaattatatgtaagaccagggaagttggagactcttagggctgtggtaggaaagctggtatgcggggagtggatggccgggatagctagcttgaaca

SEQ ID NO: 85046 - DNA, 1038 bp, Homo sapiens
tcctggtctccccgccgctccccgggggaggggagcggcttggtgcgcctgcgccagcctgtggctttctgggaatcaaagttccggaggttcatgcggtcccttttccgctgttcccggacggactacaaaacccttggtgcactgcgcctcggcgccggcggggggaggagggagagaagaggagggagggaggagagaggaggtggaggaggaggaggagggagcaggcggccggcggcgcggggggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaaggtgagctctcgaccggtgcagagcgctgagccggcggggggcgggcgaggaatcaattggcaaacttggaggtcgagccccggagcccagcgggggagttcggggagggggtcgggaggctggccctggaggtgggagagcgacgagttgagagaccttggagaaagaggagtgggaaactgggctggggtagttggagatcagacggtgtgggggtgcgggggataggagcttgaaacccggagcctcgggggttagggcccgaaagggccaccggcagattggggccctggaactggaaggttaggggaatccagtggccggagagttgctcaggagggaggacgtagaagaggctgagtgaggggcccggtagttcgccgaggtggggtagtttgtggcggtggtaccggagctccgagtagttgccgccggagaatgcccggtgattgtcggagaggtgggcaggtagttgtggggagaagagggggtctgggtattgtctacggcagacggacctgtaccggggggtagttgtggagagagcgagccaggaagc

SEQ ID NO: 85047 - DNA, 1456 bp, Homo sapiens
ccaccagtgccacaatgggtcagctgtaccaggtatggtgactgggaagtggtggaggctttggagaggaatcttggaagagcgtgaggggaagaaagtgttgttacatcagtagttttggactagcttcctggcttgccttaaagtttcataatagccgtgggttgggggtttggacagaacagtaggagtagagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctcatgtaaaaaaaaatttttttttactgtgggttcctgtggagaaagttccgaagtacctgctttaggtgaacatccacatttgctagaacattctaactaagatattttcatgtgtgcaagctagtaaaacggctgttctcagttgcatgtcacttggctagacttttgccggtgtgtgggatccggcagagtggaatcagggagggagaagactgggagcgggagccattatcgcca

SEQ ID NO: 85048 - DNA, 1050 bp, Homo sapiens
cagccaggccaatatagttaaaccccgcctctactagaaatacaaaaatgagccgagcgtggtggtgcacgcctgtagtcccagctattagggaggctgaggcaggagaattgcttgaacctgggaggcggaggttgcagtgagccgagatcatgccgctgcactccagcctgggcaacagagcgagactccatctcaaaaaaaaaaaaaaaagaagaagaaataagcctaaattacatacatagtacctgtggtaaatgttcattatgtgctccctgttactgttactggggaaggcttccttatcaagggtttcaatcctcttttgtgctatttgtaggtaattcagtaccaaactgttcgatatgatatcctccccttatctcctgtgtcccggaatcggctaggtaagtatgtggtgggaagcctcctttagggtgaagtaggggctagctctgggtcagaggtcggtcaatattattcctccccactctggttcagcccaggtgaagaggaagatcctggtgctggatctggatgagacacttattcactcccaccatgatggggtcctgaggcccacagtccggcctggtacgcctcctgacttcatcctcaaggtgtgtggtggtggggagtgatgaaatggttccatctgttcctctgcccaaacctggactccctttcccagtcccagagcatctgtctccatccgctggcaccagtgtcagcctggaggagggaagcagatgggtggggcgttttctaggcctgggttgtggtggtcatgacatcccccagcccatcttgttcctctgtaggtggtaatagacaaacatcctgtccggttttttgtacataagaggccccatgtggatttcttcctggaagtggtgagttttggagagctaaagggagctctgtaatgaaggaatggttttagggctctgggaattgggaggatttggaggaaggggtgaggagaaacgggttagagcagttttctagaggggaggctgtgtaatggtaggggagtggctttcagtactt

SEQ ID NO: 85049 - DNA, 1067 bp, Homo sapiens
gtggtttgagaccagcctggccaatatagcaaaaccccatctctactaaaaagacaaaaattagctgggtgtggtagcacgtgcctgtaatcccagctactcgggaggctgaggcaggagaatcacttgaacctgggaggcggaggttgcagtgagctaagatcacgccactgtactccagcctgggcaacaaagccagaccctgtctcaaaaaaaaaaaaaaaagttgagggcaggagctgaaagcagtcagttaaataggtgattgggggctgaggatgtgaggtcctggagtctgtctagtttcttcagtaagatgaaaaaaactcttttcttttttctctccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgt

SEQ ID NO: 85050 - DNA, 1439 bp, Homo sapiens
tccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccggtaaggccgcgggaccgacggggcggacgcgcccttgaccgaggtggcggggtggcgcgcgtgggagagccgaggccccacggctgggggccctgggttgccggggagctgcagggcgaggaagtggtcggctgggggcggcggggctgggcgggagcgggccggggttccggcggctgcacgtgggcgcgcacctcggtcgcccacgttcctcttcctcccccaacccagcctcgtccccggctcggagcagcggtgcttaggccggggccatcccctcctccattcccgggcaggccatggcctccgtcatctcccgtccttttctcagacagaaacggccccggggcgcggggcacggggcgcgccgagggccgaagggcggtgcggctggtcagagtgggccgccgcctgctgcctctaatcttatcggccgattagccgaagccacaaacccggtggcctcgatagcgggctcagagcag

SEQ ID NO: 85051 - DNA, 1062 bp, Homo sapiens
ccccttccagccttttgctccttcctccttcatctttggtcatctccccttcctgcctttcctgctttggagcttcctgtttcactccttgtcttttttttgttgttgtttgagaggaggaagtctgtgttacccaggctggagtgcagaggtgcaatctcggctcactgcagcctcgcctcctgggctcaagcgatcaccccgcctcagcgtccccagtagctgggaccgcgggtgcacaccaccacgcccagctaaagtttttgtatttttggtagagaagggttttcaccatgttgctcaggctggtcttgaacacttgaactgaagcaatccccctgcccccacctcctaaagtgcaggattacaggcgtgagccaccgcacccagcccactccttgtcttttcgtttacctttgcgccttgtctccagtctccttggaacccagcatcagcaattaatctttctttcctcttcttaggtgcacactgcactttccccacccaccctgcccagtttcctcccaatcttcctactaccctccaacctcctcatacttctcagattctcacataccctgcttattctggctctctctcatttcattttcctctctccattttttacctcaactctctcacgttttttatctttgttttgccctctcaaacatttctctgtctttccttcgtttattcgctaaacatattaaagtcccccttatgctaagctaattgacctgcttttgtataaaatgaagactttcatgaactctttttttttttttttgaaacagagtttttgctcttgtcgcccagactggagtgcaatggcatgatctcggctcactacaacctccacctcctgggttcaagtgattctcctgcctcagcctcccaagtagctgggagtataggtgcccaccaccacgcccagctaatttttgtatttttagtagagacggggtttcaccgtgttagccaggcagatctcgaattcctgacctcaggtgatcccaacccacctcgacctcccaaagtgctgggattacaggcgtgagt

SEQ ID NO: 85052 - DNA, 1101 bp, Homo sapiens
caacactctcacagataggtaggcaaggcaggcaacatcacccccatctcacagaggacactcaggttcggggcagggaagtgacttggccaaggtcacacaaatctgagctcttaaggccaagcctgtctcaaggtcacagaagaattttgagacaagttctcaaacatttctctgccttatggacccaaacatccagtttctcctttatgcccaggttgcagttcagctcctgtttacattgagatctttgtgcaattcctaatatggcccagtttccctcacccaacatgttgggtggagcccagtatcttcaggctccagctgggcccgggcccctagcggaaggaaaaaaatcatggttccatgtgacatgctgtgtctttgtgtctgcctgttcaggatggggaaccccctcagcagcgagtgactgggaccctggtccttgctgtgttctctgcggtgcttggctccctgcagtttgggtacaacattggggtcatcaatgcccctcagaaggtgagggcctgcagctggcagggtgggggtacccaaacgaggaggacaggtgtctcgggggtggtggaaaggggacggtctgcaggaaatctgtcctctgctgtcccccaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggttcgcagctggagggcaggggtgggggaaacaggaagggagccactgctgggtgccctcaccctcacagcctcactctgtctgcctgccaggaaaagggccatgctggtcaacaatgtcctggcggtgctggggggcagcctcatgggcctggccaatgctgctgcctcctatgaaatgctcatccttggacgattcctcattggcgcctactcaggtactcacgggcaccacagccctgcctagcgccctgttctctttcaccatgcctgggctttcagatgggaatggacacctg

SEQ ID NO: 85053 - DNA, 1042 bp, Homo sapiens
ttcctctcaggtcccctcaggcctgaccttcccttctccaggtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgtatgtgtggagcagcctccaggcagggcacagccccgggagggtagacgagagtggggagcaaaccccctccaccaacacccagggtagggccagcctgttgtggctggagtagaggaaggggcattcctgccatcacttcttcttctcccccacctctaggttttctattattcgaccagcatcttcgagacagcaggggtaggccagcctgcctatgccaccataggagctggtgtggtcaacacagtcttcaccttggtctcggtaactgctcacctctggaatggcccgagccactggcttcacctccctgggtgtcccggaggtcctgctcttggttgccctcacccacgcggcccctcctacttcccgtgcccaaaaggctggggtcaagctccgactctccccgcaggtgttgttggtggagcgggcggggcgccggacgctccatctcctgggcctggcgggcatgtgtggctgtgccatcctgatgactgtggctctgctcctgctggtaaggcctggaggctaggaggggctagcagcccaccccatgggaatggtcctgtgagtctctgtgaccagccagggtcccttcttaacacacatgctttcaatcctggcgccagctccggaccaggactggggctgactggctccagaatctgctgggattgtggtctgctcctgagggatttgggctgcactgggaggcagctgtggcacaactctggcagccaggagggagagcccctgtcaagcctcaggaacaatcattcctaaggacccagctttagagtccagggagag

SEQ ID NO: 85054 - DNA, 1167 bp, Homo sapiens
ctcaggtcccaccccagacctggtgaatcaatcagagctggggctggggctccacaatcggtttaacgagctctccaggtgattctgatgcacgctacagcttgagaaccactgcttggtggaaagagctctcactgggactgaggtaagaagcacagtgcattctacccactttgcgactgaaggctgtccctgccttttgctttggagttcatatttcttgcctccctttctgaaatccctgaggggtaaagcggggcgggaggggaggtgcggggagtgcatcctggggatggtggtaactgcacaatctgctgaggccctgagttcaggacttttcccctgctaaactttgaccacctccttgctccaccctccagctctagaccccaagtcaaatgttgaaagaatgaaattgggtggtggccccagcaggggtgacagagactcctgtcttgctgtctcacttttcacatggccttttccccaatcagacagctattaaaagaaacaaccccaggaagtttctgcgcagcgttggagatggggagactgtggaatttgatgtcgtggaaggagagaaggtttggggactgctatggggtatagagttgactaggcttacgggagggtggcctggaggtcatcacaggctaagaccctcctggggccagctctgacccgttctgcgggaatgggactgtgttctctcaccctgatgtcctcttccttaatgctagggctaagggatgtcctaagtatgtccctgtcatcggtcggcagtgtctgggtttcttctctagttcaccaagcacttcgacatccgttctccacgtggggccctgtcctagacttcccgagtccgcctctggagtaaaaaggtggatgctggctgccaggcctttctccacccagtcgtatactcaggagggtgcagtagcaattatttcaaaaggacatgttgctccttcccaaatgggtgcaagcacattccactgcctctccagggagggtagaaagaagttagaggagctaaaggaaagctggagaggggtcttcccctgaaagaaggggaagcaagttgggaaatgcacattggctgttggagcaggttctcactattcccttaccaccttcccagggcgcagaagccactaatgtaactgg

SEQ ID NO: 85055 - DNA, 2540 bp, Homo sapiens
gcaatccggcgacggcggtctcgggaacccccgcccccccggcccggagtcaggcggacaagccggtgctgggtgaggggcaggcgcgcacagggcggctctgaggggtcggcgggctgggggaggggcagtgtggagcccggcaggatccggaaaaccaaaggcggcctggcccgcaggcccagagcgctaactgggctgggagctgcgcaccaaagtggattcccctggtgggaaatcctgccgtaccttcctgggagagagggcggggccggcaggttcagctaaggtcttggggtggagaataaagccccagggtccggccacgcccccgggcgggacacagtgcctagttgactgggttagaactaggcaaacctctgagcctggcaagcaggtgcactggggacccttgcattgggagggctagaaaaaccctcagttatgacctgggggcggcactttgcagaccaggtgagtacccagttctaggtgaaggggctggatttgtaggatgtggggaacgtgacttagagttggaaggctttttgaaagcctgagtccctgtgtgggtgatttcatttggtggactagggtaggaataccttgaagctactagtgaaacctggttggcttgaaggtaacctgaataggtaataaggcagtaggctagatttttttttgttttggagtgtctcaaaactgagttcaactccatctcttccccccatctcactgtccccactgcatctctgcctggcagcaatccaagtcctgggcactgtcaaatggttcaacgtccggaatggttacggattcatcaacaggtatccaaggaacccagggcgggggtggaatgggtgtcttcccagctggcctgtgggactggacacccgcccaacctcatcgacccctgcggaggcacatggttgcaatgtccagctgatgctggttgaaagcctttaaccgcagcacaaatgtgtgcttcgtgacaagaggaagcctcctccgcatcttcaagggtagcggaggattaatgattcaggaacttggcaaacctggctctgaccctgccagcttctcatctcaccttctggaattgcttcattacttttactctgacatgcctttggggcagaatgtattatagggttctctgtgcctcagggcccccggctggaatcctcaactgatttcctgttatggcagcactcacaactcaactcccttaaagagctgtggctcattcgagccctccacctgttgggactgaggctgacagtgggggtcaggaggaaggagccagaggctgctgctttccttcagtaggcagccccacccctcagcaccgggagaggctgtggcagtggattctgagcagagccaggtctcccccagtgggcccttccccagcccaggcatcctgcccggcctggctctcctgggaggccctagttccctcttagcaggctgacctttgtgcagatccaagtgctttaaagctaaaacgtttgttctggggaagggtccctgtctaattctggaaatggcagactgggtcgggggcagagtgcctccaggaaaacttttcctttctcccctccccccacccactggggttcttatgatagagaatgggtgaatgttttcttctctctcacccttggtcccacgcgtgttgagagtggtcctgactctgggattcacctccaggctgaggatgagaataaagtttggcagctgtttagagcaagttcctgacacattgttcccttctcaaacttgttctgcccctctggccccatctgcactttctgcctccttgactatagaaggaagaagactggaattttccaaccctgatgggggttgggggagggggtgttggccagggacagttgcacccagcgctggcaggttgtaaggctagcctggggtggaaggtggagtcccggcaggggcagagctgtctgaggttcctcaaggtgcctttgcctccccagcctgccctttccttgtgaagtccaggtttggcactgaggttttaggtgtatctctctttacaccagcttctgggggccctgctggctctccctcccattccccaggccatgtccacccctaactggaatgctggagaggatgggcccactgagcttagactgggcatctagggggacctcagtgaggagctgagggctttgttgaagtcccttccttaacgacccatcctgttctgcaggaatgacaccaaggaagatgtctttgttcaccaggtaagagctaggttagctttctgaggggaagaaccggccgtctttgaaggcctttgctgtaatccttagcagtgcgctccgccatgtttctctggctcttcttcacaacggcccatccgccttgggtgcctgtgtcaaccaccattagccgcacttgtgctgggttactaaacgtccgtcagaattgagcatgttacccctgggcatggcacgcttactacccaccgggacctgttaacactccaggaagcactgaggcagttt

SEQ ID NO: 85056 - DNA, 6071 bp, Homo sapiens
acgggttcggccagagagcggcgcgaggtgaggagaggcgcgggcgcgcgccccggttggcgcgcggggtgacggttggggttggcccggtgacgttggagcgacgcagggcgggggacggcgagccgcgaggcagccacgcgggagaggccgccaggcggccacgccggggcgagggccaggggccagatcggcccaccggggcaagggtacctgggccgttgaggacccggctcagcgcggccacgtgaggtgggggagggggctattcggtgagagggcatgatggggggggttggcggacggccggggggaggggaggcggcgtggctccggcctggcgcagtctctgaggagggggcggccgcggcaccggaagtgccccccacgggaggctgccctcggggtcgcaggccgcatggccaagcgtggaccggggccgcatggcagcgcggggacccctccccccaggtcccggccaccggaagcccggaacggccacatggtcggcaggagccggcagcccctagcgcggggagctagtcctcgcgggggttccgagggggcctgagattttgaggagtggaagccggaggctcgggtcctaatcaccccggagggcctgctgcaggcatatgttagcgcttcccaacctcaagggccccaggagctttcctgaaaaaccctcctgtgaagtgtggcggtcagccaggtgtaagtggcaccccttcgagctgggaggccggagaaatggggaaacagggcgtttggacaggagcccaacttttctgtcggcctgggtggacagcgcctaaaagcctcaggcagatgagtttcccaccgtgataggcgttcttcaccttgtcactgtcttcctgttgtaactggtttgggagttccacggtttcgaagtccttaactctactagcctagtatgattttctactactcactactaccaaccttttgctttcattttattgtcattcaccaccccccacctctcccactttctactgactgtactggcccggcctgaaaagccgacaggacagatgcatcctgggaaaagtgggagggccttccaggagaggctgggttcctgggttctctttgggaaccaagatcgaggtgtttggcagggggatcatttcggaaacaactttgctttctcccccttggcttgttgcaagtgcatgttggcgaggcgggaatcccccaaagaggccttgtggtttcctgtagcagtgactggtttgtgtgtggatgggggggggcagtgtaacagatgggtggggccttgtcctccggtctccaccctccccccccccaattagccctgcccttttgctggatcatagctgctcacctaattatagccctggctatatgtggggaagaggggtggttggtttcagtggcaagtaacacctgagtcctccccactcccaggaagtaggccttttctcatctctgagatttgacattccagctccctagagccttcctttcccaagccaccactttagctttgatttatgggggagaaaccagctattccaccctcccatacacacaccagttcttgagtatatttgagcccagtcagtattttaagttcaggaactttgactttattttaggtgggtaatggaataaagagttgggaaaatgtttctggagagaaatgggatagattggaggtcctgttgacctccatgcttattcacttcagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgctagcacttccctcatcacctcagacttttcctgtctctttagaatttcaacctgattcgttcttgttgaatttcttgtggtgtttttccttaatcagtttttccatcttttgacttgacattgatcttggattattctctagtgtctggatccctctctgtgctcttctggcttccttattttctagctacatagttatttctgatctccctgcaagtccttttcttcagctctttcacatttcttagtttcttatcctttcccttctaccttccttattccccagtttctcagctccttctcctggtgtccggaaaactcttcgaaacttttactcagactcctcccactcccctagactcttagcatcttatcttttatcaaggtaactgtcttctccaagcctgccatgcagttttctattgtgctgtcaaccccaatctcaacggtggttttttagcctctgttttttttctttaagaggctttactgtttcttgagttgactggttcaattccaacactccagtctttgccccaacaatgtaattctgacttccctcatcaggcaaggtcaatttgagcctttatttcctccgttttagagtttggttgggtttctctttgtgatgcatacatacaggtccatctggttggtattgacatctttactgggaagaaatatgaagatatctgcccgtcaactcataatatggatgtccccaacatcaaaaggaatgacttccaggtatgtagatggtctggatgaggatgggttagcggtttatggtggagggaggggttgggggatagggactgaccaggagagcttgtgctgggagagaggagggaaatggcaggagagggtgtttggtattagtttgctatcagtccagtttgtctatcagagcctttactgtcatgtcagcctccctgggcctactaccttcagcctccttccctatctgcccccagctgattggcatccaggatgggtacctatcactgctccaggacagcggggaggtacgagaggaccttcgtctccctgagggagaccttggcaaggagattgagcagaagtacgactgtggagaagagatcctggtatggtgcctccctccctgcttctgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccaggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaactcagctgcttatttgaattaaatgggtgtatttggaagccacaaaaagactgaactctgccactgagttcactggaacccgctgtctatcactttgacttgctgtggacctgccagccatccccccaccctccaagcaaccttgacctattccagacagttgggtgggaggcaacacaaacagcagcagccaggggcagtggcaggtagattttattggcctgggacacacaggggataccctcacccacgatggggtggggggtgtggtgttgaagatataatctgatggtcacttgtggtagaatcgcgggttctggctgtgttggatgaaggggagccgagggccaggttggctggtagctgcaaagcccgactggtggtggtgatgaaaagagggctttgtcactgggcatactctcccttccacttaataccctactgataaccacccccaaagaggaaggaaaaaccagatgatgtgggccacctgtcctacctaatcctgcttttccggatccctagtgtagggattctgacaggtaaattctattaccattcttacctttcctgctggctgcatctgcacagggagctggggggaagcaaggagtccaggggctggatgcagagcctgggggtgcatggggcgcagagaggactgcagagaacagagtcagggcctgaggcatactgaagctccccttaacatatccctaaccctgacctcccaaggtgccatactcactgagtcggagaagccagtctgctggttagcatgttccatctgcttttgcaaggacagggcaccaccaggctggaggaaacctaggtggggaagaggggcatgtgagatgagaatgaaacagggaggggaggacctgagagctagagctcctgcatgggatgttatcacctgtctgagtgggctgaaagtggccatgcacagcatagggctgtggctgtggctgagataggtactgcactgcagggaatgccgaaggagctgagaaaggaaaagacagagccattaaaatcttttactgaatggcattcctcctttgaccttgaggaaggccaagccccatccctcctattactcacctctgagctgctgactaggactataagctggctgtgtgggcccatagtgaggtgggggctgagcagtcccataggcaccaccaggactgccttggaattgtccatgctctggtgtccctgcaaaagcagctgctgagcccacgtagtgccgggtctaaggaaggagaatgagaactcgcctacaaactccttgaaagctgaaacccagtgacttgtgtgtatctgtatgccccgtttccccctaaacttaagtgcttgatatgtttgtgacttgaatactggtggcaaggatgcatggatggaagtactaggggctaggcatccaatcctactctcaccgtaagcacttggggtccaaacatttg

SEQ ID NO: 85057 - DNA, 1032 bp, Homo sapiens
aggtgatggggcgagaggcttcactcccttattttttcttgtctgacagattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaag

SEQ ID NO: 85058 - DNA, 1072 bp, Homo sapiens
tcaagcgattcttctgcctcagcctcccaagtagctgggactacaggcatatgacactacgcccggctaattttgtatttttagtagagacggagtttcaccatgttggtcaggctggtctcaaactcctgacctcaggtgatccacccacctcagcctcccaaagtgctgggattacagtgtgggtcaccatgcccggctggcggttcttttttttaaaaaaaaaaaaaaaaaaaaaaaaaaaaagagggaaagaaacaactaaattagcgttttctggtccttccaagcataagaaaaggcagcatcccaggccacattctgggaggtgcagtattccctctctggctggggtgcggagcctggttcttcccaggaggctgtgattatggagtagttctttcttccccaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaaggtgagtaggagccagagagaaggaacaggaccaggcctgtgagtagagaagggctggccagaagggagaagtgggcccctagccttggaggtaggaccacaggtgtaaaaggggaacagtaatgggcaggcaagggcgagtagcattgcctggtcagtcttaggcctgctgcttcctgcggtgtccctgccattgagaatgtgccagttttggggaaggggaggggctctaggtaactgcagtgggaggagaacctcggcagtgggcaagcatggaggcaaagccaaggcactggcaaaaggaagcagagcaaagggcgggacagctgccgcggtggagtctgacctctggaagacagccggtctctcctcccagatctgcgagaagtttgggcccaatctggacacgtgccctgaaggcaccatcctgggactgcggctggacagctctggggggctgcatcttcatgttaatggggtggaccagggggtagctgtgcca

SEQ ID NO: 85059 - DNA, 1314 bp, Homo sapiens
cactatcacccaggcaccatcatgatgagcggctgtggaatcctgaccaatggcaagggcacccgccgggagtactgcgaattcagtctggatgagttgcaggtgagggtggggcacagatccctgggccgctttcagcagagccacaggtactctgtgtccctgccagggcaccaagcagggtctcctatgtgacctagaggcagtccctgtatcttccacctaaaggttccttcctagaagcctgagttgcccaagagttcagcactcagattttggagtcagatggttgaattcctcttactgttttcccatttgtagtagcgaaccggggcaagaagcttatcctctttgattgctcccccacctcctgcaatctctaaaatgagcctacgagtagtacttattccataggctgagacttgtagaagctaatgtctgtgaggtggtttaactcagtgcctgactcacgtggagcattgacgaaatgtggaaattgtcatgtctggaaaacaaggacccaggacctgtcctccagggtggtctgagactctcacgaataccttctggagttgttcctgtgtggagtggggtgctgagcaggcctcaggactcctctaaactgtttgtcttctttgattaggagggtgaccacattggcctcacaaggaagtccaactctgccctacacttcttcattaatggtatcgatcagggtaagggccgcccagagagagcctctgggccggggctttcggtggggctgggactgggggctgtacctcatcctcctgcttctctttggtgcttggcctccctgtgtttgactttctcccctcattctccctgtccactcccacacccccgtaccttcctgccacaggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccagtatggcccatggggtggggagaagcctgaagaagggattctaatgggggggggggggcggggcaaggaagtggaaggcagagggagcctggcgggggcagcttcctggaggttgagctttagttctttggcttggggcagtgagtgttggcaggcattgctgggc

SEQ ID NO: 85060 - DNA, 1028 bp, Homo sapiens
tggtttagtaaacactgagtagagagcagagttgctaaaggaaagcccaaataattaccaagacggagtccagaaaatcactgtctgcatctctggattagtgttccaagagacagaaagccagctagctgtctgagaggtgggaagatatggtggcctgtggaatggggggtggcccattctaagcctctgtccaatacccctatcccaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaaggtgagaacacagctagggcagtggtggtggggtggggacggaatgggggaaatagagtgacaagacaggctgggtgtgggcagggccaccctgatccccaagtctgttgaatgggagagcaggagctagaggatggggggttctcctggctatgggccgtgaagcagggactgaacccttattcccctcccatcccacctggtccccagccttcatggtgtccccagcgcaggcccggccggagacgtttcctaacagccttgagtcgcataatggtgagggctttggggaggccctgggaaggggagtgggaagtgaggtggacaagggagggccctcaggagaaggggtagggagagaggcaccaggtct

SEQ ID NO: 85061 - DNA, 1047 bp, Homo sapiens
cttgagcctggaggtcagggctgcggtgagccatgattgtgccactgtactccagcctgggtaacagagcaagacccggtctcaaaaacaaaaacaacaacaacaacaaaaattttttaaagggggagtgagatgggagagaagggggccttatttctcggaaaccagccctgctgccctcttcccatggccacaggagcctccccagtgacggagttgtgagattgggggtttctggtgtcctgacttccgtcccagggatcaccttgggtttcccacgttgcagagactaactgaaaggacatgagggctttaccctgggaatgctctgctggggcaggtgggtgttagctgcgattctgtgttattttcccatcctcagaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcaggtgcctgccccaatctgtcttcctggggtaccagagcctcaagtgtcacctcgaggcttgggggtctccagtgtgcagtgggaaggggtgctgtgtcttcaagactgatctggggttttttacgtcctcttttacgtcctcagatcaacgtgattgaggacaagaggaagtttgacatcatggagtttgtgagttgtggcgggggtgagggcagggtggagaagagcctgctgccagcacaagggaatggggagaggggttcttcctcagccttcccactgcccgccttgtcccccaggtgctgcgtttggtggaggcccaggctacccatttccagcagggccatgaggagctgagccggctgtcccagtatcgaaaggagctgggcgcccaggtggggccccagggcacagcaggtggtagagggaggttagggactcctaactggggggccttggacatctgagatgcccttcctgtg

SEQ ID NO: 85062 - DNA, 1058 bp, Homo sapiens
caccctcaaccccccttctcgacttctccatgcagaattctcttctggcctgtgagtttctcctccagaacggggcgaacgtgaaccaagcggacagtgcgggccggggcccgctgcaccacgcaaccattcttggccacacggggtagggatgatggcatggggaggaaggctgggagaagttgggcggccggctgaccctggctcttctctccaggctcgcctgcctgttcctgaaacggggagctgatctgggggctcgagactctgaaggcagggaccctctgaccatcgccatggaaacagccaacgctgacatcgtcaccctgtaagaatgcctgaaggggcggggctggcgctgggactccccccacccccgcccacccacgttcgggcgggcgggcggggctgacgccgaaacagaagcctgtgctgtggggcctcggaaaggggctgggccagcgccggggccaggctcgagaaaggctgcgcgaagtgtgcactgggacgtggagtagaaggcaggcgggagggcgggcagggtgcaaggatgcttggcccaccctgagaggcgtaattcgcccatcaacattgctgtcaggcatctttttagcactagacgtgaccccgggggtgggggcagatgaacggaacgcaacccagctcaaaggatgggaagttgtgggggaggtgaggatagtctttttttttttttttgagacggagtctcactctgtcgcccaggctagagtgcaggggcgcgatctcggctcactgcaacccccgcctcccgggttcaagcgattctcctgtctcagcctcccctgagtagctgggactacaggcgtgcgccaccacccccggctaattttttgtatttttagtagagacggggtttcaccatgttggccaggacggtctcgatctcctgacctcgtgatccgcctgcctcggcctcccaaagtgttgggattacaggcgtgagccaccgcgcccggccaaagatagtgtcgttcatttcttaattccctcctcttcaggctacgactggcaaagat

SEQ ID NO: 85063 - DNA, 1456 bp, Homo sapiens
catttaatgctctcaaccactggatgaggtaattattattagtagtattttattttgagacagtcttgctctgtcaccctagctggagtgcagtggtgggatcttggctcactgcaacctccgcctcctgggttcaagcaattctcctgtttcagcctcccgagtagctgggattacaggcgcctgccaccacgcctggctaatttttgtatttttagtagagatggggtttcaccatgttggccaggctggtttcgaactcctgacctcaaatgatccacctgccttggcctcccaaagtgttgggattacaggcatgagccaccgtgcccggcctggatgaggtaattattatctccatgttactgatgggcagttgaggcactgagagtttaagtgacttgcctaaagtcacatggtaagtggaggagttgggatttgagccagtcagtttgacttcagagctgttccctaagctgctacactctaccactaaagcttagtctttactctgaaggcatttgggagccagggaagcctattaggcaggggagttacaagccactctcaccatgacggcactctgatgtggcgcaagaatggattagagggatgatgctgaggctgggagaccaggtaggcaacagtggctgtgaagcagaagggagatgaagaggtctggatgagggtagaggcggtggggctgcagaggagtggaaatttcccagaggggcttgggaggctgctctgacaggcctggatgtggagtgaaagcagtgtacaggatgacgctcctgttagtccccccaggtagagccagggccctcctctcttgctccttgagccctgacctgtttgtcatgggatccaggtctgcctccctcactgaattacaatggggggacagggagagtcccaccctgggcccagcacagactacatacagagcggagctcctctttattcctgctcccatattacctatctgactcaggccacaagcccagccaccctttcctcttgtctccacaggccgggccttcggaagcatgttgtgtgagggatgtcacagaaccaggcgccctgaggatggagactggtgaccccatcacagtcatcgagggcaggtgacagtcccatacctcccaagcaccctcaggaggaggataccctcccagcctaattcctgatcccttctctgcttctctccagctccttgaaccctgatcttctgtctcatctcctctccccactgggtcctgaaagctccagcatggtcctggcctccctgctggagccactgctggcccatagagccttattgcattagggaaaaggcttcccttcctccaggcagatgcggctccaaggcacatagcctagtgagctgactgtgggccagggcccagccctaactcttgcccttattcccatcctatttaccagctcctctttc

SEQ ID NO: 85064 - DNA, 1078 bp, Homo sapiens
ggagggagttcagaggttgaatccccacccttcgtcctccaagaggttagatgaacaaagactccaaagtttatttgcctttcctttttaatcctcttcttactccaactctttaaaaaaaaaactgcccagaaaacccagtaattaagcaaaagggagctcaaagagccaaggcaagccagcccaagagtagcagggtccctcccgcaggggccaaagtctggatgctggggtctccactcagagcctggtagtaaaagctggtgcagaataaggtcgttccggaagctagcaataacccagcctgaaggagacacagcacagaaaacaggattgttaagaacagggcaggctgagagggagtgtgtggggcttggtcagggttaggcgcagggaaagattacccagagtggctttctgcaatggggcacccctaacagggccaggctgtgtaagaagtggtgtttgttggccttgtcaaacagctgtaagaaaaacagaaacgaagggatgtcgtaggcaatacaggtactgagatcccctgatgacacaagggaccaaagttccttcccccaccccacccttgaagtcccagcttgatcccaggcctttggcttacagagcctttggcctttgctgctccagagatccgcggctcgccccaccctctccccgcccacttcccccagggaccccagactttgtgccttcgtagacccacgagtcagggagccccagcgcagttacttcacctccttcccgtaggcatctgggaattgggcgcctgtggagaaaagaagcaaaggttagcggtcctagtgccagccctgaccgcccccaatccggggggacccaggtggacattggcgagaaagggcacccccccccccgccccaggaagcttccgattggtgggaacacgctcgggcagtactgggaaccaattggacccagctgggggactttaaaaggtttagggctccgcggactgtctgataaacgagaggccgggcacctcccataggttacgcccttgcagcagaccccagaggacgccccaagtacagtcccatcttcg

SEQ ID NO: 85065 - DNA, 1034 bp, Homo sapiens
gtggactcctcctccagcacccgatccttaggatcctccgcctggaccgccttctggtccctcgaagccggcccacggaaccagcggatcctcaatctagtcctgtcccgttgccccctcctttctctatcgtccctactgcggggttccctgttctcgggctccccctgatcccatcccctagctctccttttcccggggatcgactggatcccggccccgccccccggggctggggcgatccccctcccccgccgggtgaggcgctgcgggcgggggctgggcctgcggggccgcgggggctcagaggccgccgccccctcccgaaggcctttcgccccccactcggagccctggatggaggcaccacggccccagggctgagccaggtaggacctaagccgggtcggtggagggggctgcgtggcggtccactggggtctccctctccccatctccctccctgcgcctggtttcccccagcctgctctgtctgcgtgtctccgcctagggatgctctcgccgtgtctctgcgtcttggtctctttgtctctgcctctctccagtccatgaatgatcctttgaatgggcccacagaccccgtgtgttcccatctccccctccccctccttctccccttcccagccaagccattttcaccactgcaggaagggggggcctgcggcctgagcccccgtccctcaactctccccggctgggggagtcaggcctgggcaggaatggagagagaaggcagagggatagggagaaggaggagggagcaagatgtggcagacagagatgaggagagaaaatgggggagacagtgatggggaaagacaggagagagagacagaaggcttaagggggaaatttggggaaggcatttggagagagagaaagaaatgagaaacaccaaggagagagatacagaagagaaagatgtaaaaagaccgagggtgagagactgaaggcaagagctggggcaagctggaagaggcccacaaaagatgctcccagggagcactacggag

SEQ ID NO: 85066 - DNA, 1980 bp, Homo sapiens
gaaaggcagggggcatgactgggtgtgtgtggtaaggattcctgtgtcctcatctctggaataaattgacacctgcagagagccacccgcgggctggcgcctggctctgaaaaccccgcgtcagcaaacagctctggcggctggtgggggggcggggggggggcttgccgaaatgacctgggtgtctgcccctccggtctgatcttctcccttggctggcccctgctgccctgagcacccaggcatcagagcagcaactgtagggggggtggcaaggggaagggtaggtgaatggatgggttgggatgggaagagaagaaagctcagtgttgcccccaggacatgggtcacaatggcttgcaaagatgaaaaggtggtggggtccaaggttgcttgaaattgctggaggggggcagtcagtaggctcctgtgatgtctcttcaagcccacctcagcaccccctctcccaagccagaggcctggtcactaaggctaggctttgattggccaacaggcagggcttttagcgttcttggtgcccccaatctccccctcctctcaacatatatacttcttcctctatgttaaggttggggggaactcttgcattctgactcacgcctttgccctccccttcatgccctgaatggaccaccaaaccaagccagccccttcccgtcttcctccagaacccccctccagggttaaagctgcagcccgttgccgaggtaacattgcggggcagcatcccgtcacccggcaaccggctgcaggatcacgcatctgtccctggatttgcccctccagcgtcccctccctactctaaccccagcctcaaggtaccccaacttctgacggaggaaatggagagagtctggggagagaggggtcgcaggcagcacaaatccttagcgaatggtgtgttgaagtggggataaggtgctaggtttgtgcagtcccaagaaaggcctgagtctggcctggggtgggggttcagcgccatgaaattacagctcaggagtaattaacacatataaacaaacctgcctcttccagctaattaatgacttggtatttttgttttctcttccttgtctacctcattccctcccagggaggtgggagctgggactcctgagtccctgaggagaacctgcctgggagggatacatcagctggaagggagcatgctgggtctggagagctgacccgcctctcctctggctgggtcctggacttgaaccacatctgggccccacccccaacctaggcgtctgctgaggggagaagggctgctgggtgggagtggggaggtgtcagggggcctgtgggtgggagaagggggcaacttggtctgaattccaggtcactaaccacttgtctcttctgtttccccattcctttctgtctgccccatccaatttcccttgccctcttccacctctgtatttttctgtctgtccgtctgtctgtatcctgcctccctgcccctctcgctccaccccccgcaggtcgggcctgccttcaccttctcccatttccttccccttccccaccccgtgccccctccatggagaggaacagaccccttctctgtccagtctaacccaggtccctccccaaccccctcctccctcctttccccccgcccctcctccctcctggggcgaggggggcctccctccctctcccccccttctctctctctccgaggggggggggtcccagggagggagggggggtcccccgatcagcatgtggctcctggcgctgtgtctggtggggctggcgggggctcaacgcgggggagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgcc

SEQ ID NO: 85067 - DNA, 1036 bp, Homo sapiens
ccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactgggtgagggccagaggggctgggcggggctgggcggggccctccctccttcacatggccgccgttcctctgttaaggcactcactctggcctgccctcttgctcgagtgaaaccaacccagacacctctgtgccaggcacggagttgagcgttggagactcagcagtatcagacagagaagccgctgtcctttctggggagttgggggcccactcagtggctttggcttggcgtctgtctctccctcctccttgcctgatcccccctgcccgacccccctagggctctgcatctctggctgactgctcaggtgtgtgtgtctgagtgtgtgtaagagtttgtgtgtctctacttctgtctctgtctctctgaaaatccactgacagctctccacctccctctgctgctctcttttgtctgcttacttttcgctttctctggctgccggctgatttcagcctggctgtgtatctgtctctggctgtccctcccgtgtctttgaccctgtctgtgtttcattcaggctcagcttctgcttctccctggctatctctgtgtgtgtccctgcccctctgcccgcatttctggctgtctctgccagtctgtctccatccctatttgcctatttgcctgaagagacaggcagtttctctgtctcttcatatccatctgtgtctctctgcctctgtgactttttctctggctttcttgctgtccccctgtctctctgcatctctgtctgtctccctgcccactgccatccaccctccttcagagccttgccctcactcctcctttccctgccctcctgtgcccacagggaccccaaccagccggtgccgcaggataccaagttcatccaca

SEQ ID NO: 85068 - DNA, 1095 bp, Homo sapiens
ctagtggcccatgcctgtagtcctagtgactcaggaggctgaggtgggagacagttgggactgcagtgaactgtgattgcaccactgcactccagcccgggcaacagagaagaccctgtctcaaaaaaaaaaaaaaattgaaaacaaggtagaggcaggtaagagccttggaacccagaagggcctaggaaaggctgaggacagggacaggcctgtggggcaaaaggttaatgagggtcctcagggctcagggccctgtggctagggagagcattctcttcacagccacagcttctaggtgctgtgtgggccctggcaccccagcaccaccacagatcacctcctctctcctttttatttttttccagtcacctcccagttagggaacggtacacccaattcttgcttgtctcctcggcagtgctggatccagaggctagggggtagcagccggacagggcctccacctcccgggtcagttcccgaagccgccgtctcatgtcccgggcatcatacactattcggcctgaggagcggtgccgggaaaattcagggatgactgctgggcccagggtgggagctgggacaggctggtactgagccgcctctgcctctggcaccgccccctccccaccgttcttgtggctaggagcctcagggctgggaggtggggggttcacaggatacacataggcccttaggcccagctcggaccatatgcctgttttgaggggcctttcctctacggtaggctggaagcggatggtctggggaggggactctggggcatcctgagaccagggaacccaggtcccctgagtgtgttggaagccttcccagtcctcagggacatcccagtggtaggagcagatggctgggtactgatgaggcttctcgtcatcagtgtcaggagcccaagctactgggcagtgagcacagcgtgtgggagagcctcgacggcgatggcggtgagctgggggcggggacacagtcatcatcacagggtccatggtgcaccgaagatggactgcaggagaactctgcttcttagggggctgggtctgctttctgagtaatgatgacttgggagcttct

SEQ ID NO: 85069 - DNA, 1095 bp, Homo sapiens; identical to SEQ ID NO: 85068

SEQ ID NO: 85070 - DNA, 1071 bp, Homo sapiens
gtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaacccca

SEQ ID NO: 85071 - DNA, 1067 bp, Homo sapiens
gatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggtt

SEQ ID NO: 85072 - DNA, 2058 bp, Homo sapiens
aacatcggctacttccggacaagccactggtcctgccatcttggtttgttcatgcatattcagcaagagaactgcatattcatgagcaaccgcccttccccgggaggacccgccccgccccgccgccattaccgattcgcagagcagaccattttccagctggggggggctacgaatgagaggcttttgctgaagatgaaaccgttgtccaaactagaatgaaagcggcccaattttaccctcgagtcttcaaaccttaagcctcagtgcaaaagggagcagcgaggagaggcggtgggattaaagaaaaaaattcttctctccctgtcacttcaaaaggtcgcccaaccagcgagcggggggtttacccacgactctggctcgcaccccttgcgggcctgcgcaggcggccccgtagcgcaagggagggcgggaaaggaaggggcggggacgcgagggcgaatctataagaagcgtcgttcagcgagttcgctgctcagaagcgccgagagcgcggccgggacggttggagaagaaggcggctcccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactggtaagcggctctgtcctccccttcccccctcctcccctggcgggcggggccggacgggggctgcggaaacttggcgctttctcgctgcttatgggtgacgggccaggagcatggctcagcagcgccaaggccgtgtaggcgccagtctcgggcctcccagagttatattttgcaaagagttgagcaggcgtagcgctttgtccgagatggggggctggctggagggtgagaaggagggagagaaggatgactgatttcacactccagagttaccgacgttaaaggcgatccgacgaatcctagggagtctttacaagtttggttaagaagccaaacccgggtagcttcctcctcttctgtaatacaaatgttaactgagcacctgctctgttgaagacacaggagactcgggttacagaggtgaacacgacagaccaggaccctaccttcaagagcactgtctgtgggaaagggcaagcagtaaacatgaatacaatgaatgaatgagataattcagttaatggcatttgtctcgaatagagtgaaaaggggtaatcccatggagagtcactgagctggggctactttatttttttatttttattttattttattttttgagacggagtcttgctctgtcgcccaggctggagtgcaatggcacgatctcggctcactgcaatctccgcctcccgggttcaagcgattctcctgccttagcctcctgagtagctgggattacaggcatgcgccaccatgccccgctaatttttgtatttttagtagaggaggggttttgccatgttggccaggctggtctcgaacgcctgccctgaggtgattctcccccgtctttttttttttttttttttttttgagacggagtttcgctcttattccccaggccagagtgcaatggctgaactcctgacttcaggtgatccacccgcctcggcctctcaaagtgctgggattacaggcgtgagctaccgcgcccgtcgaggtggggctactttagatgggatggcgtcagggtctgggaaggcctatcttagaagacattacccaaatg

SEQ ID NO: 85073 - DNA, 1381 bp, Homo sapiens
gaggctgaggcgggcggatcacgaggtcaggagatcgagaccgtcctggctaacacggtgaaaccccgtctcccctaaaaatacaaaaaattagcagggcgtggtggcaggtgcctgtagtcccagctacctgggaggctgaggccggagaatggcgtgaacccgggaggtggagcttgcagtgagccgagattgcgctcctgcattccagcctgggcaacagagcgagactccgtctcaaaaaaaaaaaaaaaatgctcccacctcagacagacccccaacccccacctcagtagctgggacaacaggctcataccaccatgcctaatttttaaatttgttgtagagatgggttctcactatgttacctaggctggtgaactgggctcaagcgatccccctcctctgcctcccaaagtgctgggattccaggcatgagccactgcgcctggccgatgtcatatctttaggagcgcttccctgaccactctgtttaaatagcatcccccgcccttcccttgttttctctgatcattctctgctatattttccttcacagcctgtcactccagaaaggattagtttttctgtttcttgcttccttgctagagaatgaatttcatgagggactttgtctgtgttattcatgttcccttagtatctcaggtagtgcctggcacatgatagacatgtaataaaaattagttgaataaacaagtgaatgaaataattgggcaaatatgcatagataatgtagaaggacttttattgcaacattgtttgaaagtgacaattataaattactcggtatttactaataggaatcctgttgaataacttagggtgtattcttacaatgtaatagaggaacttcccaataaggtcccacactgtgctgatgccctgagacactgtggcacacggtgggcacagtgaggtattttaaatttccaagagaaacacaggtacatttgtcagataccctggaactcctagttcctggtagttctgtttcaacattagatggtgccaaatccctttctataatgtcatatttttgtgaaactgggtttttagcagttgctaagtacaggcaaaaatcagtttgtagaagaaataaaggtggtgctgtttagtctgattccaaggtttgagaggtgcagtgcctaacaggcgccataagtgagtgagatggttatttggtaaagaaataaaaatgttattttgttttaatatattaatagtattttcaacttgtgtgtattttctcaaatggctagtaagttcctaggacataaatgcttaagttgtttgggtctaggtgcttaataaattgctgtcttttcttggaaagatggagtcttgctctgttgcctaggct

SEQ ID NO: 85074 - DNA, 1923 bp, Homo sapiens
aaagtgctgggattacaggcttgagccactgcgcctggtcaataatgtattcttttaggtagagtgtgggctacattgatgagtgagaagatgatccttgttttcaagttacctataatcttgtgagggatttcctatgtatgcagcaaatagttactgagcctcaaccatatgttggttactgtgctaggtgctgaggatatgaagagaaaacatgacccttgccctcaaggattacagtccaatgagagagacagatgtgtcaccaagtaattaaaattgggctgagaaccttgctggggtgtgcataagactaggaagagttagagaagacttcataaggaggtgacctctgaactgggtcttaaagaataaatagaagtttactcccaagggggtgtgtgaagcaaaaggagatttgagaaatctattgtatttagaacataaatgtgggaggcgggtaggagaatgtggtaccaaataaagctgtaaaagcaacttgaagccaaattgtaataaggaccttgttagctttgctaaagcagaggaaagaggacgagtatttactgagattcaatgacagcccttttgttattgtggcctcaggggcagaacccaaagagaacccagcctgactggccaccccctcaagtgtttaacctttatcctgtaggcagtgagaaccattgttggccgaagggttgggggctaatttaaaatgacagtttgaggcctggtgcggtggctcacgactgtaatcccaacactttgggaggctaaggtgagtggatcacttgaggccaggagtttgagaccatcctggccaacatggtgaaaccctgtctctactaaaaatacaaaaattagccaagtgtggtgagcacctgtaattccagctacttgggaggctgaggcacaagaatcacttgaacctgagaggcagaggtggcagtgagccgagattgtaccactgcactccagccggggtgacagcaagaccctgtctcaaaaaaaaaaagtaaaataaaataaaaaatgagagttcgtgaacttggtgatggagggatagctcttctcattaacaaggatatgcgtgtctgctgtctaggacaccccctgacccggtctcagaaagcctgaaagcagaattagtcattagaagggtggttggcttggtcggcatagactttgagcagaaagaggttgaaaatgttgagcctgatttctcttaggcccctctgcagtgtctgttgtggaggccagatacgtaactgcttccgctttttttggtctcattcaaggtgagcaaatccccttcatgtttctcaccagacaatgcagctgatgaggttccagctttgcaaatgtagtcatccatgaggactgtcttcctgagatttcatcaggtcatgttgatgagagttttgaacctgtctgaggctgagaggtgtgcagaacttcttcagctttgcatctgtagaccattttggtttctacccagcagtggccaatcagacctattatgaggggattactggtttgactgtcagagggtaacctctctttttccaagttttttgagggtacctccctccagtggagagtcctaagcagtaggtcaatttaacagacatttgttaggagcccaccatgtttcaggcaggcacatgggattcaggatggttgaggcattctgcctgcctgagaggtgcttatagttatagggaagacagacccccataggtcattttattgcattgttgtatgtgcagtgatagagggctgtggaagcacagaggaggggtgcctgtctactttgggcaggctgtggaaaggcttcctggaggaagcagtgcctgagccgagtcttgaaataggagttttgcagtgggaagagcattccaagcagagaggcactagcat

SEQ ID NO: 85075 - DNA, 2425 bp, Homo sapiens
ggcagggggtgattgagcggactggccgctgccaaacatgtgcaggtaagtgctggggggccaggtgggatcccaaaggggaggtgggttgggtcctcaaaactagggctgacggttgacacctggaggcctctgagatgagtgggagctgggaggaaagcactgggtgtgtgtcccacaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctgtgagtggggaacaggctctggtctgggagcgggggtgcttggtagggggcagggggacagcttcaactgaccctgctctgccctgtccccagaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaaggtggctggggctggcggagacttttgggaaggaggggtcagaggcctggagggaggaaactggaagggaaggaaacaggaggggctggcctggtgtggagggaaatggcccaccctctgggctctgatggcccctgtctctccttggaagggccatggtggctgtgggcggtaccagcccaggatccggcgttctggcctagagttgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggtcagtggctccagggctctgcctcttagctggagggcgaggtgtctaaagggaggaagacctgtaggtggggatgggtggatggacctgggtttgaaaattcccctgctacttactagctgtatgatctttaatgagtcctttcacatggttaaaggccacaaacgtgtttctgaatctataaatgatagtgggcagtcctgcctcctggggtggtgtgaggatgagagctgtgctgtgtgcctggtacgttcctgccgagcgctggcagtggtggctggaccatgatgattctgacttcctgcctcaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgtgagtcagcatgctccccacccctctgtgtattggagccagggtgggggctagcatgaggcttcagagctctggaagagggcccagtgctgactttctggattgcccccaccctgtgttttttcctcacaggccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacaggtgtgcctccgttggaaagcccttcctggaatggctagggaagacatggcctcagtggcaaggcttcgagagtctgctcctcctacctcgggcgtgggcttggagcaaggaggaattgaagttctgaagtttaacttccactcagggagggtggctgcaggggtattttaggaagcattgagttcattgcacctctttccttcctagacttcaagaactagtgcgcagggggaacagccagtacccaggcgccaagtacatcatccgagacaatggtgatcgcattgacttgcgtttccaccccaagcccagtgaccttcacctgcagaccggctataaggcacgtagcaggccagggcctctctcagccacctgagcagaaagctttccaagatagggcaggctgggttaggccatctgagtctgtctcgttcattgggatccagacttgactgtcttgttaaaggctgttgctgcccaggtgtgcagggagctgttggtctctggcattcagggtgggggtggtataaacccggggcagcttgcatatggcagggaagagggatccgtggaggaacagtgc

SEQ ID NO: 85076 - DNA, 1034 bp, Homo sapiens
ctgagaccttttccttacctcacctctctaggtggaacggcacatgtgtgatggggacattgttatcttcaaccggcagccaactctgcacaaaatgtccatgatggggcatcgggtccgcattctcccatggtctacctttcgcttgaatcttaggtcagtccctggctgagggaagcaggctggaattggtgggaggcgggcaggctgggtggctcctcaaggtttcgctgcagacatcttcccaaccctgacttttctctttaactgtagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcgggtgtgtggtccaaatggaaacctggcttaagtgggcagtggggctctggggtgcaaggtggaggctagagaggaagagctgtgttttttttcctgacttacccagcagtggtctgtgagattgtcttttctggtgggcgaacaaaaagggggttaggaaaactcaggccaaaaaggtgtaaggcgttaattccccatttaattccttaaaatttcatgtaataccaggtattgcctgtaaaggaaagataaagggaaaaataagtaagaccttgttcaaattttatttttctattttaaccttcacttatttcctaattattaaaagaaatttatgcttattgttaagaacaaaaacaaaaatttcagtattacaatgaatttttaattaaaagtttttggggccgggcgcagtggctcacgcctgtaatcccagcactttgggaggccgaggcgggtggatcacgaggtcaggagatcaagaccatcttggctaacacggtgaaaccccatctctactgaaaaatacaaaaaattagccgggcgtagtg

SEQ ID NO: 85077 - DNA, 3309 bp, Homo sapiens
acaccaaggtagggcttggcttctggatatgtgaggacagaatttggacgtgggagccaggaccagagcaggggccttgagtgggtgctttgtccttaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtgagcatggaggcgtggtaccaagacgtctctgtgaattctctaacttcttactgtccttccatccctttctttcctccttggatttggtgccccctgcttctactctcttggctataattccattccatgtttcttagaggtccaaaggggtttgctgatgtttttccctgtctctaggtcatactattggcattggggactccattgctgattctaagacttaccaggacattcagaacactattaagaaggccaagcaggacgtaatagaggtaagaggggaggccaccagagacggaataaggggtttccagggacttcgaagttagcatcatcaagagcaaagggagtgtaaggttagagggaaggggcagagagtagggattgatgtctcaccgagaactctgcctccaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtgagaagccttgtttttccatatacggggccgctgtgaagtttgggaggaggaaggaaggtgtttgtatgtattagggtcaggagaatcacgggagttgggggaaattttgggaactgttattcttaaggcagagggaattcagtatacaccacctttctgtttcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggtgaggctttcctcaggggtcttccttgggctgttagcagggactgctgcaggctgagaaacccctaacaggtggggagcggaaatgctcaggctcctattcccagggtataattctggcccttgtggaaagaatagagtctcaagagtaggcaaacacccttgtttggattgctgtgcagcattgcacagtgcagggacagagcttccggggctctgccggcctgtcccatgggagtggttcctgctgggctttttgtccgtctagtggtagacactgagtttgcattcaaaggcctcagacacagagagtactagctgactcttctgacagtcaggtaggttaaggccccagcctgggtctttgggctttatcatccccttacttccctccaggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagtgaggaggcgggcaggcgggtggttctcgcccctggggctcagggcctgagtagtaggattcccatacctattccagagagatagcctggtatgtgtcttgcactagagcttacctttcagcatccttccccacctatctgaaacagctgtgtgacatgggggaggtggtggatggaggtggatttaagattggtccccacatcgtccctgctgatattataaagcagatgcagaggggtgggcctgtactcaggtcccagtggcagtccttgggcctgaatttttctctgtccaggattcttgcctccaaaccactgtacttggtcggctgtgcacctttgggaaccttacagtgcgttttgtggggaccaaggtcccagagcccacctgtccactagctaccccttgcacttccaggttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtgcgtgtgggtcgaagtgctgatgctagagatgtgcctccctggatggctgtccccagacacagccctccctccatttccccctctctcaggtcgtcctcccctgtaacctgctgcggatgatctggaatgctcagaaaatcttccacatcaacccacgccttccctccgacctgcaccccatcaaagtggtggagggtaagtacctgcttaggggtctccaagccaggctaggggataggagactgctgggccctggtctaatgatctcctcacctttaattggtccccaggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgtgagtgttgtgctcttcacagcagtcttcttttcctccttttacctgttgacttctgtggtttccaagagcagcccacttctgtccacaacctacagaataggttctgtaggttctgtcccacctaataatagctctcattcatggagagactgcttgtaccttaccaagtcctgtgtttggcccattatcgctttataccatcatggctttaatacactcctagtaggggagggtttgttagtcccatgttgcagagacaaaaactgaggcttggagagagtgactggattgtgtgatggtcatataggaagtaagtggcatgactgggatatgacataggagaattgttcttttt

SEQ ID NO: 85078 - DNA, 1112 bp, Homo sapiens
tggtggctcatgtctgtaatcccagcactttgggaggccaaggcaggtggatcacctgaggtcaggagttcaagactaacctggccaaggtggtgaaaccccatctctactaaaaatagaaaaattagccgggcatggtcgtgtgtgcctgtaatcccagctgctagttggggctgagacaggagaatcgcttgaacctggggggcagaggttgcagtgagccgagattgtgccactgcactccagcctgggcaacaagagcgagattccatctgaaagaaaaaaagaaaaaaaaggagaacttttccccttgaataaagggttttggattcccttgataaggagggttagaagagacgtttagagctactcagttccctgtgtcatggacttctgtctcttcccaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggtaagcctaggagggctggcctggctcaggagccccgctctctgggctaccacctatcgtgttcaccgcacttgagcccccaaagagctacccaccctcacccccatgcatgtaccagttccgcccctccgaggcatcctccaactctccaggtcccctctgcactccctttctcttctgaatgttctcccttcccctttccagggggttctatgaaaagaaagtttctgtgaggagcggggagccaaaagagagccttgctcagagagagctgcgagtggacagtggctggggccagtccccttagctgcagcctttctcatggctcctcaccccaccaggttttggtgacgacttgaactgcatctttaatgatgacaatgcagagaagctggtgctccgtattcgcatcatgaacagcgatgagaacaagatgcaagaggtaatgggggtcctag

SEQ ID NO: 85079 - DNA, 1610 bp, Homo sapiens
gatcactgtcatgccagcagcagcctagatgaacacacagtgaagtgccagagcagggaatggtgtgtgctcgggtacagcagttgggaggatatgacatgtacgtggagcccgcctctcgctaggcgcaggactgcacaagagtggaagttgtgacggggtggtgggatttgggtgcctttccttaggcttcttttaatattgtaaaatcaggattaaaagtctcactggagaattgcaggaacatgggaggtagaggttgcagtgagctgagatcgtggcattgcactccagcccaggctgataacagcgagactccacctcaaaaaaaaaaaaaaaaaagtctcactggaactgtgaggggcagagcctggtgactgactcgtttggccctcaaagaggctgtagttggaggcgagagctggggaagagaccagaggatgccaagtgctgacctcactctcactgcaggaggaagaggtggtggacaagatggatgatgatgtcttcctgcgctgcatcgagtccaacatgctgacagatatgaccctgcagggcatcgagcagatcagcaaggtcagccatcccctctgccaccgccttcctcctcccactcccacactcccctccctgcctactctgagcacgctgtcttcccacaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgagcccgtgtgtgctgcctagctgcctttcgtggatctctggctctcaggcccctcattctgtgctgtccactcaggactttttctgcctgattccatttctgagtgtgggatatcctggctcctgacaccctccctggatctgggtggcgacagaagcagggaagagagcagagttgctcagtcctggccctcccctccacttccctcccctgtgccaggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtaacagtggaatttctgaatagggcagaaggagggagtagtgtgagaagaagggcacacactttgggcagctgggctgtggtgatgggacagtcaggtgctgtgtgtggaggggtctcatggggccggtctgctctgttcaggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacgtgagtatg

SEQ ID NO: 85080 - DNA, 1595 bp, Homo sapiens
ccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcaccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccagcctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaagtatgtacatcgagtgcttcattggggttcaggagacccccaggcccctgcctcctgcctgggctgctgcttga

SEQ ID NO: 85081 - DNA, 1677 bp, Homo sapiens
cctggtatatcacttgtctccagccacaaacctcacctggacattccgtcctgcctggcaatcttacattcccccacgaagcttgctttcataatcagcaagttgagattttgtaccatttctcctcaaatctcctgtctccatctccctagttgtccagaggacctagaagtcatcgagcaaaggttccctcatctccccccagcaaatctacaaacccacctggtctcttgttctcctttgaccctctggtaatggtgggagatgtgtcctctcttctttctggaaacttccctctcccctttttggatgtggcccctgcatggacccctcacccctgcaccagccacctcgcctttcatgcagaccatgtccagtacacaggcacattctagctgggttcaaatcttggctccaccacttagtatctcatggcctcagacaagttgtgtaacctccatctgtaaaatggaggtaattagagtatcttccttttagggctgttgtgaggattagataagaccaaacacaagtgccagacacagtgcctatctcaagaaagccctcagtacatgttagatcagatgaaaatagtattgttcacagaactaaacttttccttggtccacacacccctccacctactggcctatttctctgctccttgttacagagaaacttctaaaaagggttgtcctaggccgggtgcagtggctcatgcttgtaatcccagcactttgggaggccgaagcgggtggaacacctgaggtcgggagtttgagaccagcctgaccaacatggagaaaccctgtctctactaaaaatacaaaattagccaggcgtggtggcgcatgcctgtaatctcagctactggggaggctgaggcaggagaattgcttgaacccgggaggtggaggttacggtcagccgagatcgtgccattgcactggatccagcctgggtgacaagagtgaaactctgtcacaaaaaaaaaaaaaaaaaaaaaaaaaaaaaaaaaaaaaaaggttgtccctgcctccagttccttatttctcattttcttctcaacccaatgcacactgccttcctgttctaactatgccactgaaaccaccctctttaaggtcagcaggactttcacgttaccaaacccagccatcatttctctgttctcatttcatgtgatctctcagctgcattcaacacagacagccacatcctccttgaaacagtggtttctccgaatccaggatgccaccctccctgggtttcttcctctctctccagcttcttttcagtctctgctggttttcccctcagctccacttcaagatgcccaagagtctcagggcttcattcgtggggcccttctttctcctggcgtctcacccaatcctgtggctttaaatgccatcgataggccgggcacaagggctcacacctgtaatcccagcactttgggaggctgaggctggcggatcacctgagatcaggagttcaagaccagcctggccaacacggtgaaaccctgtctctactaaaaaatacaaaaatgagctgggtgtggtggcacccgcctataatctcagctacttgggaggctgagacaggagaatcgcttggacccaggaggcagatgttgcagtgagccaagatcgaaccactgcactccagcct

SEQ ID NO: 85082 - DNA, 2003 bp, Homo sapiens
atagtgtgtatcagtacttcactctttttatggccaaataatattccattatatggatagacattttgttgatggacaattgggtttcattttattatttttagttgtactaattcagataatgtatgtttacatcctccatataaaagaagcaaataatatagatatccatgaagtaaaacattaaatcccctcacgcttctccttcagttctactcttctccccagaagtgactgcaggtgacaatctgccctgaatgtctctggccatatacattagattttttcacataacttcctagtcaactatgggcatcataggggatgggtcctcccttgcccggggtgatctatgtgtcttctgggtaaagtgggcgccgaatgttcatatgctcaatggatccctggggagtgtgggggagtcctgtagagagacgtttccttatctctgagcatccgtgttcaggtgtggacgggacagtgagtggctgggaggaagccagaatcaacagctccagccctctgcgctacaaccgccagatcggggagtttatagtcacccgggctgggctctactacctgtactgtcaggtaagccccatctggctgcatgggtaacgcagtaagagagtggcgaagggtttgccaggagagtgggggacaagctacagggctgggagggtgagttggggtttgggtgggatgggatgcctgcgtcgctgaggaaattggaaattgaggcgagggcaggcagaggcctggactcggcctgttgtccccaccccaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcatagtctctctctttattggggctcaggggacactctcagggtagctgggggccacgtgaaggggggcgttgcggagcggcacagctggaactccgggatgatgttcaggcttgggggcggggacctccatgcctccagcccccaggtgggagcagaggtaggaaggcacactgcccaggaaaaaaatcaatcctccgcccaaggtacagcagaagcggcctccttggcctaggaggcagacttcctcctgcggggaaatcccttcctggctgggaggagcaggggcccttcctcttggtggcctcggacattcagcaggtgctggcacaggccctggctgggaggtggggcgggcaggagccagcctggaggaggggctgagagtcagcaggcacacgggaacccggaaccctgtgtgctggggag

SEQ ID NO: 85083 - DNA, 1013 bp, Homo sapiens
aggccgcttctgctgtaccttgggcggaggattgatttttttcctgggcagtgtgccttcctacctctgctcccacctgggggctggaggcatggaggtccccgcccccaagcctgaacatcatcccggagttccagctgtgccgctccgcaacgccccccttcacgtggcccccagctaccctgagagtgtcccctgagccccaataaagagagagactatgacttattctatttaatatccatttatcaacattttgtcacaataataataaaaataatatctgttttaaaaatccacagggaattctcaagggaggagcttgtcttgtttctcgcccctcacatttgggaactcctggcctaggcccagtctctttggcttcctgccgccaggtccagcccctcttagtgcctgaagtggggtcttctggacccatccttgcccacagagtacagtgaacacaatgccctgggggtctgtggccaggggggagtcgagatcactgggggcctcaaagggtcagggattggggagctagtgaggtggagagtgggcggtgggggagttgtaagataagagtgggaatactgtatttatgtgggatggaaaacacgtgaacaggcccaggcagcctctagagggaggggcaggtctggagcaaagagcggctgagggtggggcagaggggaccgggtgcccagagagctgtcgaggggagccggcagcctgggacgactgcggggagaccagggcccctcagtgaacctggaagagtccgaagtaggtgaggaagggggcagccttgagatgggcccaggggagggtgcggatccgcagggaggaccctggccgcagggccaacagaccagacacctggcagaggcggagctggggcccgagggaactcgccgcagtggctgagaattcctccaggcagcgcagggccagcacaccatccaccagcaagtccagcttcaggtagacagccttcccctcatcaaagtgcacct

SEQ ID NO: 85084 - DNA, 1250 bp, Homo sapiens
gggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcaggtgagtgaggggaggagggtgtctgggagaggatggttagcatggggggtctctgggcctcctggtctgcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagaatggggagagatcccggaaaaggag

SEQ ID NO: 85085 - DNA, 2196 bp, Homo sapiens
gtttacaaaaatcctgtccacacgaaatcccttgtcggcctctcagtataagaacccccgtgtatacatctccagagggtaccattcccaaagtgacgggatgggatctctcccagtagtggagtacatcatcttacagttgtgaaagaatatttccctttcggagaactccagccaaacagtttcaggctctctaggtctttattacatattctagtattcattgagcctttacaatatgctgggtactatgctgggtgtttggcatatagtggtgacaaatatcccgaagttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtaaggagcccttaagcaactagcctctctcccttctccgactcctagaggagagtctggaggcctcaccccctcctctctccctttccaccaggcatcttggacgaattccttcaaacgtatggcagcctcatacccctcagcactgatgaggtagtagagaagctggaggacattttccagcaggagttttccaccccttccaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaaggtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaaaaagaaaaagaaaaaggccaccgggcatggtagctcatgcctgtaatcccagcactctgggagaccagggcgggtggatcacctgaggtcgggagttcaagaccagcctgaccaatatggagaaatcccgtctctactaaaaatacaaaattagccgggcatggtggtgcatgcctataatcccagttactcgggaggctgagggaggagaactgcttgaacccg

SEQ ID NO: 85086 - DNA, 1032 bp, Homo sapiens
caacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggcagaggttgcagtgagccgagaccccgccattgcactccagcctgggcaacaagagcaaaactccgtctcaaaaaaaaaaaaaaatcacagtaatgtcatagcgtgggaagtgggtactttagattgggtgatctaggaaggcctctcatagctgagacgtgaatgatgagcagccagccatgcgcagacctgggaatagcaagtacacaagacccatagtgaaaaaccatggctgaggaacagagggcttgtgggggtgacctgtgtagttggcgcagagtgagcaaagggagatggatacaaaattcggtcagagagtagatcatgtaagacatgtacggtaggctgaggaggggggattttattgcgtgtatactgagaagccattgagttttaagcaggctgagaagtgccttctgttttaaactcctgtttcaatgacagattgaaaggggggcaagaatggaagcaggaacagagcacagtagtccaggtgagaaacttgaactggagtgctaaaggaagagagagagagtagttttatgtaggataaattttacgagtaaaaccagtaggactgacaggctctgtgatactgagagatacatatttggtctcctgaccaggctcctggcattcaacttctaaaatccttggaatctccagtgatgtgtgtttttgtgtgctgatgagttgattcatggctagcccctctaggtggcttcatgattagagggttggaactttcagcctcacccccaccaacttcctgggaggggaatggggccaaaggttaaggcaatcactgaggatcagtgatttaatcagtcatgcctagtagtgaagcctctaaaaaccggaaa

SEQ ID NO: 85087 - DNA, 1032 bp, Homo sapiens; identical to SEQ ID NO: 85086

SEQ ID NO: 85088 - DNA, 6843 bp, Homo sapiens
gaggtggcacgtgtctgtagtccaagctacttgggaggctgaggcaggagaatggcatgaacccaggaggtggagcttgcagtgaggcaagatcacgccactgcactccagtctgggcaacagagcaagactccgtctcaaaaaaaaaaaaaagatttgttttttcctccgcaggttggatgtgggaaatgaagaaaaagaaatggaggatgatgcctaggtttttggcctatgtaacgggaaaagtgggagaggaacaggttgggggaggaaaatgaagagttcttttctcttctggtttccctgccctcccattcaaaggccaggaaatttctacagctaggcaggatgattggctccggcattccttaatttcagtcctcaaaatcaagagcttacaccctcagggatcttcttgcagtagagggaagggtggtgacgtacagtgaaaaacatgttggccttcttcatactgagtttgagtcccacttctgccatttctttctttcatgaccttgtgcaagtcacgactttccaagctgcaatttcctcatctgttaggttgaatgttgagaacttcccggtaggattgttatgagcattaactgcgtgtttactttgtgctgtgtcttgttctaagtgtattatggatagtcactagtttaatcctcatatcaaatggatgaggtgtaggtactactatttacactctctgacagataaggaaactgaggtatagaaggttattaagtaggttgcccactgtcataagccagtaaatggaggagctgtatttgaattctggcaggctccagaatcctgggcctgggttcttagctgctaagtgcttctccctttaaagtgtgaaaagcgcctgcccatcatgggttctccagtgttcgttctgatgtctcctccattgtctgaccttcctcccttaccccgaagaaccgaaacatgcagatcctgagcttgcccacaatctaggccttgggtcttctgttctttcacttggttcccttacctgtgtctctgttcctctctagaaccttcatggcaaaaggcaagacttctgtttgttgtacctgacctgtggcactatctctttaggtggacatcttcaataaggagctactgctaatccccatccacctggaggtgcattggtccctcatctctgttgatgtgaggcgacgcaccatcacctattttgactcgcagcgtaccctaaaccgccgctgccctaaggtttgagggggtaggagagagatgggcaaaatgtggggcggtgcagtggcaaggcattgcaggaagaagggtgggctttgggtctttgaggggcgacctgggcatggtgtctgccagcactgtacccaccatactgtgttcaattgagaaacttagggcatcactttcttttcccccatccacatagcatattgccaagtatctacaggcagaggcggtaaagaaagaccgactggatttccaccagggctggaaaggttacttcaaaatggtgagtttcctgagggaggggtatagggtgttggtggggacagtggtagaaggcagaaattgaagtcctacccctgggagtctccatgtgaagggcctgctttctttctcttctctagaatgtggccaggcagaataatgacagtgactgtggtgcttttgtgttgcaggtaagcagatgatggggccacctcccctagctctgaagtcagttgggttaaagggtcgggaggctgttatgcatcccctcatttggctcatagtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatatatatatatatatatatatatatatatatatatatatataaaaatatataaatgccacggtcctgctctggtcaataaaggatcctttgttgatacgtaagtggtggtcttccttaaggggcttcaaattagtggatatgcttagctcagaccttccagccagtctcttgagactaaagggttcagctttccatccctggctcaggcactgccaacaccttgtcttcacccaaacaaatccccgagatgggagcagagagcaggaaggagggaaagtagataagcctcaagaataagggcatccgagagggaagctggggaactggacacaagggactggggaggggaccaaccaggattcatgatagtaccccaaagccctttacagttttcttccatccctccaccatccagccaggggaatcctcccatccctacgatatcgctgttgattccttcatccctggcacacgtccaggcagtgtcgaatccatctctgctacaggggaaaacaaataacatttgagtccagtggagaccgggagcagaagtaaagggaagtgataacccccagagcccggaagcctctggaggctgagacctcgccccccttgcgtgatagggcctacggagccacatgaccaaggcactgtcgcctccgcacgtgtgagagtgcagggccccaagatggctgccaggcctcgaggcctgactcttctatgtcacttccgtaccggcgagaaaggcgggccctccagccaatgaggctgcggggcgggccttcaccttgataggcactcgagttatccaatggtgcctgcgggccggagcgactaggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccggtaagaaaggcatttgcaagagattgtggctgcttattttgccgcccccttccgacgggcccgccgggggtagctgagaggcccaccagggttgcgggagaaaccgaaccgggtggggggagggtccgacttggaggggcgagggggaagacccacggccgacgcggccaccaggtcgaggcggagggtagggacagcccggctagggtcaggcgtgcgaggtctgttacgaggcctcgacccgaggcggtgccatgcgcgaagccccggcgctgagtggcgagacggggtcgcgacctggcgtgggaaagaaaggtggaggcggccgccactatgtgtggcccagagccggcaggtccggttgcctccctgtgccgggggagggacggcgcgcggggttccggagcattctgacggtaccactcgcgagaggcgggggtgcctggtccttagatccagtcacttcgtcgcggctaaaacacgggtcggggagaagaaaccggccgttcagtgtgctggttttcttgacggccaggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgaggtatgggagggcgacgctacttcgcgacgggggcgggcgggatgtggattgttcatggaggggtgggagacgccgccgggtggtcgagggagcgagcacatggtggcctgaggcgttcccctcccccagtctgcttcgcttctaagtgttgtgcaatctccccctttgctagctcggcttgggctcattgtgcgcgaggccgccaccgcccgcggcctcccacatccgggcaacgcgaggggggggcttcggctggagggagtgggggagggcgcgggcgggatgacgtggggggaaggggatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcagattgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggactttttcctgggtcatgctgcaacactgatgtcagagcatgtttttaaatgttctgtggcaggggcagtgattattctgggtgtggataatgtaagaagttacagcagagctccattctaaggcacttggctctcagttttctcagagtgaacatgcctcgtagcttgggtcctatggcaggagtgcaataggacatggatatgcatcacctgttctataaaactggttgctggctgggtgtggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaattt

SEQ ID NO: 85089 - DNA, 1044 bp, Homo sapiens
ccccccacccggttcggtttctcccgcaaccctggtgggcctctcagctacccccggcgggcccgtcggaagggggcggcaaaataagcagccacaatctcttgcaaatgcctttcttaccgggaatcctggctcgcagacatgatccttagaaactagggcggagtgcccgcctatcgacaacttatagagcgcccgactccgccccggccatcgcattggtttggccgccccggccccgcctgccggcgctcagcaactcggcatgacgttagttcctagtcgctccggcccgcaggcaccattggataactcgagtgcctatcaaggtgaaggcccgccccgcagcctcattggctggagggcccgcctttctcgccggtacggaagtgacatagaagagtcaggcctcgaggcctggcagccatcttggggccctgcactctcacacgtgcggaggcgacagtgccttggtcatgtggctccgtaggccctatcacgcaaggggggcgaggtctcagcctccagaggcttccgggctctgggggttatcacttccctttacttctgctcccggtctccactggactcaaatgttatttgttttcccctgtagcagagatggattcgacactgcctggacgtgtgccagggatgaaggaatcaacagcgatatcgtagggatgggaggattcccctggctggatggtggagggatggaagaaaactgtaaagggctttggggtactatcatgaatcctggttggtcccctccccagtcccttgtgtccagttccccagcttccctctcggatgcccttattcttgaggcttatctactttccctccttcctgctctctgctcccatctcggggatttgtttgggtgaagacaaggtgttggcagtgcctgagccagggatggaaagctgaaccctttagtctcaagagactggctggaaggtctgagctaagcatatccactaatttgaagccccttaaggaagaccaccacttacgtatcaacaaaggatcctttattga

SEQ ID NO: 85090 - DNA, 5867 bp, Homo sapiens
aaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgatgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaat

SEQ ID NO: 85091 - DNA, 1488 bp, Homo sapiens
atggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaat

SEQ ID NO: 85092 - DNA, 1620 bp, Homo sapiens
ggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtgggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgtgcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggt

SEQ ID NO: 85093 - DNA, 2344 bp, Homo sapiens
gcttgtgggtagaggcagaggtctggatggaagtttggggaaatctggaatggagatgatgaaaaagtgattgattggctgggaggcttgtgagtgagaaggagaattcttccagtttgggggatgtgatggatcctgaggtgggatgaatggccgtgaataaatcccattgtgttcttcaggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcaggtaccagacagctgggttcatgaatatgggccaaaaggaaagatgatgggcacctgactgccaactcctcctcttcttcctctgaccagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctgggtgagggtgtgcctggggtctggaaagttagagatgggtaggaatcgagggtgggaggttggatgtgtgactctggttttttcctaccctacagaagatgaatcaagacctcaacgtcgtaatcgcagccgccgccgccgtaaccgtggtaatcggactgatggctctatcagtggagaccgccagccaggtcagccaactctggacaccagaatccttcctcagagctgagagaatgggatgctcacccctgtgaaaatcaggggttcgggttcagtgggtgtcttaggctggctaccagaattccatctgaaagtcttaatctcctgccttccccagtgactgtggctgactatatctcacgagcagagtctcagagccgccagaggccacccctggaacgcactaaaccctcagaagactctctttcaggacagaaggtaggcaggcaagatgtgctttaccccatcccttttttgttgttactctggggcagggggcacaaaaaatttcacaaatctcctactgaattgcagaggcagctgtgtctgatggagtttagaccagtgtaaactttgaataggatagagaagaaagtgtggttcacattttctggatcccaagtaagagagactggatcatgagatcagggaaccaacctctggatcaccaaatgccaggagggcttggatggtagggaatgtctcccacctgaatttctactcaccgcttcttgcttttctgttttctttcccactttcccctcagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggctgtctggctcctgtgccttctttgtccccagtttggtccatttgtttctctaggactgacctgccctggcccctggctcttgttttctgttcctccacatctgacttctcttcattgtctcttgtcccaaagatggtcttacttctgggaattcctgacattcctaaactccccaggcccaggttctccctcctggttcagaggaggggg

SEQ ID NO: 85094 - DNA, 1068 bp, Homo sapiens
ggcgtgagccaccacatccagctggtcttctgttttagtaacaactccctgctgttcttcctttagactcccgaggcttgccgacaggcccgaagctaccttgagttttctgaggactcagtgcaagtgcccaggaacctggttggtgagttggtggtgtgtatatacagttagaggtcagaatcaagattctctacagtgattctgagcttttatccaggattggcacctccctgtggactcccagtttcacaaggacagagaaacagtctgtaatgggagtgataaaaatgaaagaataaatttctagggattgtaacattttgtcctgtaaaaacacatcagaaacctagaagcaggagaatgaagtaaatggaatccatataaagaaaatgaggctggaagacggtgtatcagctttattcttatttccttaaaaaaaataaaaggctgaattcctcatttacctattccaggcaaagtgattggaaagaacgggaaagtgatccaggagattgtggataaatctggtgtggtgagggttcgagtggaaggtgataatgacaagaagaaccccagggaggaggtatgggtacggggcaagtgggcatagagattggtttccagaagtaaatgggattgtcctctgagggctgggattgttctttgagagggtggagtacggaaagttgtttaacactagtagatttagagcccagaatgatcccactgggcaggctcccctaggagactgggcggcgttaatccttccatttcattttcctttctgatccatcgtttctgctctctgttctctagggaatggttcccttcatttttgttggcacccgagagaacatcagcaatgcccaggctttgctggagtatcacctctcctacctgcaggtacccaggccgggagagaaaaatgctgggtgtgaaaagggaactaagactgctgtgggggtcagctcagggattttggttctctgtttgtctctccgtgtagaacagaaaacatctgtggaaatttggggctatagggttgggtcccagaattttccttgt

SEQ ID NO: 85095 - DNA, 1897 bp, Homo sapiens
ggtgttctagaggcatgttttctgtttttcttaacccctcacttttttttgagacagagttttgctctgtcaccaggctggagtgcagtggcatgacctcggctcactgtaacctccaactccctggttcaagcaattctcctgcctcagcctcccaagcagctgggattataggcacaccccaccaaggccagctaatttttgtatttttaatagagatggggtttcactatgttggcaggatggtcttgatctcctgaccttgtgatccacctgcctcagcctcccacagtgctggaattacaggcgtgagccaccgcgcacagcctacccctcactttttacttaagttgttgagttttatttggggatgagttgatatttgtttgattaaggtaagagttccttacacttgcatgtaccttgtgagaagtactttcacaccagccttgtctaatcctcttgctagtcttgagaataagataagttggatataatcacttagcagatgacacaagaggcagagtatgttttgtttaagatcacacagatagatactcttagggacagatactgttagggccaaatccagaacttcggtgtgtcccagtccaaactctgccctctttacctttcctcccccacaaaccactggtatttggaaggagtggaattaaaagttcctgaccttggccgggcgtggtggcttatgccggtaatcccagcactttgggaggctgaggcgggcggatcacctgaggtcaggagtttgagaccagcctggccaacatggtgaaaccttgtctctactaaaaatacagaaattagccaggcatggtggtggacacctgtagtcgtagctactcaggaggccgaggcatgagaatcacttgaagtcgagaggcggaggttgcagtgagctgagatcgcgccactgcactccagcctgggcgacagagcgagacgccatctcaaagaaaaaacaaaaagttcctgacctttccacacaggtcctcgtggtccgcggactccagagtggttctagctttctattaatatcacacagttttccttatttaagttatgcaaagggtcgtgtgcctgggactgtgagattctaccaccatgattcctacagtgacttttcctttcagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggaggtcagcaaaggatgtctttcttctgggtctcttaggggatagagggaagagaggccgaagtagaaaataagcctcaaactgggcacagtggctcacacctgtaatcccagcaccttcggaggtcaaagtgagaggatcacttgagcctaggagtttgagaccagcctgtgcaacatagtgagacccaatctctacaaaaatttaaaaattagctggaagtagtggtgcgtacctgtagtcgcaggtacttgggaggctgaaatgggaagatagaggggaggatcacttgagcctgggagttggagaacaacctggacaacatagagagaccctgtctttaccccccaaaaaaaccaaaaaccaaaaaacgttaactgagcgtggtggcatgcatctgtggccccagctacttggctacttgggaggcggaggcaggaggatcacttgagcctggaaagtcaaggctgcagtacaccatgatggtgccactgaaccaacctgggcaacatagtcaatagagtgagaccaaaaaatcaaaaaaatagaccagatctctgttgcccaagctggtt

SEQ ID NO: 85096 - DNA, 1029 bp, Homo sapiens
aaagtgctgggattacaggcgtgagccaccgcacccggcccagtcccttttcttttcttatttactcagccctgcttctctgaatttttttttttttttttaatagagacagggtctcactatgttgcccatgctagtcttgaactcctgacttcaagtgatcatcctgccctagcctcccaaagtgctaggattacaggtgcaaaccaccatgtccagcctcccccgaactcttcactgtactctctgcattctgcccgctgagtacttttttcctctgcagctgctccaatgaaaacgtccataaagagttcaagaaagccctgggagccaactgcatctttctcaacatcacaaacagtgagctcttcattctggtgagtttattctgcctgaatttcacataagccttttgaacattttttctttttccctttttaacccttttgcagaaagagaagggcttaaatgtgcttatatttatttgtcaagaggactttattgctcctgactcctacaggcccaggtagccctaccttttttttttcttttttttgagacgaagtctcactcttgtcacccaggctggagaacaatggcacgatctcggctcactgcaacctccacctcccgggttcaagcaattctcctgcctcagcctcctgagtagctgggattacaggtgtgcgtcaccacgccggctaatttttttttttttgagatggaatctcactctgtcgcccaggctggagtgcagtggcgcgatctcggctcactgcaacctccacctcccagattgaagcgattctcctgcctcagcctcccgagtagctgggattacaggcgcctgccattgcgcctggctaatttttttttgtgtttttagtagagacagggtttcaccatgttggccaggctggtcctgaactgctgatctcctgatccacccgcctcggcctcccaaagtgctgggattacagacgtgagccaccgcgcccgacatgcccggctaatttttgtatttttagt

SEQ ID NO: 85097 - DNA, 1056 bp, Homo sapiens
aaagatttctttttctttttcttttttttttttttgagatggagttttgctcttgttgcccaggctggagtgcaatggcatgatcttggctcactgcaacctctgactctcaggttcaagtgattctctttcctcagcctcccaaatagctgggattacagacatgcaccaccacacctggctaatttttgtatttttagtagagacggggtttcaccatgttggcaggctggtctcgaactcctgacctcaggtgatctgcctgcctcgtcctcccaaagtgctgggattataggcgtgagccactgtgcctggcctgggcaaagatttcttagatatgaaaccaaaagcacagttgataaaataataaattcataagctagacctttttcaaaattagaaatccctaattgtatgtgaaaaatagggagaaggtagaaaaattgggagcataggggtgaatgcatggctttggcctccttagtgaggacacagaccacaggaggtggatcagctgttcagtcatccctcttgctcttgtcaaaatatcaagattggagtcttccataaattttattatcctttataaattatcagtgtcattctagattcaattctagtattaaaaaaccgatgtttttaaattaagtcttaatttttccttctgtaaattgtgttcatcacaattttgaacttgtctagtgttccgattattgtcttaggacccatgcatcagggcagcgagtctgctcagatctcttgctgtattgcggaggtaggcccttctctctcgacagatcctcatgtcctctaggtgttccaggacagcctcacactgtctcatgggatattcttagccttgctgaatgttgttggtattttaattgaactctggcaggctgcttagcacaacaggaggcagacagatagggaggcccctgtgggagcctgagtagatcattggtttccaggctgttctgatgcaggtggtacatacacctctccatgacaatatcatttcctttctctgtttgactgcccatattctttccccag

SEQ ID NO: 85098 - DNA, 1053 bp, Homo sapiens
tccaagtgttgggattacagggaaaagaagagggaatggataaaatattagtggttgtgggagtggggaggacacttgagcaggagctaagggaagaacccaaaagggaagagagacccaggcaagtagaagtaaaagtgcctcagaagacttgaatggagaacagtaggagttggcattaaacctgaatgaacatgctcataactcaggttctttttgaaaaaggaaaaaaatctgaatgaagagtagaaaaaacatttctggagaagagaatgtcagagaaagaaaaagcatgggtaaaaaagaggccaggaagtaccagtagtaattaaagccttgggcagtagtaaggctctaagaaagaacattcagtcaagaatgatcttgactgactgcagcctctatagcaagacatatccctaaagacgagaaaggtggcttgtatgaagagtgaaatgcaggcttagattttcccatcgtaaggaaatagcaatctggtaagtgtttgtgattgattagttctatgaggtgggagctgtgcatttgccaagggcatttttggtgttttctctcctaagcttagcctttgtccctagcagcaaagctcatgaatagttcttgtgtattagccttttgaaacctctaattcttttatttttgtttatttattttgttttttgagtcacggtcttgctgtgttgcccaagctatggagtgcagtggtgcaatcacagctcatcacagcctcgacctccctggctcaagtgatcctcccaccttagcctcctaaatagctgggactacaggcacaagccatcataccctgctaatttataaattttttgcagagatgaggtttccctgtgttgtatgggctctctaatttttttaaaaaacatctttattgagctgaaattgacatacaacaaagtagacatatttaaagtgtgccatttgttaagttttgacatgtatgtaactgagtccatcactgcaatcaaaggaatgaacatttctgtcactcccaaaagtcctccatcaactaccaatctt

SEQ ID NO: 85099 - DNA, 1786 bp, Homo sapiens
aacgcgtggggcgggatcgagcttctggagctgagtcctggcccttagaatcttggacccttgctccaacccgcagccttccctgggagaccgcttagagtgaaccctgttcctcttatttttgacccctctaaggcacctgcacctgcttctacccccatctccgggagaatgaacttcaggccattattgtccctggcttggcgctccccgctccgcaggagagacccctttacccagcttctaattgactgtgtccgttgtctggtggaagacataccttagaccttaatcacatcttccccacgatccaagcacatggagaattgtctttcttccacacggtccctttgggaaggccctctgtcccgtaaaagatcctttcatcttcctcagagaggcctctgcctactggctctggaacactcaccccactttcatcttatattccggttcccaagccaaggagaaatggtcagatccatttacgacgtttggcatctttgacctcaggaaccctgggttggatcagtcaagttgcttcccagccagccataaggtggcatctttcgcaagtctctctccccaccacaccttgatctcaagacccactgctctaccattctactcaggaatggatttgaggtctcacttagacctcagataccttcaggtcattcatatagtttcttcgtcttgaggcatgtaagcttcatagtcataatctctaaaaggatctctgaaaggaagcttatgaggttcccttctgtttatcttaagatttccacttcttgaagactcttggccaactatcccagttcgggaatctgacaaccttttttggaagacgggatcatctttcaaagacccttccttatttcacctccccctttgcccaggatttggttccttagaactccttataataccaccttccttatctgctctgaatctattttctaggacatttttttcccatttagattaagccagagagagccctttcttgcctcccaagagtttttctttgtgtgactgttggtattctgaacctcttggatttgatgcctggaattgtcctagagactctcctgatttctgtctcattctttgatttcaccctggggagctggggaagagataccttcccatggcatcacttgttaagagtggatcccccttccccctttccttcagttcccctcaggcctttttcccccactgtagtcctctctagtttctcatgcccttggaaatgtctttctttgactccttctctaagtcatatttttctataactgcagagggtcttgtaatttctcttgggtggtttctgcctgtacttcagttgctaagtgcattgtagtcattttttttttttttttttttttttttgagatggagtctcgccctgttgcccaggcttggagtgcagtggtgcgatcttggctcactgcaagctccgcctccctggttcgcgccattctcctgcctcagcctcccgagtagctgggactacaggtgcccaccaccatgcccggctatttttttgtatttttagtagagacggggtttcactgtgttagccaggatggtctcgatctcctgacctagtgatccacctgcttcggcctcccaaagtgctgggattacaggcgtgagccaccgcgcccggccattgtagtcattttttactcactcttcatacttacccatttttgccttacttccctcatcagatttatttctctgcggtgactgtgggtacccatgtctaacttacctt

SEQ ID NO: 85100 - DNA, 1015 bp, Homo sapiens
agagccgcagagtataaagaccgcgctcggcgaccgcgggcctcgcactgctgaggagcggagcctccgcctggggggccccccatccctggctgtcccccagctgcgcgtccccgccccacccccgcggctgagccaccaccggtgcagtggtctccgcttggcggagcgagccttgagcttcgttccacagcttctttgcatcttggatttcggggcggccccctcccccacctctctctgcctttttgtaccccgctttttttctgcgttctgctcggtttttgtagccgtctgtttttgcaccccatttcgttttgtttctagacggtttggtggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctggggtacgcagggccggcacgcaaggggcgggggaaagccgcggggcgacgcctcgggggcgcagggtcccgccgacgcggccccagctcccctcccgggtccccggcgtccagcctccctgccgggctctgggctgggagggggccgaatcgccagtctaatctccccggctggccgtgcggaggcggagaaagtaggtcacagccgccttcccgccccccgcggagccccctcgggcggggggtcgccagctccgcctgcgtgtccg

SEQ ID NO: 85101 - DNA, 2271 bp, Homo sapiens
tctgcggggtggtatgagggtttgcttgtgaatggtggccagtacccgctttaaaaggcaccatgctagcacagctttaagcatgagtacgaatgcagaggtaacagatgtgtgccttgtcaggactatgcatggttgagaagttggaaatgtaattggaggcaaaataacagacctccacaaggtcgggcttcactgtgccctaggaccaggagggggctgggagtcatggctagaagccagacacaactgcctgtttccagtttgtctcattttgcctccagaggaaggctctaagacatccctgtggctctgtgatcagtcccagtgcagaacttcagagtgggtagaggggtgtgtggggatagttgaggttatggtgggaaccttgggccctgctgaccctgtttcctcctccctagcctttatcctcctcttctacctcgttttttatgggttcctcaccgccatgttcaccctcaccatgtgggtgatgctgcagactgtctccgaccatacccccaagtaccaggaccgactggccacaccgggtgagtgtggaggctccccctgccagctactctaactgctcttgtgcccccaaacctccagaaggaactcatagttccttccaggagtttgattttgatgacccaatccccacgtgcttggaagttcttgaaatctgtccaccttcccatttactgcagttgggagctgtgtgatttgggcatgtggcagatagccacaggagatcaccctcccatgaagacgatctcagatattcaccgctgtccccactctggtgttccctgtgtccattttcttccctctgtgtgcagtccctcatcttatagatacccccaacttctgcctttgttggctgtaggcttgatgattcgccccaagactgagaaccttgatgtcattgtcaatgtcagtgacactgaaagctgggaccagcatgttcagaagctcaacaagttcttggagcgtgagtgtgggcctggttatgtgtcagttcaagacttcgggcaggggactggggaccttggaagtggaacatctggcccctgagtctctccctcccacctctttagcttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtatctatgaccttggtccccagggtgaatggaggaaggatctggggacaccacctgcagacaattgcatcctttcactggggctaatgggcatgagaaagacttggatgtttgtgtagctgagagaaaaagagaggtgggactcttggaggctaagctctgcagttagaaggctggatgccttttgttttttttttagacagggtcttgctatgttgcccaggctggccttgaactcctggaattaagctatcctcccgcctcaacctccctagtagttgggactacagtccccggcttagcttggtctggatgcccatcttcgacaacttcttcctctgactctcttcaccttccaccctcactccaggtcatcaacttctatgcaggagcaaaccagagcatgaatgttacctgtgctgggaaggtgagttcgttgggccttgtctgcctgctcacctgagtggctcacctgagtgtccttcatggtttctgtgtaattcacctgtctctccctatcttctttgctcctagaggccccatcaccatagaaacaagggggtaagagtgggcttttgggctccactgtagcttgaactccgagggccccgcactcctcttgcttctctctgggatgcagaggcctgctctcctaggggccagacacacgccctcctccaccaacgccctggcctctggcttctctccctaacgcttccaccttctccttcattcccagattgtccgtatcgttcgctctccctcccatatggcccccacccgtcagttccttctaggtgtctggtagctgctgatctgttagcaccatctgccaccagttcgttgtccttgggaccctgttccccgcttcccccccggtctgtcctttctagaaactggctgctccctccacatccccttccttgcttcctattcaacccttaatcatgtatctcttctttctt

SEQ ID NO: 85102 - DNA, 1798 bp, Homo sapiens
cagggacagaccatcccctcatctacacacgcacatgcagacacacacacacagactcacagctccagggaggcagacttgagacaggaataattggggcgaaggaagaacaaaagaacaaatggaagtctggtgagctcctgggtgcctgccatccctaactggctcaccccctatcttcctgcacccccacagcgagatgaagatgctgagaatctcggcaacttcgtcatgttccccgccaacggcaacatcgacctcatgtacttcccctactatggcaaaaagttccacgtaagtcccaggggaggcccaggctgatggcgggtgcgggtggtgagctagggaaggaggccgcgttgccccaggcctagaccctgcactgctcctccggcccaggtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacggaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctggccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccag

SEQ ID NO: 85103 - DNA, 1105 bp, Homo sapiens
taattttgtatttttagtagagatggggtttcatcttgttggtcaggctggtctccaactcctgacctcaagtgatccgccggccttggcctcccacagtgttgggattacaggcgtgagccaccgcgcccagctgtaattctcaatccagcaatctatcagctcacaaagaagggtttggcagagtcagaatggatctgaagcagcacagcagaaataaaaacagagctagggacataatctaggaaaaggttgggattgaaagggtggaggatggttgtcaaaaagggagattttctgtttacttgagatctgcagagtaggtccaagtgtcctcgtcgtaggtgaacacacgtgcacacacacaaatggtaactgtgtgtgatgatggacgtgctgattaatttgattgtggtaatggtttcacaatatacccccatatcaaatcatcacactgcataccttgaatgtatgcaattttgggggatcaattatgccccaataaagcctaaaataaaaaaaaattaaaaaaaaaaaaaggaagctcatcaaggtgacctgtctacagaggcaaggacagggactgagcttcaggagctctagtttgcctgctgggtagggacagatgtttaagttaaaagtctctgaaagaggcgggtctggatctcctggggagagtgtttggcattccctagtaagaaagagaaaaaaaaaaggtggtcttgaggtcaggaaggctggtggcttcatagctgtctgggatccttggggcaaggcaaggggctcctgcttgcaccttcagcctggttgatgagctgacaggctggtggccccagaagcccccctggacagtagcacccactggaccctaacacccatctccaccaccagggaggaggaagggcaagccatgtctgactgccccttcaagcactggctccaagagagcagtgggtgatggggaagagcctgcctgctcccagcccccctccctgggagccagcagccctgaggagcatgggcaggcagtactgagctcctcaacccgactctcctccctatcccaagaagccctttgaaaggttttcctggcagagtttaaagc

SEQ ID NO: 85104 - DNA, 1858 bp, Homo sapiens
ttctccgcaactcccagcccagagctggagggtctcaaggaggggcctaataattgtgtaatactgaatacagccagagtttcaggtcatatactcagccctgccatgcaccggcaggtcctaggtgacccccgtcaaactcagtttccttatatataaaatggggtaagggggccgggcgcagtggctcacgaatcccacactctgggaggccaaggcgagtggatcacctgaggtcgggagtttgagcccagcctgaccaacatggagaaaccccatctctactaaaaatacaaaagtagccgggcgtggtgatgcatgcctgtaatcccagctacctactcgggaggctgaggcaggagaatcgcttgaacccgggaggcagaggttgcggtgagctgagatctcaccattacactccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacat

SEQ ID NO: 85105 - DNA, 1140 bp, Homo sapiens
gtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctt

SEQ ID NO: 85106 - DNA, 1077 bp, Homo sapiens
gtgatattacggaaagccttcctaaaaaatgacattttaactgatgagaagaaaggatccagctgagagcaaacgcaaaagctttcttccttccacccttcatatttgacacaatgcaggattcctccaaaatgatttccaccaattctgccctcacagctctggcttgcagaattttccaccccaaaatgttagtatctacggcaccaggtcggcgagaatcctgactctgcaccctcctccccaactccatttcctttgcttcctccggcaggcggattacttgcccttacttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaacttccggacctttgtccttcctggagcgatctttccaggcagcccccggctccgctagatggagaa

SEQ ID NO: 85107 - DNA, 1045 bp, Homo sapiens
acctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggtaggggtcacaccctgagagcccaaagcagctgggcagcggggcaggagcagggatgtagtctgcagtgtaggggaatgggtggggatggggaaaaaatcccaagctgaaggagtgcctggagaccccgagggaggcagggacatccagggctttgggggtgactccaggtcctgttccttgtctccaggatgctgagctcctgtgctgggatctccggcagtctggttacccactgtggtccctgggtcgagaggtgaccaccaatcagcgcatctacttcgatctggacccgtgagtggctgtgactccttcctacacagggccctgataagcctaggaatgccagagcccagctgtag

SEQ ID NO: 85108 - DNA, 1080 bp, Homo sapiens
tggttggctgccatggaatagtgaaatcacctgggaggggtgggctgtgtggttccagagaggccagctccttggtaactggcatcctgttgccatggcaacggggctggtgatggagcgggagatggcggtgtgcatgtggtgagggcgggctgaagagtggagtgcatttgggcacaccaaggggcaggagacccctgagcctggcttcctgctgcttccaatgtgaatgcacagagtccttggtgcctgctctataagaagagactttccactcagacaaaggcgggcaagcgtgagctgagaattgctgtcctggaaggttgtggggtgagggaaggaaagttctgggggccaggcctctgacatctcttccttgtccaccttaccctcctccccataggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattggtactgctgggcagagggcacgattgagtggggggctcctgatactgagcagagagggagggggacccctgcagccaagagggagatcccagtgccctcaggcagtgttcacaccagggtgtggggccagaatcagggctagattctggagtgccaacctcttcctctggcttttctctcccagccacatcggatgggacccgggagggcctggagagcctgcagggaggtgtgtgcctaaccagaggcatgaaggtgcttctccgagtgggacaaagtgagtggggctgggggacacctcctgggcacgaagggacgttggggcagtacgatcatggttggggcagttgtctcagcccctctctgggtcttcctcatctccag

SEQ ID NO: 85109 - DNA, 1039 bp, Homo sapiens
tgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtc

SEQ ID NO: 85110 - DNA, 1040 bp, Homo sapiens
ctgggggtgaaaaagccaaagagtgggagaagggacactgagctgagaccttgctgggcagggtggctgcagagctgggctgaggcagagtaaggggccacctaggacaaggagtgggcatggaacccagaggtgtcggcctggccaggggtggagaaccaggggtgggatgagtttcaggagtcaaattaaggagtagggggctgagacatgaagcacgggcagggggatgcagagaaggagttgggtgtcaaggaggtggggacagaggctgtggggactccttctgcagatgagcaatgagatcatccgcttatgctgccacgccatctccctggaccggatctttgagggatatgtctcttccagcaaggaggacctgcaaggctgcattctctgttgtcacgcttggaaagatcactacgtacaggctgtgcagatgcacatccagtatgatacgcctcccctaacatcccatgtctcaactcccttgtcagccctgtaagagggtagattctgacttctttcctgtacactttgtttagcctcttggttgtattttccgagacccaggagtttctacatctggccaaattttctgtctggatacagatactgtatctcattgccctggcttctccttttttgttttttaattttaattttaatttttttttgagacagagtcttggtctgccacccaggctggagtgcagtggcgcgatctcagctcactgcaagctcagcctccgaggttcatgccattctcctgcctcagcctccccagtagctgggactacaggtgcccgccaccatgccaggctaattttttgtatttttagtagagacagggtttcaccgtgttagccagggtggtctcgatctcctgaccttgtgatctgctcgccttggcctctcaaagtgctgggattacaggcgtgagccaccacgccctgcctggcttcttattttaataatctctcctccctgatcccaggaaccctacctggtcttttcctcctatcttgaccccatcgtct

SEQ ID NO: 85111 - DNA, 1077 bp, Homo sapiens
agctggaggctggtttgggcctggtggactacgcccaggctaggaagggctgatactggttttcaaccttgtgcctcatatcctgctccttctgtgactgacctttttctcccagctttttttcctaaacaaattctctgtgcttctctttcctcattttgactccttttctcattgcgccttggtctcttcctatcaccttcctttttgactctaccttccttctaagttatcaaaactcaatccatctccatagcaagccttatgcatattgttggggtatgtgcgcatgcgcgcatgtgtaggtctcagggagatggtggcccctggaggaaggtggcaggccgactccacccacctgttcttcttcccctcagtgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtacaggagccacctggccccttttccctatactccccttctgcagctctcccaagaatttcactcccatcttttgactcctctcttcattattctctctctttctcatacaatatgtttgctatcgtcattttacttttttttttcttcttttatttttgtctctccccacctcccaccctgctatcaacattttaattttacaacttatcttaaaacacaacaaaacaaaacaatgatcggccaggcacggtggctcacacctgtaatcccagcactttgggaggctgaggtgggcgcatcgcttgagcccaggagtttgagaacagcctgggcaacatggcaaaacccagtctctgcaaaaaatacaaagattagctgggcgtggtggcacaagcctgtagtctcagctacttgggagggtgaggtgggaggatcgcctgagcccgggaggcagaggctgcagtgagctgagatcacaccac

SEQ ID NO: 85112 - DNA, 3416 bp, Homo sapiens
cgaggagtctgtgggtgtcagtctttgtgcctgtccgtggttcccttcccttggttagtatagacaccgggagtcagggagggctattcttgccccagagcgagagtggaggtgagagtggagcgcgagctggcggcgactggggaacaggtgcaagcgccgcgtcggggctgcccggcacggggaggggccatcgtgggggaagacgagaggggaaattccgcgggaccggtggtgagccggtgtgtgggctgaggagttgtgtctgcctctgactgtgtgtctgtgtgtgttcagggaggcgggggctgagtcagtgggaagaggggaaggttttctgggtgactcacgctcccccaccccaagcctgaatcagaccccgagggagggctttgtacggggggcgggggggcgagtgaggagtccagcgcctgggtcccgggtgcggacaaggatccgaggtggctggcgagaatgagtgtgtgtttagtgtacaggaagttttgtcttcaagtgagggctttgtattcttgggtgctggcgtggggctttgtggataaaggtggaagagcagggagctggagggacggcactcactgacttagggaaagctgagtcagttccccgtgggaaaggggaagtggcagaggggaagtgtcatcatcgccgaaggggaagctgcctttcctggtaactggcggcgctctcgggaccacttcccaagcaggcatctgcccctctgttgtctggttccccggctccccctccacgtctggttcttgggtctcctccccgcccctgcctcggtactcgggtgggggcagtcacggagggccatacttgaccacagttcagcgccgtacctggcttggttactgatggaaaggatgctgcctctagtgaggagagagttctgacagtaataccacgtgaaccgcggagagggtccgcggggcccaagcgaccacaagggcttggcggagagtggcacgcagggacctgtagggtccaagcgcttccatgcaaacaaacgaccttgccccttcgggaaggaaggctcttttcaccagaaacccgtctgcccttgtgggctgggtggaaatttccccacagcgcagacttctctcaacgaacgcgaactttccagccacccccagcccctcgtcgcgcactctcccccggcttcctgcccggcgctcgctccagctggagcgctggccccgcccccgcggctttgtactcgacactcgcctctcgctgctctttgtactctagactctcaatggaccgatcccgggagccgagtcggctccctacctgcggggacgccgggtaggcaaggaggaggcgcggggacgcagctcctgggctcagagaggcgagaaggaagagctggggctaaagggaaggtgcccaagagaggggagcgctgtgccagtcgggggtccagtcggcaccaaagcgaaagggtggggggggcgtgaaggaggaagtgaaacgagttctgggttctttaagggagtgggtggtgagagtgggacaagggtgatgtcactgcctgtcgggccccgccctcctccctccctcaggacccccccccccgcagtacatttacacacaccgcttccgctgcgcaagtagccacgtcacgggcaacccccgaaatcccccctcccttggggggcgggggccacgtgggccgtggggaaccgcgtggccccggcggggaagggcagagaggatacgcgagccacgagagaggggccactcgggaccgcggtgcgcgacttctcggaagttgggggactaaaaggggtctgattttgggggtcggtcggtattgaagacccagaaagccaggggaagtagaggacctggaggaactgggtatgagactgggggcttgaccaaggtttgggtcggggtcaggcgttgggggtggagcgccgatagcggcgcggacgggtttgggtgccgtggaagtcgctgtggctggccagccctaagcagttaataggggcgctcggggtagggaggtctgtcactgggcgaggtgaagtgaggaaggggagggacgtcttttttgcgttctgcatccgtctgtcgtccgtcggtcttacggtggccgggcgtggggctactcgagcagcctggccgtggccaccggcggctctgggtgcttgaggcttgcgggtagcgccggcccccacgccggccggagcatgcgactaaccggcctcatccgcatgcgtcttgtcctggctgccttctggccctgacggccggagtgtcggatcctagatggggaccctaggtgggagccgcggggtcacatcggggtcaccccgggctgagctcgtctgaccggctcccgcgcccctcctcccccggccaccgctgccgggctcacctcgctcccattggttccggccaggctgttactgaggcggagacacgggtgatgattggctttctggggagagaggaagtcctgtgattggccagatctctggagcttgccgacgcggtgtgaggacgctcccacggaggccgggtaagcggccgctgcgttttgggtcggcccagtggctccggactggaagcctggcagcgcagccaccccgtccctctgaccggccttttggttccctgccacacacgtcctgactcccagccacactcctgggcctctagggagtggttgggccgggcctccctttggggaaagctaaggccgggccctttgcacaaatgacaaattggtggatgccacagtccgcccatcccagcccctgggccttgactgtgtgctggccagctcgtctcactccttttccttctctctagaattggctgtgaaaggactgaggcagccatctgggggtagcgggcactcttatcagagcggctggagccggaccatcgtcccagagagctggggcagggggccgtgcccaatctccagggctcctggggccactgctgacctggtaagggaaactctggggccgagctggctggatgtacactggcagctctggttttgcctccagtaagagcataatttcttatccccaactcaggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcaggtgagaagttggggccctctgtctccaggcacacctctttccatctctgtatccctcaatctgtgtcattctccatgggttcctgtcattctgtgggcttccgtgcatcagccccctcctgcctaggtaggacaagactgctcctttttgccgtatataacagactccttctctctccagatgctcagcca

SEQ ID NO: 85113 - DNA, 1050 bp, Homo sapiens
tttggcaccaacatcgacttgtctgatgctaagcggtcagtggggctgaggccagggaagttggggcaggagtgctgctaggacctcgtggcgggggcggggtgtagcctctcgtcgcacttccgcaccgcaggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggtgcgctccacgcctgtgcgcgctgatgctggaagcgcgagaggaggggctggcggcggcgctcagccgtcagccaatgagggcagagggcggggctatcggggatcgcagttccgacctggccagccatgccgttctctgtcgacccctgcaggccaccaggagaataacaacttctgctccgtcaacatcaacattggcccaggcgactgcgagtggttcgcggtgcacgagcactactgggagaccatcagcgctttctgtgatcggtgcgtgccgtcctgcgcaagtcagactgccgcgtccccgccctcggtccccagttcccacctgacctgtggccaccccgcaggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccggtgagagggtggggcaggtgttggcgtggtgtggcgcctcagcggcaagggcctgggaggctggggcttggagagccgccagcagtgagggaaggggcttgggcctaggtgtctgggggctgtttgagagtcctgttgtgatcgcctttggcccgcagcctatcagtaccagctggccctggaacgatacgagtggaatgaggtgaagaacgtcaaatccatcgtgcc

SEQ ID NO: 85114 - DNA, 1419 bp, Homo sapiens
ggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctgtttcgctaacggctggtggtagcaggttgagtaccgggagggctgcaagaccgtgattgatggggaggactgcgcagaccctggcgagggtgagcccctccccggaggcgcctg

SEQ ID NO: 85115 - DNA, 1048 bp, Homo sapiens
tgatgctggcggtggggtctatgggccacaacttcaacccgcctgggctgtttccaccccgtgcacagtatcgcctggtcggcttgggcctgacgcctcttctcccacagttcctgcgctcccaggcacccccttgcaccgcgcacctgcgggaccccggtttcacggccctactggtcaccggattcctgctcctcgtgccgctgctcgtgcttgctctggccagctaccgccgcctctgcctgcgcctccgcctagccgattgcctcgtgccctacagccgagccctttatcggcgtcggcgcgccccgcagccgcggcaaatccgggcctcaccagggtcccaggccgttcccacatcaggaaaggtctgggtctaatgaccctcgagtcaagaacaaccctgacggctgccctccctcttattcggcccaaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaaggagtgtccacgcatcaataaagatttaacgaactgaacgcgctctgcgaacagaggcgtggcacaagtactatcacccctgccctgtgccgaggaacaggaaacatgtgccagggctacaaatgagcagagaggagcatccttgagccccctggccttatcgcttttgtccgttcttcctggccagacctcagagatctgttcctgaccccaggcacctccccctcaatagagtggaggggcccagcctcggccgcctgccgctgctccccttggggacctgagcccgttctctgaccccagcttagaggaactcggtgt

SEQ ID NO: 85116 - DNA, 1757 bp, Homo sapiens
gtgttcacgggaaacgtagtatgagtcccgcgtggggcatataaggatcaagtaattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggttagcacgggctctggttctgggactgaggggcagtcaagcagcaagatggagggggtggggaactgcagctcccggcagcctctgggctttgtgtgagtgccccgcgggctgccgggagctgtggttccgcgggcgggcagcctgggctgcgcggtctgagcgcttgttacaccccgcgcaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctggtaatgtggcggaaccttacgcaaggcatttccccttaagggcctggctgcaacccttgttttctggggctcgttttcgtggctcagaggggcgggactgattctggcctactttcctgatgctctgatccttctttccagattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaatgggcctgtgtctgtgtgtagctgggatgccggtgcaggatagcacaccccatccctagaggaaagggctcatctgaagtcgggagcaccctcaaccctcctctcccaaccaagatgtccaggggtgccaaaggttctctcaagttcaggggtagagatggggggcagggctgaatgacggaccaacaggccccagggtgggcccctgcatcttccctcccacggctgctgctccagaattgtggcgggagggggtgtcatcctgctccggaaggcccattgtttcccaccccggcctggcaacaccgagttcctctaagctggggtcagagaacgggctcaggtccccaaggggagcagcggcaggcggccgaggctgggcccctccactctattgagggggaggtgcctggggtcaggaacagatctctgaggtctggccaggaagaacggacaaaagcgataaggccagggggctcaaggatgctcctctctgc

SEQ ID NO: 85117 - DNA, 2678 bp, Homo sapiens
ccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcattttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaatgttaagtgaactcatccgtctatacctagtgggggggatgttgtgtcctagtaggcaaggaaggaccaagaaataggatgtctggttcctgtgctatagtctctatccataggattcactttccttgcttccccaatatccaaaaccaaaagttattccatagagggtctctggccaggtgcagtgactcacgcctgtaatcccagaactttgggaggccgaggcatggggatcacctgaggtcaggagttcaagaccagcctggccaacctggcaaaagcctgtttctactaaaaatccaaaaaattagccgggcgtggtggcacacacctataatcccagctacttgggaggctgaggcaggagaatcgcttgaacccgggagatggaggttgcattgagctgagatagtgccattgcactccagcctgggcaacaagaacgaaactccatctaaaaaaaaaaaaaaaaaagttaaaaaaaaaaaagagggtctcaccagatttttgggggccaatccatctgtcatttccccatatggccaccaggtggctgt

SEQ ID NO: 85118 - DNA, 1124 bp, Homo sapiens
agctagagggtgaaagaggccaagcaggaaatgttgccacagaagccaaagagagagcacagaagagaggggagcggccaacagtataaagtgctgcacagaggtcacgtaagatgaagacctgagcgaccatggattcagcaaacagcaggtcatggtggctttgttagagaagccaggctgcagttggacaaggtatgcatgggatattcttagaagaaatctaactgcagaaaggaggagtgttctggctttataaccatgcacagaatatttaaataccttcctttggattccatttcttcaaccataaaatacagataatagaaagtaagatgacagtagggcaacaggcaagacccaggacatggtaccctaaaaagatgctaccttatagtgttgttgagaagattaaataaggaatgggaacctgcccagcactataaagagtccttggaaaagacactcagaaaaccttagttttctttcccattccttgtgctagccattctttatttagtaatgaatcctcccctcaggattttgagatttggcatttttcagcatccaggtaacatctctcatgattagaaaattacagaccgtatctgtgactaacattcagtttccaacctaacaatagtgtttattcctccattaggagaagtttttgagtcaagtaaaatatggtttgtttcatatcatgccagaattgagcttctttatacagtgatggaaagcaagggaatggggccaactactgggagaagagtaactaaagtcagtcctttgctcctaaaggattttaaggtgcttaagctcgtaactcaggttgtgaatcttctcaccttgcagtcatcttaagtgaacctctgaagagagaagtggctaacagtaaacttgatggtttagaatgcagctaccaattatcgagtaccttattacagccagtgctttatgtaagttagctcacttaaacctcaccacaaccctttgagataggcattaatacaccattttacagatggaggagctgagacttgagggataaatagcttgcccagggtcatagttattaagtggcagagcttggattccaggtgctacctttctgacaccaaagc

SEQ ID NO: 85119 - DNA, 1025 bp, Homo sapiens
aaatgtgtattggagaaggcatgaaagcaccggtagtactaaaaagtaccctataaatataggcactgttaataagtaacagtaagctgagcttacatgcacacagagtaggtagaggactgccctgctttctcacttagtctatatgaattctgtaaggtcatgtgaatccagatcctttaggttgtcgacctaggcctaagaagtttgtcttcctcctagtctaaaaagctttctcctgattaaagccttctggctccactcacatgccaccttagagacattttataactctttgaaggagacaaagacacaacctctaaccaggtctctttgaaaaagatgataataaaacttctacacacaatgcactgttctttcatttctgcttttttactgcctgttttcctgagtttaactgtttcagcctctatctttgtgtctctccactctttccctctttccctctcttacttctcttttcttggttctttcttcttatctgtctgtcttgatctctattctagcctctttttctgattggccctctcccctctcttctgtctgattggcctgtatccttccatcaccccatctgtctgctggattctccctgtctgcctgcagtaatgtatgtgatagcactttataaattataaagcactatgttgtataaaacaccattatcactttgtcttccttcttaccttattttttcttcctttatctgtcttcccttcttctctctttctctctctctctgtttgcctgtctgcatcccttttggtgattttgcctgccttctctgtcagtcaatctccattccctccctgccagcctatttttctgccatccctcttctctgtctgctcagttcttgcatctctccttctgtgtttccaggtttctctatatttcttttgcctgtgtagtctctctgtcgttaggccttttatctatgcctgtgtgtctcactgtctagctgcttgtctccctgcctgtcactttcattgtggggcatcagt

SEQ ID NO: 85120 - DNA, 1020 bp, Homo sapiens
ctaagtgagaaagcagggcagtcctctacctactctgtgtgcatgtaagctcagcttactgttacttattaacagtgcctatatttatagggtactttttagtactaccggtgctttcatgccttctccaatacacatttcagtgatgaagcgaccaacaaagatgtcttgctggcatcagaccacttaccatgcagagtagactacatttggagagagtaaagccttcctgagcactcctcaagtactggtagtgaacgcatgcaaccagtaactagtcaatccaaaagacacgtgctttgggtaacacttggtagaatcaaaaagaccagagatggcaagcccagccaagttagttaggagtactgacagactgacagaggaaggagcatccagaaaaactggaagaaaagtagggaggagtacagcaaaacacaagcaaaagcaagcaagcaaaaagacttgtatatgtgtagacttttctctggagcagtatccaggaaatgtgaaacagtggctgcttctgaggagaggaactccgggactaggggagaaggatgggagacaggtttacttttcacagtacactttctgtacttttaaaatgttgtaccataagtatgtactacctatttagaagttaactggaaaaagaaacaaaagaagagagaaaagcaagaagagacgtggacagcaagagcctgccaagcagacagcaaaaaggcaggaaggcagcgagagactgggaaaatggcaaaaagactgagacaggcagactgtctgaggaaccagaaagacagaaaaagagataactgaaataaaggcaaacgtgagagaaggcagggtaggggatgtggcaagaagttagataagactttgaggcaaaggggttactgagaggtttaggggagagagactatcctcattgatggaagttggcagagaagaagcaaaggaagaaaaagctggtaagtatgaagactaaagagagaaaagcctgaaacggtgggatagcagcaa

SEQ ID NO: 85121 - DNA, 1581 bp, Homo sapiens
ccctgtctactaaacacctgggggccaaggatccagagacagggatccgtgagggccaaggatccagagacagggatccgtgagggatggcggaacaggaagccaaaggcctggggagggcgtagaatgaagtctgcctcactgacggccacggggctatgggcagtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaagggtaaggagtgttgactgtgtgtgatcctgtcagtgggccgtcctctcattcttattttcaattttgacttctctcttcaacccttctccctctctctctccatctccccctgccctgcttccttatccctccaccggggtatatgacagtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgtgagtacctaatgccagcatctgatggccctgaggaacccacccatctctttcccccttggtttcacttaccctcttcctgcccccagatggctggacttcttagtaacagatgtccgagtgtctaggatcctaatgtattcctttctcccacaatcaacatttctgaaactggagtgtccttttccttagttcccaccagtcttctctgcacttctaggattcaggtgtcctgtctttgcctgtatcttccagtttcattccttaatttcttccatctgtctgtgtgtctatccttggccccctaggagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacagtgagtggaaacatctcccctctgtatttactgtcaggcctgatcccttcccccatccctggggcccacatgtccagcttttcatttctctgcactcccccacccttgtgggacccctatcttctcatctaacaatgggttctttctgcctctttctttcctcctccttgtacgtgtccatcccaaagtgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggc

SEQ ID NO: 85122 - DNA, 1046 bp, Homo sapiens
cgaactcccaacctcaggtgatccacctgcctctgcctcccaaagtgctgggacgcgcctgttattctcttattgccccggctggagtgcagtggtgtgatcttggctcgctgcaacctccgcctcatgcattcaagcgattctcctgcctcagcctcctgagtatctgggattacaggcgtgcgccaccacacctggctaatttctgtatttttagtagagacggggtttcgccatgttggccaggctggtcttgaactcctgacctcaggtgatccacccgcctgagcctcctaaagcactgggattacaggcatgagccaccgtgcctgggccaatccatcctttttcatagctccctttccctgtcccattcctcctgccggcctcttcccggttccttgttgtcctctgtgagtgtcaggactatctctttcccttttttctgtgccctgctagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacaggtgaatcctcggtccctgggaagtcagacctggtatatgacattattcttaccatggtgatggccccatgttagtatttgctgattaaccaggtaattgatctaaccttgataacctctgctgtagctccagcctttctggccttgtttcctccaggggaacgggagaaaacaggaggaaaatccggccaggcagtgcctcttttgtcctttgcctcctgtcatctccagtggcataagacatagcacatgagtctggggatgagggcatgaaagcaaaacatgagagacataattcatccagaccagtgttttgaatgtttcttcttcatagtacttattactgcctaaacttaatggtatgtatttagttatt

SEQ ID NO: 85123 - DNA, 1130 bp, Homo sapiens
gagcctgggaaaaaggaaatatgggaaaatctaggtcatggacagtgggaagtaggtctggaatgggttcagaaaagaaagcgtaggactcccaaggatgaggcctcattcagacccactctttttccagagaactaattatgggggaagaccctgcccagccccgcaagtataagaagaagaagaaggagctacagggtgatgggcctcccagttctcccactaatgatgtgagtcctctcagttgtcatttcttgtttctggagtgatggtgatcgaagattttccaagggctactgatggaacttcccagagattcagtaacctctgtgaacagtagctcttccttcagcatccagtcttgccccaagagtggctaagaattttggcctgaaagggcaggagccactagagatagcccactggtggctctgtcaccagctggcccttccccatggtgctgctggatattgtcttaaggaatgagggggaggggctgaagactagatgtgagaacttttgtaaactcaggccatagtagagggaattgtaatccaacttggtatccatgccagggaggaagagactaagactggaggagccgccgactatttccttgagctttctgacttcttgtctctatagcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggaggtgctggattctaggaccttgaaggggaccgcctggactggggaagtggggagggggaagataaaggggtgtagctggcagaggactagggtatacggcctctagcctagacttatgctgcccccattcttgactcccagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcc

SEQ ID NO: 85124 - DNA, 1110 bp, Homo sapiens
ttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagtaagatgcaagacgagctgcctggagtagggcttggggattgatgggagcgttccaagtgcaatatcataattgcttcctttatttatgtttcttttacacccctttcctggcctttaggaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggtagatacacagagcagggagctgatcgaacgcccattctcagaaaacatgggtggggagtagtggggaggtgggtattgagccacaggggtggagctgggctggaaggccacggactgggtgtctgagaacaggaggaattgggaacatgtggaagctggatccgggcatctggccttctaggtgtggcaagaatatgggggcatgtttccaactgaccccctcctcctcctctctcctcccttttcaggagtcccccaaactccccagtggggcttatgagggtggggcacttattaagtcgtctgggaagctcatgctgctccagaagatgctgcgaaagctgaaggagcaaggacaccgagtgctcatcttctcgcaggtgacctgtgcccttagctgtctttacatctgcttcctcttccctctcctcatcctccagactttaatttcttacggtcttcctgtggctgctctggtgtgacaaatgaggagattcctcctgtaagagtttttttttttttttttttttttgagacagagtttcgctcttattgcccaggctggagtgcagtggcacgatctcggctcactgcaacctctgcttcctgggttcaagtgattctcctgcctcagcctcccaagtagctgggattacaggcgtgcaccaccatgcctagctaattt

SEQ ID NO: 85125 - DNA, 1108 bp, Homo sapiens
ggttggaagttggtgcctggatcactgaaggtagaaaggacaagacctaagaaccctagacatttgtcgccattgcctccttgctcccaccctcaggtgctgggcttcaacacccgtcagcggaaggctttcctcaatgctgtgatgcgctgggggatgccaccacaggatgccttcaccacacagtggctggtgcgggacctgaggggcaagactgagaaggagtttaagtgagtgtgggtgatacagggctgagttggacgcaaggggaagagctttgggtgttcctttcttccttggggccgccatatgatgtgaccttactcaactgattatcaccctccctgtcatacaatacttcctggctcgatttcctggggggtggtctcagcccactccacctcccctcagccgagcctagagtagaggggccaggcatcctccccaggggaggggcgttgaagcaaggagcctctcctgggctgtcctagcctcacatttacttgaccacaataacctggcaggaggagctggtggaaaggatgaagagctgactgatggggcccaggaattaagtaccaaggccaaagggaaagacccaggggtggggcgcagggggacagttaggacttggagggctggtaatggtgagagtgagaggcccaggggaggagccctggagcacctggggatttgggggtttgggggtcctcagtcatcctcgcgcctccctcactgccctataccccttctgtggctcccctaaccctcctcccactcccatgctccttagggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtatcagtcttcctgtcacccaaagaatcaagctggctgcctagtctctgtccttcctctgcctctgtccctgagttgtaagcttgcgctggtgtgagacggaggagactggagcttcctgtctgtaagcgcctggagctgacacctaaccctcccaccctgccacccca

SEQ ID NO: 85126 - DNA, 1050 bp, Homo sapiens
tggtcaatgccggaactgatgcctgaccccagcgccgattctaagcgctcctccagagcctcctctcctaccaaaacgtctcccaccactcctgaggcttctgctaccaacagtccctgcacctctaaacctggtaatcagaagtcaggatggtgggagagacagaaagggagccaggagtcagggcgggagaatctctgtctttatcactgtgccttcccctgcagctactccagctccaagtgagaaaggagaaggcataaggacacctcttgagaaggaggaagctgaaaaccaggaggaaaagccagagaagaacagcagaattggggagaagatggagacagaggtgtgtggctccctggattcccctgtggagcgggaggggagggggcttggaggccaggtacctgggagccctctggctcatcctgaccccattgtcctcttccaggctgatgcccccagcccagccccatcacttggggagcggctggagccaaggaagattcctctagaggatgaggtgccaggggtgcctggagagatggagcctgaacctgggtaccgtggggacagagagaagtcaggtgggtgcatggccttaggagtgatgggggattagaatttgggatttccctcttctggggtcaggggatgagggtaacatcctcccttcctatcccctaccccctcccacagccacagagtcgacgccaggagaaaggggggaggagaagccgttggatggacaggaacacagggagaggccggagggggaaacaggggatttgggcaagagaggtaatgggtggaagggaccggacacctgggtcccagagggcatcaggggaggtggagtctggggaaccgaatgcttgggtcctgggcgggtagctgtttgaaaggccagtacagtacagtacagatagtagtcttgggacctgggaggagggtgtcctgaggtgtgagctttgacctgtctgtcctagcagaagatgtaaaaggtgaccgggagcttcgaccagggcctcgagatgagccacggtc

SEQ ID NO: 85127 - DNA, 1114 bp, Homo sapiens
gcctctgtgtcccctccacacagtggggcctcttcactggcagtggaactgcatgcctgccatactgcttaacatcatccagttaggggccttggactgtgaatgcaccatacagatccctggctgtgatcaaacaaatcacattccctcacatgtgtttcaccccataaggcagaaactaccacccatccaaccctctggccttaccccatgaaacttccctttgaccttcgacctttcctcctaccccctctcaccttgccattgatagagattatatcccaaagccctctaaccatctaatcctgcctggtgtagtcactgactcctggcccctttgatccctgttctaattccttgaatctgtaatactgaccttctaacctccctctccccttacatattaaaaccgtgattccttaaagctttgacacttaccacctcccatgcctcctgactatttcctccccatcatccccaaccccaaaccttgctcttccagtatgagatgttctgacaactccccgcccccatgtcttccaatgtccccccatcttcctttcctccatgctccctttttctttcttctttctctccatctgtcttctgtggtaatctggtctctctgtctcttttcctgacactttttcttttcccctgagttgcttctgttttccatctacttcttttactttcttgatctctggttctttgacatctgtgttctcctctctcgctctttttctgcctgtatctgtccatctgatgcctctcttttcctggctccatctctgtatttccctgtctttctcttgcccttctttctctgtggcccgggccccagttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggtaaccctctttccccctagctccagttttccctgtttgtgttcctcctgcacacatacaaacacttccatcagaatcctatacaatatggaaaaacaacttgcta

SEQ ID NO: 85128 - DNA, 1070 bp, Homo sapiens
tgcttgagatggccgccaagaccccttcaaacttcactaagtaggtctcccttctttccatctcttctttctgtctctggcactccctcactttgtccctctcttggtttctgtcgatacccctgactacgagaatcaagtttaccaaggttgactgggtcctgtcagacccaggggatgcccctgagcttccctccttacccctgggaaggtcagggatgcatggatctccacgctacacggatctccaggctatgcctcctccagtggagtgtccttgggtccgtgtcctggggagtggagggagggaatcagcttctcactctggcctgctcggggtgcctgacccagatactgcccctgcctgccccaaaggctaggtcttctgcgacctttcttgggtgcaaggggagtggggccggtgggaaggatggaccacatttttcatctccatgctgagggacagggtctgggtagactgaaatgtaactgactttatctcagaggactgccagaccagaagctcagaacctgaagtagggggtagaggaggggctcctgcttgggagtgagctgaggtcactgatctgacctgctttgtcacctgaggaatctgatcccctctatatggtggccctgattggaaagctgagctgacacctgggttgggggctttgggaggatgagggggctcactggttcagagacagtcttcacaagtcaataggaacagagggagtggagagggagaactaggcttttctgtcttactctcccccctccccccaggtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatgg

SEQ ID NO: 85129 - DNA, 1107 bp, Homo sapiens
gcaggaaggatggcttcctggccttccaaactagccgttacaaactccattactacgagacgcccactgggatcaaagttgtcatgaatactgacttgggcgtgggacccatccgagatgtgctgcaccacatctacagtgcggtcagtgccagccccagggacccatcccccagagctcttcagaaccccaagactccctcatctcccctgccccaatcctactatatgtttgctcaactcaagagttttctcaggggcccttaggttcttaactcccaccaccactttctcctcagagagggcttgccttccagcccttattccttgtgcattcacacacccctgaggttatacaaggtttggggctaaaaaccagaagtatccaaagcctggctctaacatcttccctttccatagctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctctgcggcctgagcgtgttggtttgagggccctctcagtcctgccccacgcatgaaggtggaaagtagggcagccacaccccctggagggccacgaagtggctttgcggatgggtttctcaaccgtgggaatattgatgctttgagctggataattctttattgtggggaccgtcctgtgctttgtaggattttagcatccctggccaccacccactagatgctgatagcacaggcatgaaatcaaaaatatctccaaaccttgccgaaagtacgctgggagatacattccctcccgattgaga

SEQ ID NO: 85130 - DNA, 1026 bp, Homo sapiens
tccctgcttgcttcttgcggtgccattcgctgtagtgcagacacactccattccggtcaaacaggtacaggttgtggacagtcatctgcagggcagggagtgtgagcctcgctccggggccgcccccactccttgggctcgggttcccggacccacagccttccaaccaggtggggaccccacccacggactcaccggaactgctccgagtgcccgtcaagagttacttccggtttccacggagctccgccccttaggggggttctcgctcggccgcggctgggcattaactccgctccagtgctgcttgtcagactccgcctccctccctcagccaatctgtggccaccggagccgcgcacgcgcggccaggcgctcgggatacagaagtgatgtgagtgtctgcgagcgtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaa

SEQ ID NO: 85131 - DNA, 1543 bp, Homo sapiens
aacctgggaggcggagcttgcagtgagccgagatcatgccgctgcactccagcctgggcgacagagcgagactccgtctcaaaaaaaaaaaactaaaaaagaaaagggctgagggttaagagcctgaaagctgggacttaaatgtttttctgaggagggcttttttgaccattccatctaatatggcaccacctcctttccaagtagtcagatcgccttcttatttctttcatgtagcttatcgttctgatatatcttgtttttttctcctctctaaaatttgagggtccgtatcttgtttgtcttagtactggctgcctaaggtctagaatatacataacacagaaacactctgtgtttgtcgaatggacacaaactctgctagcttgtgcacaggatttacagctactggtgatatactgagctttatctctgtgagcctctgccttagtgtctgaaggggacagagaaatagacaaaggagaggaaaagtcaaaatcactggttgccatttttggaagcctctctttctccatgttaaaccccttggcatgaatgaaaggctttcccctttatccttgctgtgtttattcattgtgtccaatgagcttctgaaggtaggagtaactttgcacattttgctgtgtgggctgctgcatctctgccaaaaggtttatgggatttttactcaggagatccaggaaaaggaggagcctggaatctaagcacttatctcctgaaaaggtacagaaacatgttggagatcttgagcctcaaggtgcttgcttcagaattttcctgattctccctctccagacctattctgttcttgggacccaagcttcttggctccagcccactcccccactagaggagctggaaagtttggtgctgtggtcataccaaagatgggcaacacccagactcctcacccttttccccagcattgtgagcgccatattcagagcctgcagacccgagtgttagagctacagcaacaattagccgtggctgtggctgccgaccgcaagaaagataccatgattgaacaactggacaaggtaccagggtagcaaaatgtgggtgggtctctccatgaagagcattaaggaataataaataagtgggtggccaaccaatgtttcttggtacatgctgagagctgggcaaggggttggtttgctgactgttgggagaagatggctgttgaccctgcccctgtgggtagaaagaggcaaaaaagttattttgaaatttcatcttacttgccctacctaagaccctggcccgtgtggtggagggctggaaccggcatgaggctgagcggacagaggttctcaggggacttcaagaggaacaccaggcagcagagctcaccagaagcaagcagcaggaggtgagcgccctggagcatatggcattagaacctgagtcacagatctcaagatggaaaggggcagaaatagctctggaattagggtttccaacagattgacctcagtcttgtagtggctgtcctgacatttcttctcatccctccttt

SEQ ID NO: 85132 - DNA, 1049 bp, Homo sapiens
ctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccagcctcagggtatgttatatcagacacgtagaatggatttgattgctctgtcgaacatttattttagctaagaaatttatgtctttcacccatagtcattttcactttgatgtatgtttaaagtgcgaatatcttaataaggaaagggaacctctttcactccttgaggcaaaattcttgttcttcatctcatatgaggggaaagttggtactggattttgtctacattatatcctccatcctcttctaagcccaaacagatttgggccgttatcccaccttccttcactccaggcccggtatgaaagccagcggatccagctggagtcggagctggctgtgcagctggagcagcgggtgacagagcggctggcgcaggctcaggagagcagcctacggcaagcagcctccctcagggaacatcacaggtacgtgggactcactgggtgtcacttctctcagccacagcacgtatcgttagtgccaggcctgtgttcccttcaatccctttgccatggtccagcactgtgactcccagggtgcgctaactcccatcagctgggacctgagtctctctcgggagggctgccttcacgcgttcatggagagccagaagtgcctgggaattttcatcccatagggagtagcccttaaccaagaactgatgggtgcagaatgatagatggtccagctccctcactgggacagtgctgaggtatgacctgtgctgtctccagagctgctctgtcggactgagcctcctcgcagcctggcctcacttctcctcacacccattctgctgccgagattttctggaactgcttccgaaataaatttattta

SEQ ID NO: 85133 - DNA, 1026 bp, Homo sapiens
cagcctcaaacggtcctcccaaagtgttgggattacaggtgtgagccactgcatccggaaatttataatcttattaaagtgtttgtaccatgtcttatctctttaaacctactgtgctttgacccttctttctgcctctctcctggtcaggctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacaggtaactgggggcagaagtcactggggttccccttctgtgcatgaattggctccctctttcgtaccctgctttctgtctgatacttgagcatttagtttcccagatgcctttagtgatcgcaagttgcaaggagcagaaatctgctcacattggtccaaataaagggattgagatctcatggaaatatgacatcgctggacttaatgagaactggagttgggaacggggtactatcaggaactgaggcagctagctggcccttttctgtgggcctgcatagcctcctgggtccacctctcctgcacatctgctcttttttcttgctagaccagcattcaaggttctcacccttcataacttcagtttacacatgggtttgaccagctgtgatactgactctagctgagcctctagacatttatagagacatcggtgtctcagtttttttaggtccagtttaaagaggccatctgattggattggctgaccttgggtgtggtgtccacccctagtttaatgtcacctgtgatttgagtggatgggggcattctgtgtggtacaaacatgacaacctaggtcgaattaaaaatgagggatggggccgggtgcagtggctc

SEQ ID NO: 85134 - DNA, 1027 bp, Homo sapiens
aaccatgtttataaaacttccatttaaatgctcactaaaatggacaaagaaaaacaatactagggaagaaaataacgtagacatgaaatttaaaaaggccccaaattcatggtacaaacactgaaaagcactcagtcaaactgaaactggaagaggatatcctaccttgagactcacacgcagctctcagctctggcacatggtgcagggtagtggtgatggcaggtacaattctgaaagtggtgttggcaggtaagaggtgggtgtttgagggacagagtttaccagattctgagaagaaggcagggcccttctatctgaccctgagttatacacatgataggatgtggattcatagagtgttttgtactaatgtttgcattttacttccacctaagtaactttctagcccccaggggacgggcaaaggaagaaaaggtgaagatgaatgaccagacatgtgggttgccctgctcagctgtgtcagaacggcttgatcctcagccccgcacaggaccactctctggcatgcaccagcggagaaactggaggcacactggcgcaggagcagccccaggcttgagggcttttccagccctgtctgtttacccacgtatggaaatgtttacttttctattttttaccttaaatatgtaacactggtttgaccaaactctcagattcatggcacactatcatcattggtaggtgatggtttgctacggtttttaatagctggtaaagtgaacacccagttcattctcctcattatctcctggattcccgcctaccgccatcagtcagtatgccctacatttttcttgacgtgaagcacagcctggagaatattccctgaaacagctctttaaacgcaatccaaaaaaggcatcatgctgacttaaccatgttatgaggtgagtaaaacaacgttgatttttaaaactgtatatattggctgggttcggtggctcatgcctgtaatcccagcactttgggaggccgaggtgggtggatcacctgagatcag

SEQ ID NO: 85135 - DNA, 1018 bp, Homo sapiens
gccggagcctcctggcgtcccccctccctccctccgctgccccacccccgcgctgtacccgggggctccacccggcttcgctccctcaagtagcccacggcgaactccaatatctccgctttctccagcttcgggttccggaggttctacagacgggaggggagggcgcagagacagaaaggggtggggagaaagggggaaagtggcagggggaagaagggagggacggatgcgggagctggtggtgcccccgatcgcatttgcgcactgcccacagaacgcgcgaccaaatgcggagtggagatgaccaaggaaagtcctggcccaccctgagacgaaactgtccaatcctaggggttggaaccaatgcccaacgcgtgaggaggagatttgaaaccgcaacccagggaatgaaattaaccacccgacataacagaggctggctcatcagaggctggctgtgggggagggggaaccggacacttagagacccaaagggtgaaactgaccgaccccgggagcgaaatttacagaaccaggcgtgaaacttacagacccgaggggtggcgaagaagatcgcgttctgagagcgagtgggggtctgggatggaattccaaaggcgggactcgggtgaggatgccttggggccagggttgccaaccaagcttgtgtccccaccccagtgggaagccctgggacgcggaaacgggaagcttggggacctagggctagcggagggactgacctggtcccgggtccgctccagcagcagcagcctcagctcttccaggctgcggttgatgcggtcccggcgccgcttctccacaagcggcttgagcatctgcgaccagcgagaaaaggagagcgggccgaccagaccgagactcagtgcggccgccccggcgtcggatcccgccgctgggagagcccggcttccaccccggccacaagaccccagattgcctagggccggccccattcgatccctctccgctccccctcccaatgcccctagat

SEQ ID NO: 85136 - DNA, 1038 bp, Homo sapiens
tacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggtgagcactgacccctgcgtctgcctgccagcccccacccc

SEQ ID NO: 85137 - DNA, 1260 bp, Homo sapiens
acgcccgggtctctgtacaaagtgcgccttatacgctgccaccgctcacggctgcgcctgcgcagatttagcagccgtggttaagagtgtcgtcaaggaaaatccccagcttctgggtaaacaagttgccgcgtgagaccgccggcacgtgtaccctacagctccaagacctctcagcctatgagaaagcttggagagcgggactggcatttacgtcaccaatcttggcaggtcgggggttatttccccagccaataagaacctcagaagtgtcgagggcgtggcttccggtcaggcttccaatccccgcgttggggcggcccctctctcacgtgtatctctcccgcccccgttggcctgctgaccaatgagaagacgatggcggccggaggtgccaatggaggctgtgcgggggccggcggctgcacgcggcacggggcatgggtcggcgcccctaagccaataagcgtggggggcgtggcagcccggcccgtgggcgggtttggaggagccagtgtaatgctagaagtcctagaagaaatttggagtgtgcgtgcgcgccgagcggtgagtgctcggggatgggggagagatgcggggcgatcggtgtggacttttccggggtggtgtggtcggttaggaaggtgttagagtgtgtgtgtgtgggatcatgcaaatacgtgataactgcggtgggagctctgatggttgtggagaatagggaccgtgaactcaggtctagagggacggggtgggagttagtgacatcagatccctcgcccccgtggagtccctggacacttgactgcccggggggaagggctcggaagccctctgcgacctgagggagctccctctcaggtcgggactgaaggagcccctgctcccagggtgtttgggtggtctccttaaacacttgaaagaggcagaggttcggaggccggagggaggccctggtagggcaagtcggagggtaccaaagggttggcatgctgatatgagaaaggatggtgttttaatttgtgagacccagagctagtcacattacggctccgggcgtctttctcatgttaagcggaagggtttaggcctcagagtcgtccttgagaatagacgtggggtagcaactattgagtcctgagaggatagggttggggtttgggcagattggctgtgcacgtcttcctgagcccctagaggtggggaggcaccaacagggtgttttggtatctgtctgtacaaacaaccaggccaggcgtc

SEQ ID NO: 85138 - DNA, 1100 bp, Homo sapiens
tggtgtgaaagggtaggagagatgctggaggtgggggtgctgtgttttagaccccccatattatcccagtgtcccctgcccccctcttcccccaccccatgcccccaattctgtggcgcatccagattgtgaaaatgtacaataaatgtgtaatgagtaaccaggtgttgtctaagatcttttttatttttctattttttttttttggttgggggagaataagatcttttcttaaccaatgggaataatattggatcggaaggtataccaggaaggttgagaagatacattggtaatggactggactttgcaagaggccctgaccttgggcagggcaaagtgtgattctcaaagtggccacaggggggcactaggagttggtaatgggaagtgtcatagccagcccgtgtctctaagcccggtgcgccctgtggtctagggttcccagctttcgtttccctttactggggcatgttcctgctgttggactcctttctactcctcgatttaacttctagacgctctgccgtggctcccgtgcagcagtagatgaagtagttggccatttctgtgaagcatgtcttcccctctgtgcctaacccagtgccagcgcccagatggggttagtaaattgtggtttaaataggctcacagagacaaagctgagtatgttgtggagctgcctgtagatggcctactacccctgtactctgttgtatgacttgtgactttagaccccacactgaactgccacagcctgtaggtccaggaggccccgatgtggcatcttagtatccctgttcccaggtgcttcaacaatgagtggccggccgcggtggctcacgccagtaatcccagccctttgggaggccgaggtgggcggatcacgaggtcaggagttcaagaccagcctggccaacacagtgaaaccacatctctactaaaaatacacacaaaaaattagccggggatggtggcgggcacctgtaatcccagctactcgggaggctgaggcagagaattgcttgaacctgggaggtggaggttgcagtgagcccagatcaccccactgtgctccagcctgggtgacagaacgagac

SEQ ID NO: 85139 - DNA, 1774 bp, Homo sapiens
accaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccacagtttacttcagcacttaaatccccgaggagtctgccctgcctagagaagggcctctcccccaaccctcagccgttcctccacctctcagccatatctttcagcccccactcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtccctt

SEQ ID NO: 85140 - DNA, 1041 bp, Homo sapiens
aggagactgcagcagacccaggcccaggtggatgaggtgagtgtggggggagtcaaaagcagtaggagggaccctgggggttggcgtataggtgtaggggcccatgttggtttgggagtgatgacagttcacgcctgtgggtttgcggacaaagataccatgccccatccctgtctccctgtcagcacgcacttggaagggcgctgggggtgttaatcagctttgctagcctggggtgtgccagcctgggcaggtgtgctctggtgatggacagagcgcctgaggttccatagagggagggtgttgctatgacatctgagatgtcaccagcatgcccctgatgtgtgctccttgcatgtccccaggtgtgctaggcatgttctgtgtgtccttggcatgttaacctggcagtatcagggtgcatgttccatgtgtggcacggtgggcacatgtttgaggattgccctcactgaggtgggccttggcacacccccctgcctcgtgggcccttctcccaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaaggtaagggtggggacaggaaggaggacaggtgggtgaatggggtatcatagtttgtcttactgatcctcgcctctcacccccagatgatgatcatcttgggagtgatttgcgccatcatcctcatcatcatcataggtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatc

SEQ ID NO: 85141 - DNA, 1040 bp, Homo sapiens
gggcgacatggcaaaaccccgtctctacaaaacaatacaaaaaattagccaaacatagtggtgcacacctgtagttccagctgcttgggaggctgaggtgggaggttcacctgcacccaggaagtggaggctgcagtgagccatgatcacaccactgcactgcagcctgagtgccaggagtgagacctgtctcaaaaaaaaaaaaaaaaaaaaaaaaagactgacgaactctccatgcttttcttccctctgtctgcaacttacatgcattttcgacctagaccttcagaggtgagctcccccagtgagagattcatcaaatataactgttcacagatgaaagaagttgtcataggccaaaagtgaggaaaatccaggacctgcttttgcaaggttttccaaggtctctgaatagaaggaagtgaaagagtcagctacatgaacatctagggaaagagcattccagacagaggacatagcaagtgcaaagatggtgagaacaagccaagtgtgtttgttgaacagtaaggaaggcagcatttcagaaacctagtgatggaaggggaagaaaagttcagtgtgaggttcgttaggtaaacaggggccagatgaagccaggccttgcagctacagggagggacatggtcaggttggtgttctagatgatgactctagttgcaacatggataatggattttaagcaaattttatttttatttatattcttcttccattttttttctttcttttaagcagattttaaacagaaggctaataattatccagaagagacaggatgaggcttggacaaaggaggtggagggtatcaaaagatatttagaagataaaggaagtctggacttggtgctgtgggtgagtgggaaaaagggagggtcaggatggctgttagattatgggggctctgacagctggaggtctggggcattctgcttataataggccttctgggccaggcgcagtggctcacgcctgtaatcccagcactttgggagaccgaggcaggcagatcatgaggtcaa

SEQ ID NO: 85142 - DNA, 1032 bp, Homo sapiens
cccccgccttctgcccctgcgcggccctgcccagcgcctgcacccacacccacaccggccattcccccaatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggactccttaggtgaagccgtggacatgagcatcaagggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacct

SEQ ID NO: 85143 - DNA, 2784 bp, Homo sapiens
cctggccagaaggtgatggagaatagcagtgggacacccgacatcttaacgtaagtgccccaagcctgggggtggacgggggtgaggggacaatgaacaggcaggaagtcggggagataaaacctaagcacgggaggagtagggatgaagacaagtggggcggaggacaggatgggatgaggaagcagagagaaagcaaacctcttaataaccaaaaccggttctgagttgccttcctccactttctaagcaggcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcagtatgggttgatgccccctgagccgaagcccctctgctccctcacccccagctcctcattcagccccacttcatccagattgctttctctgtagctatggctagtgagccccatttagctcttagtcctggcaagccttgaatccagaaatctgcctccagtttccccttaccactcccagccctggtgtccccggcctgggccacgtctgaccccagtttgctcctatcatcttttccagctcttttatgcctttggcctgaggcctcctctgtctcttcccccagccatcccaacatcctgcgtctctacaactatttttatgaccggaggaggatctacttgattctagagtatgccccccgcggggagctctacaaggagctgcagaagagctgcacatttgacgagcagcgaacagccacggtccgggcgggtgggcacctggggcgccagtagggggctcgaggctgagggtgtgctgcttgtagctggaggtccatccttgtctgattgcctgtcgttgcccctcccagatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggtatggtggcctgggaggccagacctgggtgtgaggctgggccattaaaacctctccaggggccgtgcaccgtggctcacacctgtaatcccagcactttgggaggccgaggagggcggatcacctgaggtcaggagttcgagactagatttgccaacatgatgaaaccttgtctctactaaatatacaaaaattagccggccatggtggcggacgccagtaatcccagctactggggaggctgaggcaggagaattgtttgaacctgggaggcggaggttgcagtgagccgagattacgccattgcactccagcctgtgtgacagatcgagactctgtctcaaaaaaaaaaaaaaaaaatggttagagtgtggtgctaataaccccaaggtcgcaggtttgatccctgtaggggccaatggtaaaactttggccaggcgcggtggctcacgcctaccagtcccagcactttgggaggccaaggcgggtggatcacttgaggccaggagttcaagaccagcggaccagcctggccaacatgatgaaaccccatctttactaaaaacacaaaatttattaagcagacatggtggtgcacacttgtaatcccagctgttcgggaggctgagacatgagaatcacttgaacccgggaggcagaggttgcagtgagccaagatcgccccactgcactccagcctggactctctcaaaaaaagcccggagcagtggccttttttcctcccacatcactttttaatggtttcatagtatcacatagtagctgatttatttaaccagaacatgcctgatgggcattagagatgtccccagtgaactccaaatgaacactgccctcatatcagggtatcttattaagatatatccttcagtgtggagttgctgggctgtgtgcaggctcacctctggggctttgggatatatcatcaccccaaccccacccccactccagtggccttgcctggctggacctctcccctggtacatcccgtggtcttttggctcccagccgtcaggcagcagggaaaggagagttcctatgtcactaggacccctgcccacgccccttatccctcccaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtgggagggcggcctgggcttcgtgccagctgctgaagccaggagctggggggctgggggtgggcagagtgtatttgcatggccctaagtaactccaaacagaatgggtagtcaaggaagatgtagccagggtgaaactaatgcagcccttccatctcttcacacctgcaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttg

SEQ ID NO: 85144 - DNA, 1067 bp, Homo sapiens
agctactcgggtggctgaggcacgagaatcgcttgaacccgggaggcagaggttgcagcaagcccagatagcaccattatactccagcctgagcgacagagagagacctgtctcaaaaaaggaaaaaaaaaaagaaaagaaaaagcaagataattcactgggggaatttggggaaactttcctaaactggaagccaagcgtgagcccttctcattccgcctcttccattgggttcccatgacttacgtcacaggacatcgagccaatgggaactaggcatgggcgacgagcttgcccaatggggccggggcgggagatttgaaaagtccttggccagggcgcggcgtggcagattcagttgtttgcgggcggccgggagagtagcagtgccttggaccccaggtgagctggcctcctgtcgcaggccttgcgccgggagtgggcagatgatcaggtagatcagagggtccgttgggctggcctgcgcgcacgccgcagggctggaaggaggtagggacgatagcagggcgggggcggtgagaccagcgcccagattggggctagtgtgctgacctgctcccttttaccagctcgggctagcgcttccggctcgatcggtccaacccctccctctctctctctttttctctgcttctcacggctgtttcccttctccgcccagctctcctccccctttctctctaaggatggcccagaaggagaactcctacccctggccctacggccgacagacggtaaggcccttccctccgtccctgcgcccccatgaccccgcatggcgagttcctgctgggaaacttgagatcctgcaatgagcaatcctttaagcactttcttccccgttatgctccaaagtacgggtcccaagtttgacgacagaacccgctctggtcatttgtagccacatcctgtcaggtgctgccaacgtgaatctgaccagccagtgactcccagctggtgaggacctctgcagggctcgtcacatacaaatgatatctgggactgagcaggcagggcctggccttcaggccatgattcccaatcca

SEQ ID NO: 85145 - DNA, 2823 bp, Homo sapiens
atcagaaggtaaactgggactccagggacccaggacctgacctgcgccctgagcctctggctaggatcccagcactttgctctccatcctcccaggttcacctcattttctttggctcttcagtccgctggtttgagttcttgcacccgggacaggtgtaccgactcatagctcctggccccgctgtgagtgtcctacttcatcatacctttccccagaaagcttttttggggttggggtctaaagagggcatgccagtgcctggtcattctctaggcctcctggaagaaggctggatttagatacaccagaaagcctgtgtgtgttgacacacttccttctccatgctccagaaagaacaaaattgggtcagaatgttttgtgaacctcccactggactagcacacactcacaggcagtcgtcttcccatttccgtgcagacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaagtaaatgtccaccaagcccctctggttaatttggccactctctcttctcccaagctagctgggtttggtgaagacttcattttctgctgcaggaggtatttcttttgttattgttgtttttgtttgtttttttttgagacggagtctcactctgttgcctaagccagagtgcaatggcctgatctcagctcactgaaacctctacttccctggttcgaaggattatcctgcatcagcctcccaaatagctgggattataggggtgcacgccaccacacccagctagtttttttgtatttttagtagagacagggtttcgtcatgttggccaggctggtcttgagttcttgaccttaagtgagcctcccacctcagcctcccaaagtgctgggatttaggggcgtgagccaccttgtgcgggttttgaatgatctgccacaaccctctttttcccataggccctgttactcttagtgtgcagtgtggcagagctcaggttttttcaggactttatatatgaagttctagcagatactttagctccattttctgccttgaatctgactgtctccactctgtgctttcttgtgcctccattctcagtgtatttccctgaccttccagtttcacagattccttggtgtctttctccgctgagattttgtcacggacactatgtgaaccccttgtggcgtctctctggatgaaactgggtaatgacccttcctttgtggggaaggtatgaaatagagtgatgggactttgtggacttcacagatcctactaacacccaccttccttctatagggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccaggtgaagatgtgtagtgtcacctgcctcctcttgctactgatgtggctctctggaatgtgcacccctgcttaactttgctgcagcgaccccttctctttcatacaggtttccatatatcagtctgccatttgtgcccagccagtaccctcacgaggtgttgcaggctggtcctcctcctagtcttcccctagctttggtagagccatggctaggatatgtccctcagggggagtggccactctgtggtgcttgatctctgagtcccagcttctaccccaatttgccttgtcttcctggtcactcactattcctcttccacttgcagatctcacaatgtttattgttgtttccggtcatccacttatgtgcaggtcctgagttttccccctgagaccaccatcaggtcagtgcccagaccccaacccctaaacttcctggcttcacatctgcatctcccacatgtccctggttctgaagattttgccatcattacagtcttctccaatcccaacaagatgtgttgagtcagaggagcttctctactccaaataaaaaatgctctgtgtctatcattgtacccagaatcatttagtgttctaggcttttgaaggcttttcagtcttaacatgcaaatatttcttggctaacatcatggtgttcaaacctgaaaaataaccaatgactatcagagatcaggaattaaaatggggcttctaggagcgcatggaacccactgctgtccccatcctgatgccctctaagtccttctagacccaccctgctttcagaacccctttgcctgttctgttatcttgacccctgtctctgtctccctgtatttatttagcattcccctgccccacatctacctggctgaacttctgcagggtggtcagtccccattccaggccactgcctcttgccatatcgtctctgtcttcagccttcagctcttctgggtgtgtgcttattgtaccagcatctgccggcaggtaagggagggaaggaacaggctgaactgagtatggagtgccagagggatgtgatgggaccaagaggacttttccaaccactgtcttcatcccagggaaagtgcactcgcctgggctccacttgccctacgcagacagctataagccaggccatcatcaggtgagagcacaaggcgtgcacccattgtgccatttacttatgagaccactttgt

SEQ ID NO: 85146 - DNA, 1086 bp, Homo sapiens
agcctacggggcctccctgtacgagcagctggtgtgggaacgtcagttaggacttcccctctacctgtgggctaccaaggccctggaggagctggcctgcaagtgaggaggctgagggcccagggcggggaggcagtgggagtagcacacttccttggcaaggagagcaggattcttgaagaggcaggctcttcaggggaagtgactgtgctgcttttcctggccaaggctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaagtatgaggatgtgggggaaggatggtggcagaacactggaggacacctggggcccatgggacacacacccgatttctcttccctccttgacagtacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggtaagggggaccctagcagggctcaggtgatttccctttttgtcatccttattgccacgactctagtctcggttactatctttcttcgtcattttgactacactagccttctaagcagaccacttcatctgttgttggccctccaattcattctctctgcagcaactagaaatggggatatgccaggcacagtggctcatgcctgtaatcccaacactttgggaggctaaggcatgaggatcactggagcccaagagtttgagaccagcctgggtagagagaccttgttgctacaaaaaagttgtcttaattaggtgcggtggcatgtgcctatggtcccagctactcaggaggctgaggtaggattgcttgagcctgagagatca

SEQ ID NO: 85147 - DNA, 1040 bp, Homo sapiens
tacttcccttgacatcagtcacaatactggatacatatatactcaatacactttgattacatgaatgaatgttgtttgtgtgttatggggcgggatagggcacagttttctcagtggaatatttatgtattttgaaggaagttttagggatggtttgtatgttggggaagtggtttggaaatatttggcatctcctgtgagagaggagagacgctaagatttagttggcagacatagggaagatggagaggtgagttgagactcacagagggcaggtctctgagttcaaatcgtgagggaaaaggactctggcagagtggcagtgttggggtctcttgtgtcacattgcctgtctctgcacaagccaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcggtgagcacagggagagatcctagagcttgaggggccagaaatgtgggttttcaaagaggaagaaaatagtggtcaactggacctcggcctgtttgcagggagcagtcactggcgtgttgaatgagcccgctggcctctatgagctggatgggcagctggggctctgccttgcctaccagcagttccgtggccttaggcgggtgatgcgacctggagtgtgtctgcaggtatgtgagatcagggctgataacaaaaagagacctctgcagcttctcttaccttcataggctccttttctgcagcagggtggttatatagaaatatagaaattaaaagtgtgtgttagggggcacttttgctaaggataacttggacagaagcttaaat

SEQ ID NO: 85148 - DNA, 1359 bp, Homo sapiens
atccttattttctttttcctttttttttttttttttttttgagacagtctcactctgttgcccaagctggagtgcagtggcgtgatctcagctcactgcaacctccatctcctgggttcaagcaattcttctgcctcagcatcccaagaaactgggattacagctgcacaccaccatgctcggctaattttttgtatttttagtagagatggggtttcaccatgttggccgggctggtctcaaactcctgacctcaggtgatccacccgccttggcctcccaaagtgctgggattacaggtgtgagccactcgcccggccccatccttattttcttaggcctttagccccaggttttacccctttaatcaatcaaactcacctcttagtccatgttccctgcaacctttccctgggctcttgagggtttatcagggttgagggttgccttagtaggcttggacctggctttgcaggacctctgttcccttcactctacagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcaggaacggaagcctctatgtgagagataacactggcgtcctgagctgtgaggtaagtggaaggtggagatcagatgcctcagatcctgacaagaatggtgtccaaggatcaaggcaattaagtctctgaggaaacaaacggggaggtgggtggataggatgctaaggttctgattaacccttgctcttggtctttcttagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcaggtaatttccccctctaggcatggcaggggcgctgtaaaactgaaggatgatgctgggtcagtggagggagagaaagaaaagggcattgatagtaatatagactgaatgttccaaatcaagggaatggtgggctttgaatattaagaaggtaaagagaagggttgttcaagggatctgtgccttacctaagggaaagagaattttgaaggtttttagcatagcttgctttgggctatggacattttgtatcattaccaggt

SEQ ID NO: 85149 - DNA, 1028 bp, Homo sapiens
agtttccctcttgttgcccaggctggagtgcaatggctcgatcttggctcaccacaacctccgcctcctgggttcaagcaattctcctgcctcagcctcccaagtagctggaattataggtgtgcaccaccacccccagctaattttgtgtttttagtagagacagggtttcaccatgttggtcaggctggtctcgaactcccaacctcaagtgatccgcctgcctcagcctcccaaagtgttgggattacaggcgtgagccaccgcacccggcccggatatttttttctagtcctttattcttcccaagtttccttggtgggccggatagtcaagatgttttaactaaattcactttcctcaggaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctataggtaaggagaggtggcggttgcgggggctgggcaggggcaggtattgaattcaggattgaaaagtaaggttctataattagaaaaagggcaagtgagagagtgagcggaggacaaggtagtctaaacataccccttctgcagagcttttctaacactatcaagctttccttttcctaaagttctcctgaattggcttaagattaaagaaaaagagaggaagaggggaagagagaaagaaaatttggaaaaagaactctcgaagtggggaaagaggctggtgttatctttattttgtgtattgggaaacaaagatacagagaactgtttgacattaccaagtgcagatcattgtgtttaagatgtgagttttagggcttccgagagtgtgtttatatatatatgtgtatatatatatatatatatatatatatttttttttttttttttttttctctctacactatcatttccaaaagtgttctaggcaacgttagtaaagc

SEQ ID NO: 85150 - DNA, 2194 bp, Homo sapiens
tcagttcaacagataggccatagttaatgttatttttattttatttatttattgagacggagttttgctcttgttgcccaggctggagtgcaatggcgcgatctcggctcactgcaacctctgcctcccgggttcaagcagttctcctgcctcagcctccctagtaactgtgattacaggcgcccgccaccacacccagctaattttatatttttagtagagacagggtttcactatgttggccgggctgatctccaactcctgacctcaggcaatccacctgcctcagtctcccaaagtgctggggttacagatgtgagccaccacgcccggcttagttaatgttattttttaggaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacaggttgggcccaggtattagattcttgggggacatgcctcggtgctgggggcagtgtctcaaggtgtccttgccctgtctccctgcagctgaggccctccccagtgctgaggagacaaagaagctgatgtggctgtttggttgccccttactgctggatgatgttgctcgggagtcctggctccttcctggctccaatgacctgctgctggaggtcgggcccaggtaagtatctcatcctgcccacccctttcttctgctttcctttgcttcctcttgtgatccttgggagatttgcttttcctttgctctttgctacttcctgcctaggaaaccacacatgtgctttccccatttgggtagatccctccaaagacctagcctgctccaaaacatgttctcaaagcaaaataaattagattccaagttaaaatcaaacagttttggccaggcgcggtggctcacgcctgtaatcccagcactttgggaggccgaggtggggcagatcacgagatcaggagattgagaccatcctggctaacacggtgaagcctcgtctctactaaaaatacaaaaaattagccgggtgtggtggcgggcgcctgtagtcccagctactaggcaggctgaggcaggagaatggtgtgaacccgggaggcagaggttgcagtgaaccgagatcacgccactgcactctagcctgggcaacagagcaagactctgcctcacagaaagaaaaaaaaatcaaatagttttgatgctagaggacagttttggtttggtttgagtgtactttaaaagcaggtttcttgttgcccagcctgaggctgaaagccaatggtgaggggatagcggtgggaggttgtccagacagcagtaggcaggatccaccctcccagctgaggcctgccgggggttctccagtcctaaccatcaggcccattgttcaggctgaacttctccaccccaacatccaccaacatcgtgtcagtgtgccgcgccactgggctggggcctgtggatcgtgtggagaccacccggcgctaccggctctcggtgaggtgatggggaatcaggaggaggagatgagccagagatacaagattagatcctaagctctagagagaagcagggacaggtgctcctggctttaggcctgctctgtatggtcgtacaagttgttcactgcctgaaagtacctggttgaggggtaaatggggcagaaatccagcctatgcttcctttaatttgtgcatcctggcatggattcatacctggaaagggcgtctttttgtaatctgagaaaaagtgccatatggtgtggcagtgggctagccttgcatgactaagagggtaggaaggtggaccatttctctccattcttaaactcttcaccccttgccctctgtgtgtctgcacccctagtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtgagt

SEQ ID NO: 85151 - DNA, 3095 bp, Homo sapiens
aggcaggaatatcgcttgaacccaggagacggaggttgcagtgagctgagatcacaccactgtacttcagcctggacaacagagcgagactccatctcaaaaaaaaaaaagctggtcaggcttctccctaacatcagcttcctctgtgttcacgctgccttgctttcgaggcctcttctcgtggcttccccagtgttctgattctgccttcccttcttacaggcatggaagttgtaaaggttggaggtcccgtctacaggattggagttggaggtggagctgcttcatctgtgcaggtgagtgggaattgctaaaggtgcagaatccttgatataaccgggccccaggcataggggagcgtataggagcttccagtctcgctgagctgagctatgccatatatgcccccaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggtgaggaaaggagttggaacaagagactgggcctgcctggtatcctgccaggtttcgtttagggagaggtatcaggaatctccaaccaaccacccagctctgggtcccattctccatgctctgtacattctagacaggttcagggttggaagggtggaagcctgctgccgtgggatgattggtggtaagggtgcggcagcagttgacacaggaacacaccaaattacaggcccctttggaggccagggactgccctttgttgcctgaccaccactaggtcactgcttctccttgcaaccctctcaccaggcaatgtcctaaaagagctgagtgacccagctggagccatcatttacaccagccgcttccaggtgggtctcgtcccctgaagtgtgacattttcccacccctgccagccccagcccgcttccacccatctctcttgcaacaacatgagacgtgggagtgcccactggcccttctctttcctccccgccgtggctgtgcagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagagtgagttggcccagggagttgggagcaaacactggggcagacatgagccacctgggtatgggctagagggagagctgtcaagggagagagacgagaggaagatgggaggtagtggcaaacaagctgtggggaatgttggatccaaggaggggcagggactcaatatggaaaccaaacaaggagtggaaagcacatttgtgccctgatttctaggaacattccttgctggtgttcatagtctcatcccctctgggtggggtccctgtggtctatagatagtgctggtggacgatcgggagtgtcctgtcagaagaaatggccagggggatgcccccccgacacccctgccaacccctgtggacctggagctcgaatgggtgctgggcaagatgcctcggaaggtatgtggggttgaggggatgggtttttcctgtggtcctctccacaccaccctttaccctacgtgcactttgtcgcctgtgtgcccagcccgccccaggtgttcacactgcctgtcgctgtctgtgttgcaggagttcttcctgcagaggaagccccccatgctgcagcctctggccttgcccccagggctgagcgtgcaccaggctctggagagggttctgaggctgcccgccgtggccagcaagcgctacctcaccaataaggtcctccctgcacccttcctctgccccctgcctccttcctccgctcagcctcttctgccctcccacccttagaaagtgctgtgggggtttttgcctggccctgcaggaagcagcaggggcagggcagccaccctgatggcctggtctccctgctacccaccttctaagtagagctgttgtctgcattgggggaaagacaggcctcccactgccctgagtgccttgggggcatgtgcgggagctcaggctgtccctgtcccttgctctcttgctaaccccacctggttccacaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggtgagttctcccacagcttctatcctggagcccccgggcttcaggacccttccacatccatctgtagcccttcatttcatgttgcaacctcccagtccgcctgcacccctggcctctccacatttctcttcccctctaatgctgtgcctctgccacccccaggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctggtgaggtgtgggagccccagggaggggaggaggaactatggagctgggttggcaactcattcctttggactcctccttgctctacagggtcactggtcatctcagcctatgccgtctgcccagacatcacagccactgtgaccccagacctcaagcatcctgaagggagaggtatggacatggccccatcctttgtgatctttgcttgtgtgatctttgtttggctcctgctttgtgagtgctgggcccccatctcaacactgggctgtggtgttttctgggactgattgtctaggtgtctcaccacatgctgggaatagcagt

SEQ ID NO: 85152 - DNA, 2192 bp, Homo sapiens
ttggtgcgggccttcagcatcactcaggggctgctgaaaggtgagtgaagacccctggggagatagcgcacagggtgccaggcgtgcagcaggcgttcaccatctgagcagtggggcaaaagggactccaatggacgatgtaccccagatcccctgacattctgacacacactcttgatggactgactccggaaggtggggtggggctgtcaggtttgggtcccgaggttgctgagctttcttctccttcctccagaccgcctcctctgctcaggccacgatgtcagtgacggaggcctcgtcacatgcctgctggagatggcctttgctggaaattgcgggctacaggtggatgtgcctgtccccagggttgatggtaaggaacctggggtctagtctcaggcccgggctgccttctctaccctgcagaccccatttccaatatattaaagagtggagtgccctccagtcccctttccctgagtcttccctgactagcttttctgtgctgtctctctgacagctgaactggatggaactggctgacacccaccatgttcctgactgcacccctctgagacttcccatccctgagatgtccatgatgaaacatcctcagtcctgccgtcctagccctcatcctccctgatccctaccctactctctggctgcatccctctgaccctcaccctggcccttcctgcatttccctgatcccgccccaactcccttggcccttcttgcatccccctgactccccacattgctctcccagtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtgaggaagtgagggagagagcggtgtgcagtgggcagtcagagtggggtggccgcggtccatccctctcccactgtggagggggccatcctttctcctagcccgtgggagatttgttcctcttcctaggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtgagggagtgtgtgcagaggctccgcgtcctgggggcactgagcctggatgcctgggcctgccctcagaaaggtgtctggggagttggggtggggaagtgactttctggcccaaagacacttattctcccccaaggtggtcccagcccccgagtcgccatcttgcgagaggagggcagtaatggagaccgggagatggccgatgccttccacttagctgggtttgaggtgagcagggtagggggcagctgggggtgattgtccagcctcagctgcgtgtcctcccacccacactccccctccccaccttcgcaggtatgggacgtgaccatgcaggacctctgctctggggcaattgggctggacactttccgtggcgtggccttcgtgggcggcttcagctatgcagatgtcctgggctctgccaaaggtcagtgtgcaggcttctgcccactcccttcccccacattcctgaagaggtgcctttagccccatcttcctgggctggggattggcctctcactccaccgagctacgagagagtgggcccattcgttctgggccacatgccaacagaaggctggtagtaaatttttaattttttcattgaaaaaaagtatatatatacacatatgtaattaaaatatatattattaaatatatattatttatatatattatttatatattattaaaatgtatattatttatatattattaaaatatatattatttatatatattatttatatattattaaaatatattatttatatatattatttatatattattaaaatatgtatatttttaaatatatatatatatatatatgtattttttgagacggagtttcacccttgttgcccaggctggagtgcaatggcgcaatcttggctcaccgcaacctccacctcctgggttcaagcgattt

SEQ ID NO: 85153 - DNA, 1609 bp, Homo sapiens
cagttatgccccttcattcccaattcccttttttgaggtcctccatgtctcaccctgacttccctattccctgctagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggtcaggcccaaggaaggctgggggagggcccgagggttgggggcaagggtgggcatgaaggaccttggctctcacttccctcctccttccatcccaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagag

SEQ ID NO: 85154 - DNA, 1352 bp, Homo sapiens
cagcaaacttattctactctctttacccagaaataggtcagactcaactacatccatatctgatttcttcctttgtttttttttttttttgtatgtttagtagagacagggtttgaccatgttggccaggctggtctagaactcctgatctcaggtgatccacccacctgggcctcccaaagtgctgggattacaggtgtgagccacggcgcctggccccccaacagcattttagagatgaggaaatgagactcagagaggagtctgatggctatagtaagaaatgaggagtcaagctccttagtgtgcgctacaaaaaccctgcacacctgactgtgtttgcagctccctgccacccattcccatcctaccctcccttgccaaacagatacacttgctttctccaaaatatgccctctcatctccaagtttttgctcctgatgttcccccagctagaatacccctaggatgtcctactgaattctgagtcaaactttaagactcaaagtatgggccaggcatggtggcgcatgcctataatcccatcactttgggaggccaaggcaggaggatcacttgagaccagaagtccgagaccagcctgggcaacacagtgagactccatccctaaaataaaacacacacacacacacaaaaattaccggagcatggtggtgcatgcctgtagtcccagctactcaggaggctgaggcaggaggatggcttgagcccacaaggttgaggctgcagtgagctacgactgcaccactacagtctagtcttggcaacagtgagaccgcctctcaaaaaaaaaaacaaaaaaagactcaaagtgtgctccactgttccttcagtgaggcatcgggggctgtgtcctaaatgtctttgtatctccagcccttcacattagggcctggcaaggtaagagaccaataaatatgtaccctttggcttcatttcactaagtcattagggtccagaggtatggtcagcacttggaaccctgtggaatggcctcaagatcagagtcctcttgcccaattcttggctgggaagtaggtgacatctagaatccatgagggtatgggtgatctcctgggttccagacatttgcattgagtttattcaatcacttaacaatatatattaggtctgggctgggcacgctggctcacgcctgtaataatcccagcactttgggaggccaaggcaggcggatcatctgaggtcggaagttcgagactcacctgaccaacatggagaaactccatctctactaaaaatacaaaattagctgggtgtggtggtgcatgcctgtaatccagctacttgggaggttggggcaggagaa

SEQ ID NO: 85155 - DNA, 1089 bp, Homo sapiens
ctctcttcccccaggttggctgaaggggcttcctggggccttccctgcccagctggtgtgtgaagtcacaggggaacacgaaaggaggaggcaccttcgccagaaccagaggcttctcgaggctgttggatcttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagct

SEQ ID NO: 85156 - DNA, 1172 bp, Homo sapiens
gtatttttagtagagaaggggtttcaccgtgttggccagactggtctcaaactcctgacctcaggtgatccgcctgcctctgcctcccaaagtgctgggattgggggcatgaaccaccgcacccagcctgaagttactttggaaacaaatatatttgtatatgacagcttgtaaaactgtagtgagaagagcagaatcatatatttctcagtgaaaaagaaacaaatcttataatgaagcacagaagaggctttaagaattactgataccatcttgccttttctcctttgttggtaggaaattagtaaataagccaggtttgatggctaaagagtgatttctggagttttttaaaagttaaaatcttttcttattaggcatccacctaccccaggtttgggaaatggtattgaatgttgggctttcccttgtgttttagtgattatttaaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagagcctgtgttttgtgtgtggtgatttaggacactccctagttttcagtggatcagtctcttacctctgatttgttggtctaaaatttttctgaaatcaggactgatgagattttttttatagtgggcagcagcatttgaggatatatcagaagctggaggggtgtcattgagaagaagaaggcctacaagaaaagctagttggaaacacttcctcttgaacctgtcttttaacttgcttactatggataggttgctatatggacaggctatattttttaccttactgcgtaaaagtttgtattgccattggataggaagtcttgctttcaataggataagaagcttctgtgactttatagcttctagatgacttcttcaagctgttcctccagattgagaggtctcgggttcaggttatctgatagacccatgggccccctttaccttgttttctgcacaagtgctggatgagtgccatcaaaccaaaacctaacacgtctttgagttaaaatataa

SEQ ID NO: 85157 - DNA, 1831 bp, Homo sapiens
agctcgttaaagtaccggcacgctggccgcgcccacgccacgggcgggaggggacggtgagtgcagggacccaggcgaccggccggccggcgtccccgcgcctcctggcggccagaagcagggcctgcgcttccccggctaaggggtgccggcccccgccccggcacctgggagtgaaggtaccagcgggtctcctgggcggtctcctggggccgctcgttccttcatcacccccaggggcagttggaccctgagcagccttagccaatagccccgggactacccttcccagaggattcagcggcagcacccgggtctcggaagggagacactaggacctggaggaggggagttttgcaatccctcgcagttcccctcctagccactaggtgacactagccataaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccaggttcgggttggtgggccttattcattttggcggggctatacgtattcactcttaagcctgtagaagatgaacgttgattgtaccttctaaaacgtgaggttatagttaagagaattgcgttgtcggtctgctcagcagagatgtaagtccagtcttgatttcctcaggcactacttgaggagttgggagagtgtaactaaaaggtcttataactaggacaagtgtttttgatgcaaaagtctttagtccgtaaacatatacagaaaacacccgaataaaacaaaaaataaaaagtttcgagcttcggttgataggcccttccgatcaaacagtttttgttgaagttgcacaacatgacactgcctatgatcattctagactatcaagataaaatcattgcggttatttgtttggaagctggatgagattttggtcatttaagagtctttttaactttttatttagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggtgtgtatccctacttgttctcgttgtcttgatggatattttacgcacttagcttagaagagagattgcattcctgagaaagatgcttctgagactcttgctcccaaagagtggcaagatgagttgagccagggaccaaaaaacagtaagtaagctgcttttcagtttttaattgtattatttggtgaaaatcttttttttttttttttttgagatgaagtctcgctcttgtcccccccaggctggagtgcagtggtgccat

SEQ ID NO: 85158 - DNA, 1033 bp, Homo sapiens
ggagcgcctgcgcaagaggacgcctgcgcaagaggacgccgtcagcttggcgtcagcgcgccgggctctggcccgccccctgtgacaccagccccgccccaccccgccccgcatacccgtgcgctgccgcgcatgctccgagccccgcccccgtgcgtcacagaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggtgagcctgcagcgcggggccgctccctaaggggctgcgctgggccggcggcgccgaggcctgcccttggggagccttcccggcccggggccgtgtctgaggctccgccggggcgggccgggccgggttccggggcggccagcctgggggcaactgttccaaccgctctaactgtcccctcccttccctggtccgatgtgtggccccccaggggcgcctgcaagggaacgattccggtggcctccggaagatgtgccccgttccgggtagggtgagggctggcggtgacggaggccgggacgtggcaccgtgggctggggcgctggcggcgcaaggagtggcccagtcggaggtggcagcggcgcgcccagcccgcctcctcctaccccctcttcgaaattccttcatttgcgagggtggcttggagcggggttgcattttgatctctcagtgcctctctcccatggggggcgagagcgcgagcagcccacgttgggctcggattggcattctcctgactcccgcccggaactgctaatcatcctccccctggagttcggcaaagtgtcaccaacgggctcgggttacttgtgctcgactcttttcttgctgtaagccatgagatgaccctttaagttttgcaaaggaggtgagagttctgtcaccactgattattaccttctattt

SEQ ID NO: 85159 - DNA, 1040 bp, Homo sapiens
ggcctcccaaagtgctgggattacaggtgtgagccactgtgcccggcctttttttttttcttttatttgagatggaatctcacccttttgcccaggctggagtgcagtggccaatctcggctcactgcaacctcctcctcccgggtttgagcgattctcctgcctcagcctcctgagtagctgggattacaggtgccggccaccatacccagctaatttttttttttttttttcatattttcggtatagacgaggtttcaccatgttggccaggctggtcttgaactcctaacctcaagtgatccgcctgcctcagcctcccaaagtgctaggattataggcatgagccaccgcgcctggcctgctttgttcgcctgctttgttcttaatgtggctcataaaggctattccaaaaaagaagttttggaaatgtttttcagcaatggtgatatcactggaatatgcatatattcctgaaatgatcagttttaaagaatcatttgcatgttttaaattttgaagcctgtttactttgtggtcatacttgaaaggtctgctatcgaactaccaatttttaatagcttgatgaacatttaggtttttactatgtgccaggttctgtcctaagtactttacaaatattagctcacttcataagctcattctaatgattatccccattttacaggtgaggaaatggggcactgagtcattaagtcacttgcccaaggtcacccaagtagtgagtagatgcatcagtagcgagtctgaacttccaggtctgacttcagacttgggcagtttggcttcccggtctgggctcttaaccactatgctatgctgctcctatgacttattcttggttaaatgttttaaattgttttgatctggaagagatgatggtccttttagtaaatgatatccaacataggttataatactgttagaggggccaataagcgggttatgaaaatagcctattgattagaaaagttgtggtcaacattcaattcacatgagattcagcaagaaaataaaga

SEQ ID NO: 85160 - DNA, 1048 bp, Homo sapiens
cctttaccatctactgtagccacatgcttgagggtatttagtgtctggggagtgggtgggttctgggaaggttggatgggcaggtgaaaggtagggaatgtgaactctgtgcttaccctgggccgcatttagcctgaaaatccagaggtttccttaacaagtttgcggattttgaggcaaggattttttatattagttcttttcagagagattgttattgggtttctttctgagaggagaatggttgacaaaatttaacatgagtttaggcacttagaatgaatgtgtcatttagttgtttttaaagtaattgttacaagagtgtgggtaaattccttgggttcccccccacccttttaacttgagttacctctttagtaaagagaactgtatattaatgacatgtactttcctatactgatgccctcaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaaggtaaacgaatgactgcattttgttagaaaaaaaccaccttggtaattagtgattaaaatctttattaggctcttcccctagatcttagtcccagaacatttcctgttggtgtttcatgtcacctgtaactcatcggacggaagggaaccccaaatcctcatctcccagataacgcccttcaaagctttctctttcaatttttcttttttccttctttcatatactgtggttgatcctattggttttgttttgttttttgagacagggtctcacattgtcgcccagtctggagtgcagtggcatgatctcggctcactgcaacctctgcctcccagattcaagcgattcttgtgcctcagccttccaagtagctgggattataggcatgtgccaccacacccagctaatttttgtatttttagtagagacggggttttgccatgttggccaggctggtcttgaattcctg

SEQ ID NO: 85161 - DNA, 1088 bp, Homo sapiens
agaaagggtgaacatccagaatgtatagagttcttacaaattgattacaggaaagacaaaccagtagagaaatgtacaaagactaaacagctgattttcagaagagattcaaatgactagttactatggaaatagaaactaaaaaacgtgactatcaaattgtcaaaaaaaaaaaagataatatctaatattatcaagggcaccaccgcatagattgctgatattagcacaggctttttagagagcattttggcagtgtctgttaaggtgaaaaaaatgggcatatgttctgacccagcagttctatttttaggaatctcttttccagaaatacttgtctagatgtttaagagtatatgtccttgtagcattacttataatggcgaaaaatttgatataatgtaaatatccaccaattggacagtggtttagcctatttatggtatctatactttatccatagtttgaagtagtttgttgatattgtattgagtgttacactactttgtaacatcaacaacaaaacccaaatgtaaagggaactgcaagtgtaatcactcagcttttatttttctctagctataccaaatggttttggtaccagtccactaactccctctgctaggatatcagcactaaacatcgtgggggatctcttacggaaagtaggggtaagtttcaattatttatcactaggtgtttccactgacaaggtattgaattatttcttaatttgaagtgagggaagaaagaaaggatactttcctgtggtaaaggctgtcatgaagctcagaagcaaaagcatccattgactagccaagtccagatgacacttcatgatgcccctgcagaagagcctgtaccttgaactctgaggttcccaccggggcattcttcctgttccccactcctgtttcaacagcacgatgcctctgtccttgtctagaatactttgtctaaggcctgctgtgtgtcttctaccaccctcatcctggtctttgctgctgtctaccgtcttcctggtcattcctttgttttgtgtttgtgggactttaacatttggctcatggcattactctctactttta

SEQ ID NO: 85162 - DNA, 1052 bp, Homo sapiens
gatgagtaagttttgaggcttgaaatagaaatggtttgaaatgcaaatttttatgtgcagctactgttttgacaaccatatcattcctccttcttttttgtaggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggtaagtcctgaatgttttaagtgataattttttgagtagtaaagtgacaggttagtaagtgagcataatgaagccttgaaaaggtaaactcagcttgacaaaccttcccgaagcctgttatcattctaatcttaggtgacatgacgtctgttgttgtcctctagtccccatggagtctgttgccccaggaaccctgaatctgaggcttctgtcctgggaagcagactcttgaaaggcagcagtgtgaggctctggtgagtcaaaatgactgcgataaggtccctgttctccaggtgcttacaggctggcagacttggaaatatttttttggggtagaagacagcatcacaattaaatatatgcaaactctacaacagacatcccctgtgagaattttagagaaatataaagccctgaagtacttaggcactggatcaaatacagtttaggagatacaacttttgtataaagttaaggcttttttgaagattgaaataaaattgttttaaggttgaagcatccttaatgcaaaaaatttcagttagtatggaagtatatgaactaaaaagtcatggtttcctgccttcacactgtttctgcattccttacagttattccaaggcatgccaaatcatatttttatgcatctgctctaagttgtttgtaacacagttacgggattatactttaaatattgctttgcagtgtgcctatcatgacttctattgccattatctttccatgtcatgtatattattctacctcaatttacttatttatttttaaatactacatgg

SEQ ID NO: 85163 - DNA, 1032 bp, Homo sapiens
ggctcaagtgatcctcctgcctcagcctcccaaagtgctgggcttgccgccgcgcccagctgaaatcagaactttattctaaccattgggtttcctcgggtggagtaaacataaaattgattttcctcaggcttaggagtttcaggcagacttgcggcagcccttgtttttatagtggaatgataaatggaatgactggatggttttacatgagcgtagccatttcccctgaatgatatggagaacttttagggtagtcttcataaatgttggaagcagtgcctaattatttttccctacaacttataatgatcctctactagagtagttattagtttctccttggaatcgtatttcttgatgggccgcaggtgcctttcatgagagcaggtgtgaatcataaatggataggtcggacaggtgcctgtgcgtgtggaagccctgaagaacagtcacgaggagggaaggataacactgtctgttcagggtcgctactcctgcccgccacttgcctcccaagacagagcaccagggcagggattgccaagaggtgagcctgttctgagggagatgtggggaccttagggtgagctgaagccaggaacaggccttgggcacactgactgcacctctgccccttgagagcatccgagatgtaagtgtaggctttacttcctgagctgaacccggaaatgtgctgtgcttcccaatcggaacagttgcagatactgagttttggttttaaatggtagacattttacattgtgccttttctattaagaaatatgcttttgtgggctggctgttgtgtgagtgtttagcttatatgataagtggattgtgtatgcgcactgaaatattaacctactgttgctggagttgtctttctagttgctgtattcctgaggataactcttttgtgggttttgctgtgttttcactttcttgccgctttgcttcgattccggcttttggcctgtctggctttttacctctggcttttcttctgccaacctgttgaccagataaaaa

SEQ ID NO: 85164 - DNA, 3655 bp, Homo sapiens
gggtgtacatgtgttcaccttcccacccgctgaaacttcagatgcagtgaagccttctcacataaaacaatataccttaactgggcgtattgctctgtgggattcaaaagtattttgtaaattctggtcacttgagggcttcttggaatcaggtttttgtctagtctgtgagcacttctgccagttcctgaaacatgggctgccgtgcctgcttcccaggtgccgagctgtttccttcaaccatggtcaccctttgtctcaccatctgaaaggacacacatttcatgtggagtgtggtcgcttggagtctctcaaaaacactcttttttttcccataactttatgtagtttcttaggtaacatgtgctctatttttgtaagccactctgagttcttttgggctgtgtgtaggtgggcatggactaattttagggcgtgatgtggaaatagtattcgtattactgtttaatatgttctcctttcttttattaggcaagaaaaagtcatatttcccacgttgttcatgggtaactgaatttgtttgctgtgctctttttcattctttcttaatcctggtgtgtggtggaagacacattaacaatctggttttactaactgcatggggctgactcagctttaaccaacttacagcccatcagtgaactttcacggtcctgttcgacttgactgtatgccgttattagttcagctgtgagaaacaagaacaaattagttgcagtggtcctggggtggctgggagtagcatgccaggtggcacgcctgagatgggctagggcgctgtagtgttgatttcagagtctggcgatgggggtttgaggtcactgtcaggccctgggatcacctttgactgtcttcctgggactgggggtcttcccgttacccagttgcttctgttttctcaagtcaggcaccagtgtgagcattccctcacctctgcgctcacgcatggagtccccagttaaaatggaatggtacatggggacgtgtgtaagatctgccttacatttcagaactgctttgcagtttgcagagcctgggctgagaactggagcaggctggagctgctctgagcccacactcatccactgaaataggagactcaggtgtggcgtgtgcctgcctgcaggctcttctggatagcttgagcccaccctcctgccctctccagtgtcctgatccttgctgctttgacagagttaatgtttccatccttcatctcagctgctttggatttattgtcctgagtagcttctaagtgtgccttggctcttcccccttttcacttcttccactgacattttacaactgaccttagcactttttcttagctggattctctatatttcagcctccttaactagtctgtggtggtaagatcatgaaattttatagctctggaaccttttttttacatatatgattcccagatctgtatcttcaagcctgccccatcactcttccttcagtcctgtcttgtgcactgggacattgccctgtggctctttgctgctccctgaaactgaatctgttgaatatagagtctcttctcttgcaaatcttttccccatgcacagctttgcaggcctctgaaggacttcactagacctgtcatcccatctagaaggccagctttcttctctctctgttctttaactttctactttttgagtcaggagagaggcgctaggtgagaccctggtggattgatgttccctctctactccacccaccttcacattaagcgttccatttctgcccatgtagaaatttaccggttctctctttatagtctgggctgcaccacttacttttcccattagagccggcctgcattggagtgccgaagtggttgcttctgagggctgctaggtggcctctgaccaggaggagactagaaaagggtcctggcctgggcatctggaggcagctgtggccccgacttccccatcagtggctcactaggtgagcctaggctaatggctggaccttctcttgctttggttgtcttggcagtggaacagtgggatgaacctgttgttccttacggtgcacttgaaaatgccagaatcccatcctcaacctgcttgaggagccatctcctagttgctgcttttgtacacccccgtggcccaggtgccagattcttcttggcatccaatggtgctccctttctgctgggttccgggcactgtctgcagtacaggtttaggggcttgcctgccactgtgatgtgtgaggccaggaatctgaggttcacacgtgctgagagctgcaggcatttgtggggcctgcctggttgtccctgaggtttctaggagaagcaggtgtcagggactctgggactagccagacagatggagcctattatatgagggctaccgtggcaaataggatatggccttggccccagaagaggcacaggcctgtgaccttgggagagtgggaaggatgatttcaaacttgcaaatgtgttgaagctcaaaaatcagacctaacccagtgaggaaagagacaatctggctgtttgtcgtcgaagtaggacagtgtgcaacagggagaaatgacatttgtcagagcctttctcctggggctcttggtctctgtatgcgtggttggaatttaaactccacatatgtactctgagtttagtttctttagacatgaactttgtttcttccaagtaggcagggactatttgtcaagtctctgcatgcctgtttgtctgtgaggttatcctcaccccgtcagtgtacgaaacagctgtctctgcagggagtgtgtgtcggcattttttttttttaaggagaacctctctccatgagtctgtatttagctccctggagccgtctgatgagtaggtgggggcagtagtgggcaggtgtggtgcagtgtggccccttgtcgtagttggctttatctcccaaattgctagtgggacaaattttcctaggaagcgtttcaaggtggaaaggctgaagtggctcctgagagaggttccaggctgcacactccctccccctcttgctgcttcctgtggctgcgctgcatggtgcgtgagggggatgcttggggggctccctgcatcgctgggctctgggtgcgtgatggggacgctggggggctccctgtgtcgctgggctccgggtgctgggtcctggctgcaggctattgggttgggctgggctgtctgcacacgagtctgcgttgaaaagcctactcatctggcgttgcttgctaaacaatttttaaaaggttatttttctccaccttattaagatattcgtgtattaatacattatatttggaaaatgtaaggagatttggaaaatgattaaaaaaggataaagtagtaaacaaaattcacccacagcccagagggaagaaaagtaacgattcttaaattttctttttatgatatatatgatcctatgtacatatatgttggtgtgtgtatatatatatgtgtatgcgtatatataatgtatgtatatatacatttatttatacacactccccctctgtccctgctttgtggatttagctgcatggatagtaatgtctatctaaggggctatagtctagaatctagaatatatactatttgcttttttttctttcatatcattgaatctac

SEQ ID NO: 85165 - DNA, 1129 bp, Homo sapiens
tgccccttgggccatcaggaccctacagcctgcgaggaatagttttagaaagcagattaatttcctattgtgtgtgagtgattttaaatgagtttttcgtttcccctttcttcccttctgtgctctggttgctcccacagggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactct

SEQ ID NO: 85166 - DNA, 1047 bp, Homo sapiens
tttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaatctgttttctcaccttctgttctcgatttcccatctgtgatctgactggagggtgggtgctacacaccaacttcaaatgatggcgccaggccctttttgctgagggcgctgtctcccaggtcagacgacagaataattctcaggccagtcctggctccaactcttgttcctgccagtgcctcacaggatgcacacgcactaggaagggaaagaccacccaaaggcaggagctggcccacctgtcaagggagtgatttaggagggctctggtcaccagccaatgaagctcactgctgggttaggacattttcaggggtccaggacatttcaggctgcattttcaggcagac

SEQ ID NO: 85167 - DNA, 1038 bp, Homo sapiens
cgtggtggtgcatgccttgtaatcccagctactcaggaggctgaggcaggagaattgcttgaacccaggaggcggaggttgcagcgagcagagatggcgccactgcaccccagcctgggcgacagagcaagactgcatctcaaaaacaaacaaagtaagataactgagtacaatgatgaatacctgtgtacagtaattaacacctacacgtgcaggaataatgcacttattctacctgtcactattgaggaatacattaaaggcaattctgattttgaccagaaggaaaggtttcagcacattagtcatgaattctggacagagaggtccataatgcctccaccatgtgtcatcttcccaaagaaaaggggctttaaaaaatattttttcccacacaaaataccatttcaagaatttcaaaactactgtgaccactttcacagggaacgagcagccgccaacaaattagtccgtcgcactgagaagaagctgaaagaaatcttcatgcaggttgaggatgagcgtcgacacgcggaccagtataaagagcaggtacgcgaggaagtgcctccctgggaagcgcgtgagcaaaggaactggtggagaatgagctggtggcacaactgaccagtggaattcagggccctcccgattctgatgtttcagctaacgtgggctgttccatgttcctggtgggcactcccagtacccgagacacaggagggcggggagagcaggtcaggaagcaagttcagtgaggcctggactgaactgtaaagctcctgcttcctccactagaatgtgtgcttcgtgagtacagggatttctgcctgttttgctccctgttatctccctaatgcctagtatagtttctggatattgctggcagtcatgagatactggctgggtgtagggtgggcacaggagatactgaatagaaagtgaagggaagacaaaggtactgcacgctgcacccgagtgagcttcagcgtctgcatccaggcccccttttctaagtacacagggaatgttccgcag

SEQ ID NO: 85168 - DNA, 1078 bp, Homo sapiens
cagtttctgcctggttctgacacccctgcaacatggccatgccccatgtcctcacagctctaggaaacaggaatgcctgcttagtcctctgtacctcttagcaaccaccccatgcccgctctgtgcctaccccagcctttattacatggttaccgtattgtcttgggtttttccatcttggcttcatctacaccgagctcaggtcactggctgccttctcgcatgccctcgtagcagtcagtgggatggtttgtactaggtggtggtgtttaaagacccctttgaacaaaattcagctactgtggttttctgttgatagtaactgtttggtaacagagacctctacagagtaacagaagtttccactcacccgagtaaccagagccccccacttgagaacagtctgcctgttctgcgagcagatacttggatgtaacccagcataacccgatgttgtccattaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggtatgtgccttcacccatggagtctctggatggcaccacgtgacctatgtggcttttacacagagtccagcagtgaagctggggggcacagcaccgctgtcagcgtggccgggggtggggcagcaggccataaagagagtgcttgtgtgtccgctgtgtccacaggagatacttgaatgcacttagcaacacagttggggtggaggcatcatgctggcctcctgtggccctgagagcctgtggcgatgcttaaaacccacccttcctcacctcgagaggagggtcatgttgacccagccccttagtgctgtagcttttgtgatctttttggtctgttttaatcgtcactttttctacccagatgatgtgccagttttcattaccacaatgacaagaagtgatctctgcaagagttcatggtgtgagcaggcaggcagggggccctcacctat

SEQ ID NO: 85169 - DNA, 3511 bp, Homo sapiens
aacatgtttgtgcttacattttagaagtcaatctggcaggaaatacaaaggacgataactgagggatgcctaagacgggagaggtgatcctagttcgaagggctgagggcctgaactaagacggggcagggggtggagaggaagggattccaggcgtgactgaggagaggcggggtgtggtgggggacgcaggaggggaggcctcggggatgcctggaggctccagcctgggcccctgggtggatggcgccgccattcgtttttcagagatgagtctgaagcagtgttggtgtgaagagcttttacaaagttatcgtgtgtgtttttaaatcatctgtgtttgttaatgtcactgggcgttctcatgcattgaggctgtctcttttgtacgacatgaattctttaatacaggtgtatttgttttggtgataaatgtaatggaagtgttgccctttaaaaaaaaaacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccaggtgtgcgtcctctttaggaggccgcggtggcctcgatgtgtgccttcagcagatcctggccctgctgtgctgggctgtctcagctccatttgggacagttaattaggtcgtactaaattaagcccattaaatggtttttcttgacccagccacatgctggttataatgctggaagcccttaaaataaggacctaggactgtgtcaacgatgtaagatttcaatccagtcatcattttatggactattagctaagaaattaagtgacagtctaagactcatttgttttaaaatcacagtattgatttttcttctctcaaaatattaaaaacaaaaggttttttttttcttcaaaggcaaaaaccaattgagttcttttttttttttccttgagatagagtctcactttgtcgcccaggctggagtgcagtggcgtgatctcagctcactgcagcctccacctcctgggctcaagtgatcctcccacctgagcctccccagtagccgagactacagacaggcgatttttgtatttttagtagagatgaggtttcactatgttggcctggctggtctcaaactcctgacctcaagtgatcctgccgcctcggcctcccaaagtgctgggattacaggcgtgagccaccatgcctggccccaattgagtacattaatactgagctttctgtttgtccgtacacaaaacctagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccaggtgggtcggccacgtgtcgtttcctcctggcagagctcttgcttttgttcgtttggtttaaaataatcttatttaaaggcatttaaatgtgatacatgtttatatcaaaattggaaaaagggaaagcaaaaaaaaaaaaaaaaaggaaatacaagaacaccataatctagtggcagcactctagcgataaatcagccacatggtggaagagaaaagttgatgtcactgtttcggtttttcgtattcccccatccccttctgcacagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgtaagtcgcctggtgggctccacacttccgcacgggagagtatcccaggggcctgggccttcacacaggagcgggcgactcctcaggggagcctgaaggacctgggaatgcacagcccagcagcaaagccatctaggagtgttttggcctgtgcatgcgtacggggttcaggtcttctgggactgctgtgaggttttctgcagtcttcccccagcactggctggaggtgaacatgtttcttcttgtcctttcactgccctccctgctccagcctgcatcctggcaggagggcctttcaacaaaaggtttcatggttctgccgtcacaggtagttatcaaacatgaggtgagtggggacctggagaggaggaggagggaatggcagctccctctgacctggttcttcccagggaggccccactgttttctttgagagcttcagtagctttgggggcttatccacagcttggaagcttctgtggcacagtttttctttccattgcatacatcttccacaagagctgccatgatatttatttaccctacgtctctcccttagtgtatgacgtgttgaagatagcaaaacaaacccaggcctggtatcaaaggcaaggttccctggctcctccacaggcttccattctgaccatgggaagccacttaagcttttgaagcctaagtttccttatctgccagatggacattatacttgcccaatttcatgaagttactgcatctgctttgaaaagcacacaaagtcctctaaaaaggcaggatctcattttcatgtgctatgggccatctggccacatcataagtcagcgaaggtggtcccacctttctgctgggtctcctacaacttggcgcccagggactagccccatggacaaaaagaggccactgaaagtagaagtggccatggttacacagtgaaatgtggagagagaactctacagttgatttcatgttcgttttctgtagcatcaacactcacatgttgatcccacaaacaggtcttttgtgcctactgagcaccagacactgtagaaatggaccttcctcctgtcctaggattccccgcgcctgtccccgtgagaactgcagtggtcctggaccccagagggggtgcacagcagcaccaaggcctccctccaaaggctgctgtgagggtcaaagggcacaggaggtggagctctcagcacagtgcttggcgcagagaatgagggaaatggtgctgggggcatctttgtccagagaaagatcaaggcctgtgtactgtgccctgcttcttaggcccaagccaccctaataatcagcagtttccacatgtgcttttcaatacgaatgatcttctctacagcaagaagagatgtactgttgtacttgttcctcacagacagcaggcaaggagtcagtcaacagacaggttccctgacatggctgtttcctttg

SEQ ID NO: 85170 - DNA, 1027 bp, Homo sapiens
accagactacccagaacaatttgaagacccctagggatgtcaccctgtgtcttgataagccagacatggcatggaagttgcactggttgtttgtttttttggtttttttttaaagatagggtctcactcgcccaggctggcgtgcagtggcgcaatcatagctcattgtagcctcaacctcccaggctcaagcgatccaccttagcctcccaaattgccggggttataggcatgaaccactactcagctctctaggaggatttctgatatcacagtaatagacctgccagcctactggaaatagcacatcaagtatttattaagggaatttatgtaatatttaaaacaaaaacagtactttttcaaaaagaaaatgtgtttttaatcagtcagctaattctgatctctcttaaaaaatgtccttctctagtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcgggtaagggaggccctgccgtgtgctgtggcctggagaaagtctgtcgtcagagccactcccatcctatctgcccgttctgttcagtcatgtattgattaggctccagcctctgtacgtcactgagtgggctgctgggtacccagttgccaagacaggagcggctttcagaaaacacactgtctccttaggaagaaaagccagatgcaagtgcatggatccagccaccatctcaaaccacacagtcctccccagtgtctcttctcactaaacccttctcccagtggcttcactcaaaaccccgaatggtttgaaagtcattcttccctaacttgtctgctgccagtaagtcacacgtcctgccgatgttccccttcaggggttcctgacattcatctctcccttcttgtccttccctgcctgtgatctcacctcagccaccaaacacagtgttg

SEQ ID NO: 85171 - DNA, 1061 bp, Homo sapiens
ttccggtgtgatgaggaggtcactccttcatagttagaagcagatttttaactataacagcctttgacttcagagaaaatgttttcatattctaagggctaaagtaagagtgtcctaccttttaatggagaagcatggtcgtttggaaagggggctggggctggaatctagttctggctctgccaccattagctttggggccttcagcaaggcctctacctgagaacctcctcctgccctagcaggtgctgagcatctgcaccagcctcaggccccaggaggagggatgtggggctggggtctcgtggagaggtgctcaggggctggggctcgcctgagaaacaggccatccgggtgccatctctgagtgcctcttgcgcctgggtgttttaacagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacggtgagtgtgggagaggaagcagggcccgggcgcctgccgacctctccaccgagcccgtgcagaaatgcctggtgtgcttgctatctttgggaggtggtgtgcttttccttgtgatggcaggtggaacggtgattaaatggtaatggttagaaacagaccagcctatgggtagaaatacctgtgcaggggtgggtgggtaaaccagcagactgagggacacagagggagatggatgtgatcggaaaagctgtggtcagtgatggatatctagggggagagagtgacaactacacagagcagggggcagtgaaaagagatttagatagataggaccagagggagaagggtaaacacaggaataggaggagatacccaggaggccaggcacacatgctggcagtgctaggtggtgtgaacggtgtaggtaaccagctgaaaagggaagggtgcct

SEQ ID NO: 85172 - DNA, 1159 bp, Homo sapiens
ttagaggggagggtggagaaaaggcctggccctctctgcccactcttctgtctcctctctcccagtactcgaggatggcagttttcttggttcagaacaggggttcccatggaaaagggaatggggtgacaggcagctacgattgctgccccagcacctgctgagccactttgcaaacctgggtacagtgatgtgtttgacatgagaggattccagctcccttcggctctcacagtgtggtctcacctcccatgaaaggacattcttaggacactcaacttcttccttaaaattccctccccacactaatttatctcccctccagatctcggtgggtttgaaatgactgagcagttgacatcagcgcatgaccatgtcatcagggcagtgacatgcttttgaataaaatggcttattttcaacttggatcagtctgtattttagtttattcctgtggtgagtcactcggtgtgttgaagagcttcttatgtcttaccttaaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccaggtctgcagcccagcagctgcgctgcacgggagcccatggggctgagtttcagcagactttgttatgttcgggagcattcaaaaaccctgggagagtgagatggggtttgcttgctgtttggtgtgacctgagaaagtgaaaagcccaggcgtacagaatttgtgtcaggacagcaagaaagtctcataaaccatctcaatatttatactttaaaatgacaaattatattatgaaacccttggaaattcacaccagaacaaattatttcactataacaaatgttttggtctctgtacattacagattaactgtagtatgttttatttattttttttttttgaatggagtctcactctgtcacccaggctggagtgcagtggtgcaatctcagctcactgcaaactccacttcctgggttcaagcaattctcgtgcctcagcctcccgactagctgggattacacgtgtgcaccaccacactggct

SEQ ID NO: 85173 - DNA, 1050 bp, Homo sapiens
accaaacagcaagcaaaccccatctcactctcccagggtttttgaatgctcccgaacataacaaagtctgctgaaactcagccccatgggctcccgtgcagcgcagctgctgggctgcagacctggccagtgcgccctgcagctcctcctccttcttggccagctgcagcttgagctcatcaatctgcgcctgcagctctgcgatctggtcctgcaggtcggtcgtctccccgtcgagttttcttttggccttttccagttcctgacgagtcttttcttccttctttaagcgttctttaaggtaagacataagaagctcttcaacacaccgagtgactcaccacaggaataaactaaaatacagactgatccaagttgaaaataagccattttattcaaaagcatgtcactgccctgatgacatggtcatgcgctgatgtcaactgctcagtcatttcaaacccaccgagatctggaggggagataaattagtgtggggagggaattttaaggaagaagttgagtgtcctaagaatgtcctttcatgggaggtgagaccacactgtgagagccgaagggagctggaatcctctcatgtcaaacacatcactgtacccaggtttgcaaagtggctcagcaggtgctggggcagcaatcgtagctgcctgtcaccccattcccttttccatgggaacccctgttctgaaccaagaaaactgccatcctcgagtactgggagagaggagacagaagagtgggcagagagggccaggccttttctccaccctcccctctaaaattctgcagtgatctctcagttagccctagtgatctatttcactgaatgatttatttcctcacaacaacctgtatgcctttgtgttctccaccaggaaccaatttgctgagaggatgagaccgagtgtcacaggctgatcaaacaggtgagtaaaaaagcacatgtgcttatgggtacttcctcagcagaagaaccatatactagtacaaatggtttatgaaagtaatttcatactgacatgccctcttttg

SEQ ID NO: 85174 - DNA, 1065 bp, Homo sapiens
taaaatggcacacctctattgggcactcaccatgaacggagcttgcaggactggaagctgctctgggtgagtcagtgagtgagcgctgagtgaatgtgaaggcctaggacattgctgtacatgactgcagactttatcaacatggcacactgaggctgcagtacatttattttaaaaatagagtaattgcactgtggtgttatgacagctctcgatgaagttttcagctccatgatcatcttaggagaccactgtcgtgtatccggttcatcattgtccaaaacatcgttctgcagcatgtgattgtgtacagtctgctgggggaggcagtgccgatagaacttattttctctcgagtcaaagttgacctttatgaggaatacagaacccaagtggtcattctgaatggcttttctgaagcagtcaatttttcctgtccaggaaaagaaactcatggaagatcgcattgctgagtgttcctctcagctggctgaagaggaagaaaaggcgaaaaacttggccaaaatcaggaataagcaagaagtgatgatctcagatttagaaggttagtatttggggctagagaaatcagggactaggacatgtgagtgtttagcttttactgtaatcagaacatgcaaaaataaaaaatatacatgatgattactaataataaggaccttcagtttgggttgacttattaaaataggtcccttggctgggcacggtgtctcaggcctgtaatcctagcactttgggaggctgaggcaggaggatctcatgaggccaggagtttaagaccagcctgggcagcatagtgagactccatctctacaaaaaatttacaaattagcctggcgtagtggtgcacatctatagtcccagctacttggaagctgaggcagaaggattgcttgcgcccaggagctcaccagagtgagctgtgatcgtggggtgacagaggcagcagaattgcttgtgcccaggagctcactgtagtgagctatgatcatgcaaccgcactacagcctgggtaacacagcgagaccctgtatttaaaacata

SEQ ID NO: 85175 - DNA, 1477 bp, Homo sapiens
gttccagatagaatcaccttgagaagcttttccagtccatgtgtgtcttgaggaaagccatcattctgatcccattgtatgatgaagtctggtagattttcattttttattgttaggagaaaaagggagtataattggcatccaagatacaaagttgattgatgtagccaggattcctcctttaatatatagccagtatcttttatttttctgattgaggtatagactgtatacagtgaggtacacagattttaaatgtgcagctcagtgaacatatgtatgtgtatacacccagaccaacgtcatgtcacatgtcaccctgatattttctgatgttttgaatagaagcctatgaacacagctcttacagcccttcctgttatctaataaatgctacaaattgacagtgacttaaagtacagaaagccagattctcttttgcgtcttaaggatatgaacattttatgggacatgaagaaaaatgaaaggtttctaaaacaccatgcttttgatttttctctgccacaacctcctaaacctactttttgacctgaaagaactaacctcatttttacttatgagaaataaagtagatctacagaaaacatcagattatcaccagttcatttcttgaacatgtattacatcatatctttaacatgtattacccaacattttattgcctcttagagcaaaacacacagttagtagatacacatcgttcacaaatttctacaaaatacttcttggaatattctcttacagatatgagatcctaactccaaatgctattcctaaaggttttatggatggtaaacaggcctgtgaacgaatggtaaggttttcttgatctttttctggcttgtagatttaatctaatctttcttgtagttaaaaaaagtaaataaactctttctctcttagatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaagtgagtgggtattcacgaattaatcgttcactgaggaagtgcttgtgctagataagcattgcattttgacctggggtgcaagagtgtgtgagacatagtctgtccttacagaagttgctttatagtggcagagatagtcaggtaaatacatgaacattctaagtaatgggatgttgcaatacaaaaacacacaaggaggctgggcgtggtggctcaggcctgtaatcccagcactttgggaggctgaagtgggcagatcacttgagctcaggagttcgagaccagccagggcttcatggcaaaaccccatctctactaaaaatacaaaaattagccaggcttggtagcatgcgcctgtagtcccagctacctgtgggagctgaggcgggagg

SEQ ID NO: 85176 - DNA, 1587 bp, Homo sapiens
ctgtcaaaggaaacaaatgaaagaaatgaggtgtccattagggttgaggagggcattaaaaagggcagttcagttgataattctgattgattttaaagtatttgagtaatgtgtttcattcatttaacttcttttcaataagaggatatgtacattatgcaccaaatgttttgcttgtggctggtgtactgtttatggtctcatcattagaagtactaggtctttgtggataatgtaaaactatcggttgctgtaacaagggaatgtctgacaagtttagccattgaacacctaggaagcttagtcatttatcttttcagaagagtccttcctattttgtgttcttgccctttagtaagtgttattcatgttttgagaagagaactgaagcttacacattgctaaaaatctgaactcctgtaatctaatcttcctgcatttgttcctaaaacttgaatgacttttctcactgaatatctaatgactaataagagagaattctggtccctagtccctgaggttatttgttaagtggatttgtacaatcagatattcttatatatatttttatgagccatttcctatttggaggcctttcacagtatcagtttgtatgtatcaataatgccagccaatgagttttcattttccaaataattgtaaatgtaacagtcagaatgttatccaagacagtgaattcctgaaactagcgcagcggaaggcatctgctggtgtgtgttggtgtggagctgtcaaagcactacagtatcctgccatataagtgtgtggctgttagttcccggcttgtgcagtgcctaagtatgctgactgccttacctatatggcatctcctgtcatttgttccacaaagcttgtgctgctgcactttcactgtgtcttttctttccctgctaacgagtgaggtttggcttatatttgttttctcctttcttctccccagtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggtacgtgctgagcaaaacatatgctagtatttaaaactgatctaggtcagatgctaaagattaaaccatgaaactattgtttgcttgattaggctggaaaattggatccacacctagtcctagatcagcttcgctgtaacggtgtcctggaagggatccgaatctgtcgccagggcttccctaaccgaatagttttccaggaattcagacagaggtattgctaacttttactttttttgcttatgtatcagagtttatcttgatatgaattaaaacagtgataaaataaggaaatctttttccttgtcccctacatagtttgttttcttatatagcaaacatatagtgaggttctggaaaagggacaatccttactaccttgattattggtaggaagattgagtgcctactttataaaaagggagtgtgcta

SEQ ID NO: 85177 - DNA, 1023 bp, Homo sapiens
atcaggattattatgactatttattagttactatatttttaaaaaaccacacacacaacactgacagcagattgtgtttaagaactgcccgtgtaggctaaagtactgcacaaccagtgtaattgatccttccagagtaacatggtgctcttcctcttttgttgtagtggtgatttgttcttctggtaaacttcgtgcaagttcacttagcagatatttattaaatagctactgtgtgcccagcaccaggcaccggccaacatctggggctgggagattgtctccgctgatggttggggggccagagacaccataggcacagctttcggggccctgagtatgtaagatgctggaaaaatgttccctggggaagctcagtccagtgagaagaagcacagaaacagtgtggaagttctgtcccagggatttgaagcctagagaagggagtggtgtatttagctttggaggcagggtgaaaaccgagcataagaagggttccctgaggtagctggtaaaggaatggagatttaaaagtatttaagcatttgccaagatgactggagcgggctgggcattccaggcagagagaaaaggatggaatgtgaagtcattgtgtctttgggaaaatgcaactagtttgtacagttggcctttaggggcatgtgtgaaagggacaagagaggtgccttcgttgaacacttgaatgtttttcaggctcacaactctgaagcgtggtctccttagctccatttcaagaggaggaaattgaggcttagagaaattgggtcacttgccccagaatcacccagctcatgagtgtggtgtgtctgactctgagtgaaggccattgctatgctgtactactgagctgagttatttggacactatccgacaggctgtgggagaaactcaaggatgttaatacttagttttgtcttttagaagtggctgctacattacacagggacaaaaggtgtaaatgaaggaaacatgtagcactacgggtagaggatgaaatggggg

SEQ ID NO: 85178 - DNA, 1016 bp, Homo sapiens
aaacgtgtggggggactggcagggtggccggggagggcgggggtagactgggggctggggtgggctttgggtttctgtttttgttttgctcataggcctgcatgaacctttcatttcatgctcagttttattatacttcaaggcaaatgtttgagtgcataagcaatttaattgctactgcctacacattgcttcttattttatgcatagcacttatagcaccgcatattaaaaggtatgccactaccttttccaatagtgccattgtgatacacagtcctctaaggaaattgttaagaactgatctgctaaatgacatctcctttgcttttgagtcacctttaaattttcaactctgaggaattccaaggaggatttttttcttgtatttaagacacattttgtagacaaataattacatagctacctcaggtgtgttggtctcatcattataccttttgtttggaatttgtgtgcctatctggctacttggccttttcttttcaaccagaggccctgaaactatctacaaggcctgatatgtgcaagttgagactaaaatagagtggaatgttgtcagaattatacattgaaccttaaattgagctccaaatgtttgggctttgtgatctgaatcctcagccctgtattacaatacagcctaactacagctacagagtctccaaaagcccaatataaaatgaagcccacccagccttccgaatgtttagtgaaactggcaagtagcgaaactcaaagataaatttatcttatgaaatttcctttatgatttttggaacatgataatgctgagatccaaatccatctcaaaagttatatttaaaatgttaaagggccatgcctattttaatccaactcaaaattcctgccatcacctctagttcacatactatgaaagaagtagactgcaagtatggagtgggaggagagaaaagattatgctagagacagcataagcaggaatgaaaattctacggaactccaaaggaagagat

SEQ ID NO: 85179 - DNA, 2017 bp, Homo sapiens
gtatataagatttggtgggcaaggatggaggtgggaggctgggatgtcatacaaattacagatcacagatgctatgtcttacaggtaggaccctgtctggagactccttacctgcacttttgtgtcttccatttaagagatacgggaaagttattgatttcattacagaaatgcttagaggaaactgtaagccttgctgagctccttcagccctggtgtgagccccattcatctgtacttagtccacagctctgactcacagatgccatgtttgcacagccctatttatggcccttgtctttccagagatatgccgttgggagtgcatttggccattcttgtcaaaataagccaagggatatcttatctaccccaggtttgctttggctctgctagcctctgctctggaatactcctacatgtttgctctcctgataatgctgctcttagcaggaggtgctgtcgctcttcagcttaggtggacagttagtttcatctgagtgacggagaagatctcagaggccactcactgttgggaggcactgttcttcagggtgaggagcaggcagagaagcagtaccatgtttgtccaattttgaggacagtttgtttcatacagaaagcagtggcaggcacagaaggttaaagagggttctaaggtggaggatttatcactgctcactctggatagagagatcgcaggataaggggagcaatttttctctagaaaaataaccctggaaaaacattattttcctctttttagagccacttaaatgcaaaagcagaaaacgacaagttgaacatgaatagatgaatatatgatatatgaatatagtttgcctgtgaaggtgcaacacctacagtatgaaacattttgtgttaaaatagagtttatggctgggcacggtggctcacgcctgtaatcccagcagtttgggaggctgaggcagaaggatcgcttgaccccaggagtttaagaccagcctgggcaacacagcgagaccctgtctcaactgaaaaaaaaaaaaagaaaaagaaaaaaagtagagtttgtgttagagttttagagttttctcaaggccaaaccaggagaaataagatttattggtggcagccctgccctagagatttataatgccctactttttgctaaaagatgttgtttgggatctctttaccagctgcaaaggacttcttggcacttcttaaagcttatattgaggaaaaaaaaaaatcctaaagattgcattttcatgtcaatgtacctcctaggatattttcatgagtaacagtatgatcaataagtataatctcgcttataattcaaaattattttaacattttgctacaacagaacttgaattttgttttccttaatggtagttatctgtcatatggtaatttgtattcaaattatttttcggaaattatatttccgaaaatctgtattagaagtaaaattaattacacagcagcgtaatttttgacagtaaaagccattgatacttacattcgccatagtgctgtgacttcactgcagtcatgccctaagctactaacgataagatatttttacgatagacaactcaaatagtgccttattcctcataaatgtcatcttgcatttacatgggctaatcatttgacattgatatcatataatgctcacaccgggagttgggaatgtgctcttttgatttagcattaatctattttataaagaactttatccaaatgtgcaaattctctaaacagtcatgtttgcatgggatctgccttggactagctccttttgtagcccgatttcaaagttgacttgtgctgtcaaatgtctttcacactaactgaagtgtttgtgtatttgctcttctgtcctgtttttgctgtttctctgctttagagattcagaatattcagagagcttctttctatgacagtgtttctggtcttcatgagccaccaggtgaatgtataaagcctgtaggtcttccaaaacagaagggttttaagccca

SEQ ID NO: 85180 - DNA, 1015 bp, Homo sapiens
ggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtaagagctcttatgttgaataactggattaaaatggctgtgtttgaaattttgctacatttttatgaaggtgtaacaaaggtgctgataaacatttataaacaaatacagtatatattacaaacatattgtctttcagacagcccattttggggactgttgtataaaagtttctggttgaggcttaaagtgtttttgtttttgcatttggttttgtgttctccatttcaccacttttggctttggtgcgggataggtggactataaggcagatgagtggctgatgaagaatatggaccccctgaatgacaacgtggccacccttttgcaccagtcatcagacagatttgtggcagagctttggaaagatggtaagaaagtgcttatctttgtaatcatgcttggctggaatcttttataattaaggtttatagatggttcttttacatatatatggatacatataacttcttactttaaaatctttctttccctagagcagggctgccgttatatcggaatttatccgttttaacaatacttgggttaagaaatgaatacagagacagctaccttcttggtcagatgttgtaggagtacagaaacattctaggcccggagccacaaagacgtacacgtatgacttaggccaccacagtcccaagtcagttgtaatccaggaacactggaacacaaaacccgagaaggcctgctcattccattttccctgtgtcaggcctgctgagctccgtccttcctcaccacccgcacccgccgcgacacccagtggctggtggataaactcaaattgcctgcatacagatcaattgctcttctttccatcagtcctcatagttcttttgttatatg

SEQ ID NO: 85181 - DNA, 1048 bp, Homo sapiens
gcttacagctcttggaaatacccggttcagagaaggaatgataatagagatcttgacattgaaggatgaagtggaaaaaatgaaaaggagacacagtaatgatattcatgatcatgctgtcaccaagtcatttagaaaaaaatacaaatttttatttgagatactgtgtcagaatttaggaaaattctcattaaaagtggttaagaatgtaaaagggtaaaaggaggatgtttttgttatattaatattaatgtggaacttcctttctcacagttgttgtgtgattagggtggattgagttacctgccactctgagctcctctaaagtgacctaatcccagttgcttcagattactgtcttctttttagctgatctgaaaccctgacaattctttcaggtggaggagccctggggtaagggtctccattgcagaagggttccctcagcttccacccgctggcattcagatcacccatccctttctctgaccactttattacactgtttcatttatatttaaccatagcctctagctacttttaaaaacagcatttgtgtgtattgccaactctttgccagtaaatatgaaagctttgtgagttgatgagaactgatcttagagtcttactcaaacagctgatttcatgagtgtgccctagaactggtacgagttcagttttgtatcacacacttgccatatttgcagtgtgacaataaatgatggcccagaagcactagaaaatagaccatcactatttaaatatcttatttagctttcatgtgtcatttacctccaaaaaggaagtcactccagacaatggtgagctctaggcctttttaaaaattgagacataattcacaaaccatgaaatccacccttttaaaactacaagtcagtgatgtttgtagtatattcacaaagttgtggaaccattaccactaccaaatcctgccacgttttcatcaccccagaaagaaacctcatacccattagtggtcactccacattctgttccttcaatccccggctgccactaatctaccctc

SEQ ID NO: 85182 - DNA, 1129 bp, Homo sapiens
tttccagactgggcagccaggcagaggggctcctcacatcccagatgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccccgtctccaccaaaaccagtcaggcgtggcggcgcgagctttcaatcgcaggcactgggcaggctgagtcaggagaatcaggcagggaggctgcagcgagccgagatggcagcagcacagtccagcctcggctcagcatgagagggagaccgtggaaagagagggagagggagagggagagcgagtaaattctttaaaatgatcaaagtgttgaaagaaatagaaaaagaaagcagcaggcagtaccctgtagaagttaaatgtgatgtagacaagaataacgggacagggtgacctgcagaaattctctgcaggagagcaagagagccagtcacaaagaaagctgggagcatatttgcatatctgttataacgataaatagccctgctattttgagcactcctgagaaatattctttggctctcaagaatgcatttgtcaaaagagtaagttctctttaattcatgtctcctacggtacagtagtcagtgcgggtacctgttacaatagtctgctgcgccacatcacatcatcattctaaaggcaacttaaccaccaagcaagctggcttggagaaagtgtttcagggcctttgctgggctcgggacgtgcttggtccacatcactgtatctttagcttatgtccatggtagttttcatattcacttcatagtgtttgctgcaaactacttgctaagataggaatatagaatatgagtttaaaagctttccttcaaaaaagagggctaaaatatttaaatctgaaaacaatagagttttgtcatctggacaattgacatcatttcgcagat

SEQ ID NO: 85183 - DNA, 1075 bp, Homo sapiens
agagggcctttatttatttaagaattatattaaataatttaattcttaactgtctttgctcagaccttctggaaaagtctcgtgctgttcgtcaagcaaaagatgaacgtacttttcatatcttttaccagttgttatctggagcaggagaacacctaaagtgtaagttacaaaggtttttactattttatattcactggaatatctcttttaatttttttttgagaaaaaacaattttgggaaacagttttttacacacaaaacaccaaatttccagctggttaaatcatgaaaatcaaaatgaaattgaacttccatgccatggggtaagtactttattttaagcggcaggtattgtagataatataatcttttgtacttttatttcttttttaaaattttttaaattagaagacaaatgatgcgtattttacaactctgtttcaacgttttaaaatatgaaagtaagggaaaagaaatttacctaatgaaattaagtagaataaatatttttatttctagatttacaactgaatatatgttattgcttccactagtactagaaagagcctgtggtggatattgattgattgaatgtcagggatcacaaggactagaagtttagagttgggcaggtacaaaggagagctcaggtctgggtcagaattttgctgggttagaaatatattgagggagaggagaagatgtataactttcccatctcttctgattctcaaatttagtgtttctgcatgattattatatatattatctagatatcaaagtagacacatatacagtaaaagttttctcatctggcatccaggcttttgctaaccacagacatctgtgaaacctttgaacccaaaaattaatcagagaatgacctgcaagggaaaaatcaagcaacaaaaaaatagagttattgccaaggagagactaaaaattcaagatgatgcagtatgtaacactgaagagaagaaaatgctcaggctttcagactggcaataactgcaataggagtaaattctttttttttttttttaaatttattatttatttattttttattga

SEQ ID NO: 85184 - DNA, 1046 bp, Homo sapiens
tctagttttagttactatagatacattataatcaccccagaaaagattctagaaatcgatgtcaattcagaacaaacaaaatttttgaaactaattaagataattttcattttattttcttcagggtatgaaaatatcaaatatccgggtttccctattgcacattttgagtgaaatccttaacaagttatatttgattatatatgagagaattctagttgtctttgctgttgagagctctcacagtacacgtgtaatttcacttgtttctggattggtatacaataagcgttatcaaaatgtgtagctgtaattaatacacaaggtacttgtcacgttttgggggttttccatgcttttgtttttactggtgaagttccgattgaatattctaagtaccataatctgacctttatgcaaatcaattatggagtgggcattttcggcacagatttcttcacataatgtttaaagatagcgttcccacttaaaagtaaaactcgtattttccaatttagtctagatgtgtgtttcaataaaaatgttaattctgaaagtatttattatagatgtgaggagaaagcttttttaacttttaacagatattctctcccctcggcctgccgccaaggaagaaagaaaagtcacctttgcttatctggccaagtggccaacactcaagtgacgtcaggtcccatggcctgcatcttacctgatttgccagcgtatccaacatgaaggggaataatctaagtcctagatcacttggggatattcagtaaagtttttcatttttgcttctgaaatttcactttgtcaggttgtcaaagtgcttggctatgtcttgtaaaatatctgagtatgagtgtcatttagctagaaagttgataattttcaacttcataaggtttttgttttgttaaagtgtttttaaaatagaatacatgttagtgctttggcttataactgagatttattggttaccaaatatattttcagaaataccgttctcttttgcctccttccacaccacaggcccctgcagc

SEQ ID NO: 85185 - DNA, 1096 bp, Homo sapiens
caacagtgaatcctgttggttaaacatctagaaggtgtttcagatctgtccacatttcttctcctaactagctagttagtctaaaaccatatctgaggatatttcttctattattctctatcacagtatcctgtttatttccctcatggcacctatcacaagctgtaactaattactttgtgtatttattatctttcctagtagaatgtctaagatctttgtcagtagggactttgtatctttggttcctagcatagtgccccacaggtatatttatggattttatggaattcatttactgaaaatgtggcagacactacaaagtgccatacactcttccaggccctgggaatataccagtggtcaaaactaaggttccctagccctgtagagcacaccttcatattggtgttaactttaatatgttttcaacggcatgtcatgatgttgttgagctcggggaaggtagtgcatatgctagatcctctgagaatatgcatgcccccattttagaagcaagggtagagaacatgagggaggcagttgctccgtgggcaggccaggccttgggttgagatcaatgtcataccaagagtagtacgatgttaaaaaatgagttgtgtatacagtgaaatttcatgcagtcatatttataagctacatgcttacagtgaaaatatttgaggctataaactccataagctttagaatccatttggttccatttctttgatctgatatagacgactaatttcctgaagaatatcttttctttcaaagatactagcatatggtttatattaaagggattctttatttaggagagcattacccttaagaaaataatcgttcacagttagtccagttctctgtttatggagaagtaaaatgcgttccagatggaggagatttatgtaaaaagaatctctcataatgaaactttaaaaacagggacttcaatttcaaaatgattgtttggatcagcaggtacatcttccctcacagagttttagttagaatcactttctctatttccacaaatccttcttttctttccttttattttctttctctctctcttttttttttttttttc

SEQ ID NO: 85186 - DNA, 1060 bp, Homo sapiens
gatagagatagtatatgaaactccttggaaaactggaaagtgctacatcaatacagtggtaactgttaaattaactgccttaaagttttcaaataaggcagagttaaaataaacaagtattaatatgttcttaattgaagtgtcgtgctaaatttcatttcatgaaagccagtctgttttattttcaaaattctctgcctgatttacgtgccccatgcttaagttgatcttctctgttcagcgtgacatttttttctccttgtgaccactttatagatgctaattttttcctttagtggagtccattatcataaccaggattaagaagccaacaaaagttgctggatggcagacagaatgaaagaactgaggaaaagatgcagtttcttttttagaaatttttcccctgatgacttgagtaaagacattagattaacgtacatctgcttttatttgtgtgtgtgtaatgtcttttagggggaacttgaacggcagcttttgcaagcaaatccaattctggaatcatttggaaatgcgaagactgtgaaaaatgataactcatctcgttttgtaagtttcaaagcaccagaagcttttaattccttagatttctagttaaatgtttactgtgattaagcaaatgaattacttttcttcctagattttaagaagctaatagatgtagttctgtagacataatacaagctcacatgtaattttaaattttctagtagtcacatttgaaaagaaaaaaggtaatgtgtaagtaactttcatcattttatcatacagaaatgtataactctgtcttattttatggatatgtaatttaacctctctgagcttatttatctttgattgggcatgataataacacctgtcagtggaatcggagtagagaataaatggtgtgcacgctgagcacttagcccggcactatgcatagtaaacattcaacgcattagatgtggtaaactgaccttttcctaccttgctattttctgtgggatttggactttggaataatttgtcactactatgacttctctttaattttttt

SEQ ID NO: 85187 - DNA, 1027 bp, Homo sapiens
gtagcctcttgctactacccacagcagcttgaggggagggtagagatatgggaagaagtgatgacagaaaaagggcaagaatagaaatgtcagttctccttaatttttagacatgcagaagtggtagttaatacagcctgagagaacgccagccaacccagcttccacagttctcaactgcacattggcttggtgctttggaaatggcttactgctaggcaaagactcaaacttgctaacatttgcatttgtctgtttgtaatgaacagcaggaatcgcctaaaccagtgaaacaccaggcaagtgctcttctttatgcttcttagtcttgagtgtttgcactaatttctgtctgtagattgagtctctgctagaatcaaatgccactagttctaagtgaaatctgtcattaaaaaattttaattttgaaaatttattgcttagagccttattctttcttgagaagcgcatgccgttttgctttaaatttgttttctcaataaattttaatatttatttgcccttttatcatgacattgaactgcatgtttatgaagcctataaattatggtttcatatgtcatttactaggtggaattattttaatacttatcagacacatggaaacctagctttgtgccctacactacattttgaatttggggctgcccctttaaaaattatacctttagagctaacaaatttctgatctgttaaagttttatggcatggcatagtttatgcctgtatgtgttttaaaccaaaggcccaattatatttaatatataaaataaattagagctgggcacagtggtatgcacctatagtcccagctgtttgggaggctgagacagaaggcctgagcccaggtatttgaggctgcagtgagctatgatcacacaactgtgctccagcctgggcaacggagcaagacctcatctctataaataagtaaaataaaatcaattacaattttcttaatgctgggcaagtagtggaagactgttattcttcctagttatcagat

SEQ ID NO: 85188 - DNA, 1080 bp, Homo sapiens
ttgaggaaacgcaaacatgttcacgtttagaaactcctgatcttttgtgtccgaatgtgcttcaacagatgcaggacacctccagctagaagcctccttgctttgttcttgttagctttgtacttctaccactctctttgaaggatttcttctccaaaagagcacgatgctgggactgcagcctttccccttaaccatagtcctgtcttagaccagcagtgaaataaccagccacttaaagtgtaagactgcttcaccgttaacatctcattttgttgatggaaatgaggtcagattccctttgccctcactctttgaggtcttggcctgttgttcacttttctgaggagtctcctaattttcttagagagaagtctgctgagctttctttttggctctcttccctctgcttttgttcaagctgcttttagttacctcctctgtttccatctgggacagatgtgccatttctcattgttttttctatttttccaagatttatactcctttgatcctgccacctccttcattaaaatcagattttaaaaatttccattaccatcttcatcatcatcatcattgatcattatcataactattggtatcaccactaccatttattgagagccttttggcgaggacagtgctaggccctttcccgcattatctcagtcctgtgaagtctcattttaaaggcatataaactgagcctcagagaactgagtaacttgcctaaagctccatagctagggagtggcagaaggatttgaatctaggtaggtcattttgattctgtagctcaggttcttaaccactgtcctaactattgattcataaagtttagtaattcaaatcacctcatgtatagtggatgaatatatgagtggacaataatggataatgtttattgaatgtcatctatatgctttagttgagctgtattttttcttcaacaaccctatgtattaggagctattatccccattttatagtgggcaatataagacccataatctatcctcttgggagctcaacagtaaggttttgaatgtatctatctttgaagccatattttctata

SEQ ID NO: 85189 - DNA, 1400 bp, Homo sapiens
catctatggtgatgctctagactttgccatcttttagaattaactgacttttcagataatgtttcagtagttctaatgcagcatccttccatattggtagtccaatcaagaagattggacttcttaggagaagagagtccaatctcctaaatgtgttctttgacttcatgtggatccccagcccattacttgttttactttccccctatatgttaacaacacccttcactttctgccttgtataatttagatttcatggccatcttctacccatttcctaaacccctcccttgtcccgttgttcattggttattcttgtttggtaaaactcacgctggatgaatcaagatatttgtctcttttaatgctgttacttgggttgctgatgcttctggagttatgctcacataatggaacagataaataccactgtaatttcctgaccgtgagccctgattctacactcaactcttgctaatcctaccttggtcctcccactctccataatgactatttcaaacctctgcaggctccagatctctgggtccctccttgcccctctactccctggctgatggcttgtttcccattccacagaggcactgcagagaaactgccccagctagatgaacagatcattatctcttgtgtctactcctgtcaaaggctggtcttacctagtccttcacctctgatgctgatcacatcctcttaaccttcttaagaatctcatggtgttgattattctgggttgtgactgtatcttctgcttctctttttataggctcctaacattagcaataaattttccctattagctaaagttttacccgttactttaaataagaaagttagttccttccaccttccttttacagccagatttttcaaaacagtgttgcagatgggtaggcagatatggttgctggcaggagcttgtgaaaatgaagcagggtttcagctgagagtgaggaggagggaggagagattggtggtttaagatagaaatagtgtgatgtagtcatctaggagagacagataatacttacatgtacatcactgacattgcatcaaatatttaaaacagttgctattggaaatgtaaggagaatgtgaaccacagttatagagggagttttaatatgcttctctcagaatttgacatattaagtagggaaaaaaagaatattaaagaatgtgatttaatacaacttagcaagcttatattgaaaaatgtatgtatgcaagcagaaagcacatttacaaatgtggtgtctattccatatagcaggccaccaataaaaatctcagttcctgaaagaagaaatcacaggctacattctctgaccacagtgcaataagacaagatattagcaataaaaagatttccaaatgggtta

SEQ ID NO: 85190 - DNA, 1027 bp, Homo sapiens
gcgaaagaacgagactccgtctcaaaaaaaaaaaaaaaagattctgtttcttgcatgaaatgtatttatcatccttcctagtttcatatcatgcacaaactttttggtcacacatcccacatctttaagtgtattaataaaaaatattcaaaagtttttgctttttatgtgaaaaagcaggaagctagcttaattttttttaaattggattttaggggatactgtatcaaaatgcagttgtgtgcctggcacatagtagttgcttaataaatatttgttgaatgaatgaatgaaagcagagttcttagacgtaaacttgactgcaaaaaatcatacattcattaaaagcatggaatggtagattagacagaattggaaactagagcagtagatttgaagactagaatggagaccaaaaagaatcagatggtgcttatgagagaaggagtaggaaacatggaatgtatttgtagattcttgggttccatgaaaaaagtgatatttttgaaaaaggtcacctgaactaaagacacactcaggtgttcagataaaagtgctgggtggaaatagtgaaaggagatacgcttcatcttgcataccttggtggatagggcaacatgacatggaaagggagtcagtagcatcgggcttctcatttgcaacactgtgtgttaggaactgaatttaggaacaccgaggcctctaccttgcacataatcatctgaggtcacctaggagtacccacagtgaggctcaccaccttgtggcttgtcttcctttgttcctgatgcctcaccagcccagttccaccccaggtagcttccattcagcagcaggcaaccaacactgctaccaaccccggttgacctgggtagatggaaaggaaagttttgcttgctgtaacaatacctgcaggggccacttttttaggccacaatgaaaatttaagacatgagagtccaccatcttcatggaatcctggaatgaaattcactgtgtttccagtcatgttttcatttccataata

SEQ ID NO: 85191 - DNA, 1090 bp, Homo sapiens
tagctgggattacaggcgcctgccactgtgcccggctaatttttgtatttttagtagagacagggtttcaccatcttggccaggctagtcttgaactcctgaccttgtgatccaccctcctcggcctctcaaagtgctgggattacaggcgtgagccaccgtgcctggccaagaagagtattttaataccctttttagataattgtggatattcttctttgatactgtacccaaactggacaaatgctattttcttaaagattaattgcaatatggaatctgaaactgcattaacgagcttttcatagcttgtgtactcatgagagaatgaatgtaaaaaagtaaataacatattgattgtaccttatgatagccacgtgaagtcaggaagctcgcattatttctacttcatggatgaggaaattgagtccagcagagtgccacttaataagctatctgtgggagaactacttgtggttcatagtactaaattgcccattataggctaagtttaatttgggggatagattaattatccaaaaggtaaagatctcctgcttaaatgactctttggtttctgtctcctgattggaccctgattgataaatgcagaggttttttttttaatactctattttatttttattctagacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaaggtaattggaaatatttgaatactaaatgctcagaatttcttaaatgtaatttactgttttttaatgtctcaatgtattctacaaaagttaaattttatttttttaaaattaataaaaaagtaatgtttattgtagaaaaattgagtttttaagattaaaacagacaacacagccattttctgtaagtatgataagtatgtttgttgctctaaaacaatacctcataaatttgtatgttaaaaagcatctagttttcatatacatttgattcccaccacaagg

SEQ ID NO: 85192 - DNA, 1001 bp, Homo sapiens
agtaaagacccaatgaatatttgttccgtttaaaaaaaaaatacacacgtgtatgtagttttccccacaaaattgggaacatgctgtgtaattacacttttgtgttctactgggttttttaaaatactaaattacaagcatttccccatctagaaaaagtactgataatatgtaagatgtcccaatttgataaaataattttaagatatataatctactgcttctagacctgttctagaagttatttgttaaattattctaatttatagtcacctgctaaatttaagcatctaattacatgtccagtgtaaaatttaagaagtgtgtgcgtgtctactgacagcaagacagtttcctaagtgctctgtaggatatgcagtttacacctgataagaatagtaagagaaacttgtcatattttgttatagttgaatattttcttttaatagattctacccttctgaaaggtggagtgtgtatcctattatttgttctcaaatttacctgtgatgtttcccaccttgaagccatgcctcctttcttctttttttttaaattttttattttacttattattattattattattattattattatttattattattttgagacagagtctcattctgttgccgaggctggagtgcagtggtgtgatttcagctcactacaacctctgcctcctgggctcaagtgatcttcctgcctcatcctcctgaagaactgggactgcaggcctgtgacaccaagcccagctaattttttgtattttttgtagagacggggtttcgctatgttgcccaggctggtcttgaacacctggactcgagcaatctacctgcctcgccctcccaaagcgctgggattacaggcgtgagccaccccacctggcctcctttctttttaccagtgtgcaacgtttaagttggaaagagacaacttgttaatagtgttattagaccagtccctagaggcttttaaaactgttatgcagaatg

SEQ ID NO: 85193 - DNA, 2026 bp, Homo sapiens
ggcccccagccaggcctgtttggaactagggccttaggaaggaggttggcgactcggcgggtcagaccgggctggtgaggtttggataacgtggcctctgcctacagccgttatctctgtttctttagggcctctgcagctcccttcaagatcactgcggtggatggaagggggtggggtgggctggggtggggtaggggaaagcaggcggggtagatgcagactgcagatgaaacaaagactgctgttttcgctgaataatgtaataccaaacataatactttggctttgctgagattttgttttttaacgttgaaactgaggattctttgagtcaggtttaattattcttgatagtatctcactctggaaaactttataatctatttattgttttatctccttcatcaatctgcctttattaattattctttgagtcccttgcttttgatgtttaagtatgccctgcctgtctcgggttctggaaaagtggccattttatgcatctccttacttctgcatcttaaattcagttcttccccgtccttatctggagaaagcatatggtgtaattgtgcgatatagcacgagctttggcagcagaaggatgtgacccctgcgagcctggcttttcatttgggctccatagggaaatcattataacgaaggcagctgagatggaaggtgagatggaggaaatcttgaagggcacgttgtagggtggaagactatatgcttcagcggtttatgcactttatcacatgtgaggaattaaagttcctggtgttggatcctagttttggaaatattaaacacagtatagagatattaattgggagatggggcaggccataagtagcaatagtggccttttgtgtttggtttgtgtttgtgatcattgggttgagcaggattttgataaattagcagactcgtccagccctgtcatgtaagtgacctcaatggtagcagtacccaaattgggacagttctgttttagctcatctgttatagatggatgctctgtcatggataatttatccatccttcttgtttgcctttctatgtgcaggccgttcataaaattgaattgtttgcctctgtccacactcatagtaggtgctgggagggatttgaaaagtttgctgggtgacatttcattggaagtgaaaaatgacctgggggtggagccccaggggtgtgtgtgtcaaaccactgaaagggatggcaactttggctctgtagggggctaattcatacacagataaatgatttaattgtaattaggcagcaatttaaaatgacactaataaccctcagaccatctttatgttcgctaacaaaaagattcctgtttgtctttatttcccctaagttatgggtatctttttctataaaatatataaaacctttgccagatgattcattggttaagcctatactttttaagccgtaattgattgggtttttatttagtagaaaggtagtatatagcattgtacactacacacccttcaaaatttcctccatgtcaccttccatcattgtagtgtgtactctggagctgaactctgagtttaatcccagctctgctacttgttagctgtgtgcccttgggctggttattggctttctctgtacctcagattcctcatctgtaaaatggagatattaatagtgcctacctcatagggctgttgtgaggattaagagttgatgtatgtaaactgcttagaatagtgcctggccataattagtgatatatgacaatggtatctgctgttttaaaaatcatagtgttgtccttcctgcaaagcaaatcactggtgagtggtacactgttaaacaccagtattatccagattgggtaccaatgtattatggagtgaaataaatgtatttgacaattacaagtgaagaattaaactgaacaaaatatctccaatggtctcatgaactctatcaggtaaacaataatatgaacacttaacagctgcaaagccctctggtacaacgcagggtaggg

SEQ ID NO: 85194 - DNA, 1304 bp, Homo sapiens
ctaacgtcttcccttggagatgggcgcgcaaaccaaccagtgggtctgggggcggcggtgatgggcgtggagctggcccaatgagggtaggggtgggtggggcagccccgagcagcagtgctaaaggagcccggcggaggcagcggtgggtttgggactgaggcgctggatctgtggtcgcggctggggacgtgcgcccgcgccaccatcttcggctgaaggtgagaggtgcggctacccgggtccgagtgcacggcccagggctgggggacagtttgtggagggaggaatggctcctgggctgaggggtcccgggcggctctggaggacaggaacgggggaccgaagcgggagctggggaagacagaggggcttctgagctgtagggtttgtgctgcggggaccttaggttagtttgagcagggtcctgggctgggggcactgggacctcagtgggtggagatggagagactcccggaggagcggggaatgaagtccttgtgaaacccgcgggggtcagggcctgggtgtgcaggagggcgacccctggggggctgggggatggagatctgggggtggggacgtgaggaccaggttctcggtgggtgggatccctgggggcgcgaggtcgaggggctagtgtcccggcggaggtctcggcgtgccccgcgagccagtgtctgcctcccaggaagagaggggattctaagcggggctggaaagcgcagtcccggcggtagggtgggggggcgctgggcaggaagggcccctgcgtgggttgctgggtgggttaggcctggcgcgaccggtcccccgcagcaccagaggggttcaccatgggcttggaaggcgggcggcgcgcgcccgacccgtgggtggagggacaggagggcattggctctgcgcggccggggaagcgcgcggcgggtgaggggctccggagccggccgcgggcgtggggagggtcggactccgccggcgccggggaaggagcgcgggaggagggcgtcctgccgcgccctccgtggagcgcctaggccgggggtggacgccctgcgaggcccaggcggtttgagggggcgaggcgggaaatgtggcggggcgcgctgcagcaggacggccggggggagggtcagcactcgcctcgggatccctttattgtgtaagcgagctgggaatggctcgccgcagtctcttcattgccttctgcagttgggggtcacaccctgatcccataaaatcggactggaattggttcggagggaagttgaagccgcggagtcctggcatttgtgggggctttg

SEQ ID NO: 85195 - DNA, 1515 bp, Homo sapiens
cagctccggcccgcgccgcggacccgccggcctcggcctcggctcccgggaatcactcactcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgctcgccacccctgttgggaccctcgggtccgcctggggacatctgctgagcgggtgacggaggctttatcctttgatcccttctggatccggtgacgcgctaagtgttgggcacgtacggcctacggagtttgaatgctggggccttcctgttgcggcacccccagcccactggtgcagcgggatcgtgcgctcccgccgcagccctaatccagaggaccgcgccgcgccagcgccttcagccaggctgtggcgcctccagtgggtagggctggctcggctctagccaggtgaagctccagactctggattttcccgtcttcggggttcagcgtgtatccacctcacccggccgacttggccctgggccctttcacccagtggaatcctgccactgggagaagagaaagagctgtggctctatggcgaaatcttagctcggttgagaggcagaactgacacagctgggacgaaggggagtttctggaatggccagatgcgtgtcccaggtgtgtaggggagatggaatctccgtactactcatcaacttctgagtggaagtcatccctcccctctgtgtctgtttcctcatttgcaaaacaaggataaaatgagatcacatgtggccccaagtaagggggctctcagtagaaggatcccaggcaccgctcccaccactgaccaccaaccttgctgcacctcccccgcatctctccacgtcttcaccaacattctcctgggagctttagcgactcccagattttctctcaggctgcctccacccaccccttgtggctttcgggttctgatatccagctgtccttgaaatcacgctttctaagagttggaaacatccttccacagattctagagccattatacagatagtgatattgaggcctaaagtgacttgcagttgtcacccagctaattagagggcttgagccagaatggatttcatggcaaacagtgaatctcggactctgggcatcagacttccaaccgcccccaccccgacccaacac

SEQ ID NO: 85196 - DNA, 1039 bp, Homo sapiens
cttctgtcacccaggctggagtacagtggcatgatcatgcctcattgtaacctccaactcctgggctcaagctatcctcccacctcagccttccaagtagcagggaccacaggtgcaagccacaatgcctgcaaataatttattattattcttattatttttgtagagataggattttgctgtgttgtccaggctggtctcaaactcctggcctcaagtgtcctcccacctcggctccccaaagtactggaatggcaggtgtgagccaatgcacttgacttagactctgttcttgagtgatctatctgaccctgagctgaagtggatactttgtattgatatttactattcattctcattgtcttattattaatggcttattaacaatacattattgatgctcattaacactaaagcccagtgtctctgtggtgccagtcatcactgtcctgtacatgatctctgtttgccctgtagtaagcttggtgatggcagtatcactggatttgctggttctaggcaactttttaatttaagttaattaattaattagtttatttatttatttatttttgagatggagtcccactctgtcccccaggctggagtgcagtggtgcgatttcagctcactgcaacctcggcctcctgggttcaagtgattctcctgcctcagcctcccccagtagctggggttacaggcatgtgtcaccacgcccagctgatattttttgtattttcagtagagacagggtttcaccgtgttggccaggctggtctcgaactcctgacctcaaatgattggcccacctcagcctcccaaagtgctgggattacaggcatgagccactgtgcacccagcagtctatgcaactttatgaaaattgtttagggctttggacactttagggtcttctgcatatggttttttactcaatactcctgatatccatggaaggaagagagggcgggagaacaaggaaggaagattactatccacatttttcagaagaggaagttgatacttacagaggtgaagt

SEQ ID NO: 85197 - DNA, 1066 bp, Homo sapiens
tccaaattaggggcaactaggcaactaagctctccatgttactcatttttaattaattcaagttgaaattgaagtagctacatgtggtgactggctaccatattgaacagcacagctctagcccctggcctctctgtttcctcttccatcctgtcctgttttccttctttctttggcattgtcgccctggcccatcatatcagccacccactcccctttccttctgtcccacctcctggaaaacactctcaacttgagattaatccaactgtctctttctctaggtctatccaaaggctgctgggcgctgctggggaagagggcatgtgtgtctcatggccttgctggctgccattctttctcatagatagtcacaaacttcaataggccctttaattctgcccagcaagcattatcctcttctctctaatgacctcaagcctccagtgctcccagctcctcccccatcctcagcagatggtgtcacttcctatttcattgaaacaagagacacttggagaccacctgaccaccagttttacaagcatagttttatctgtcttccacctctctcctcctgctggctccagttcctatcaacatttaggcatggtcaaatagccttatcttacaaacaacaataaaaaatcccaaccttccctcaatcctatgtcaccttcctgctgtgaccctctatctttcctgccacttatattcacactttcttgaaagttgtctacacctgctatttccactttctcacctcccgttcactccacaaccccagacagcctggcttctgtccctaccactccctgcaaccactagtcaaggtcaccaatgacttccttgtagtttgatccaaaggacttgtttcagatcttatcttgacctttaaggcatgtgactcaacactgctcagcacccctccttccttgcaacgctcttacccattggtttctataacacccgagtcccctggttttcctcctcctcctctggctacttaaaagttttcttgaaactgccgcattctccccctcctagggtgatccgtctggcttca

SEQ ID NO: 85198 - DNA, 1072 bp, Homo sapiens
gcgcggtggctcactcctgtaatcccagcactttgggaggccgaggcgggcagatcacttgaggtcaggagtttgagaccagtctggccaacatggtgaaaccccgtctctactaaaaatacaaaaaaattagccaggtgtggtggtgggtacctgtaatcccagctacttgggaggctgaggcaggagaatcgcttgaacccgggaggcagaggttgagaatgcgccattgcactccagcctgggcaatagggcaagactccatcttaaaaaaaaaaaaaaaaaaaaaggctctgtggacagaaacaacattcaggaggaaggcttggaaagcacttctcaatccagtcttgtagatgctccaaaaggtaccccagtcagctgagcaccccaatttgcttcttttccattcctctttgctggaatgtcttttcctgacttgggttttgatgcgatgccatcagcttacattcagggggatcacagaaactgtccaaccgagctcactgttgtgactgttttggggatgttgtcagggacgtttgctcattaccccatactgtgttccctttctgggccacgcccccacaagaaattcctatctgattttagtaccaagaatagttgtaattcccttgagcagtaggtctgtttttatctcatggacactgggaattgtgtaatgaacatggtctcctcattttagctgcaggaaagcttagggacaaatttgtggcccactcagaagaggtgtagaggttggaactccagggtgcattggacctgtatcctcctctcgactttgtctcccttcttagcttttctttgttctcttacttcatattttactgtgcaaaactgagagcatacaagcaaagataaataaaaatcacctgtaatctcattattccgagataaccactattaactgtgttgtctttttatgcatactttttaaaaaattaaaatgacattatactgtgtgtttttaatttgcttttttcatattataatatgtcatgaacatctttccctgtaattaagtgttctctaaatgatttaaaatttctgt

SEQ ID NO: 85199 - DNA, 1152 bp, Homo sapiens
gtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtgggtgagtggggtgcggcggcggagccggcggcgggtggggccgcgggcgggagctgctgggcctcgcagcggcgagttcataggagcgcgggtcgagggaacggcgggaggcgcgttcgccgatgcccgggacccgggagggctcagagcaggtccactcgctcgcgtggcgctcgtggtggacgcccgaatttgcgcccagtgctctctgcgaagccaagaagcagcaggagaaatgttcccgggagggggtttggcagaacatttgcagataggtctccgctaaccctggatccaaacgcaaacattcattgccttccccct

SEQ ID NO: 85200 - DNA, 4118 bp, Homo sapiens
agagttttgagcaagggaatggaaaacatgtcttggagggccggatcgccgcagaggcccagtcaggcgtcctggtctgaagacgccgggcctcccgcctcctgttgcaagggaggcctccatttttacgctcgtgtcccgctcttgcagacataattgtttgtcccctttcttttaaggatcagaactagtttccagtctgaagacacttttcaagatttcgcagagagagagagagtgtagttacactccgacttagtagtcttctagaataaaattcctttgatctgctcagttccctcggaaatgttggtttttcccatctcttcttttccccctccttcctcttttcttttcttccctttgtgcgtaaaagccctttattgacatttaaagggattcccagggttttgctatcagttttagtttgtatgtgcatatgaaagataactttgtcttgtcaccatcagggtctaattggacaaatgcaagtgaatacatttaggcgaataaacttgatgtggtggtgaaatttctctggcttgaagatttgccttagcgttggtattgttcagattcaccacccacccccaggtcttgccgtcagtttggatgtggacacgtaacctgcgtttgttataatgatggtcatgcacttgaaataatctctatagtttgggattttgtctcttgaccaaagcactaactatgcacacaaattggattgacctttttttttattggctaaattgagcaatcaacatattaacgaatgtaattagtaaccgtttttgttcaaaaagtttaattaggcttaataagtacataatctacatgacaaatgattggctaacaatatttttctgggttttactgaagttattttaattcccagtagttaaagtatctttaaatcttgccaattattcagtcatctcataaaagcaaagccaattcaactatgttaaagttatttatagtttcctttttgaatagatgttctgataccttgtagatatagctgggaacatcagattgaagttcccataaagtcttaattgaagtcttagtgatttttccatcattctgtaaaagagaaagacagcaaggacaatttaggggtgatttacaattaaaggttgagctttttatgaaaaggccctgtagtggagatatgtgaatgaattagtatttgacaggtgttctgagatactaaagggcactgtgctaggaaaaagcattaataaatccttcaaaagtaactttggactatcagaggctcagattttcctcccaacataatctcttcttgcgaatttcacgctgttgacatataaagtcaagctacccagagtatttacaactatggcaaagtcaagaagtatatattttttaattcccataatcagtcttaataacaatgagcctattactgtgctgtttggtctttgcttttataaaataatgatatgtgatttataataaattgaaatggtacccttccctaggttaaccctgtgccccaccctcccgcaaagaaaaccccctaaaatttaccaatttaccaatattatcatttgactgaacagtccttcgacatagggccatggtccttatagatgactaagaaatgcacatatcctatatgttttctttggtccagttttcttttcggtgttgtttcaaggtcaagctttctatggaataaaatgtgaacgttcataaagcccagttatactttaaatgcagttttggatttcttccggggggggggaacaaacaaccctcaaaacaatatgaaagacaagacgatgtataatgttacggccttgacagctctcagtggaataactaaatactttcttccgcccatatgtatcagcagtgttcacatgcttttatacacatgtgcattcacattcattgtgtaaagaagtacccatgcatggtggggctgtgtgtacattcaaggcaaaatgcatgaacagttgtaaaccacctgggttgctaggccccttcccccctccccgcccttcccttttttcaaaagagcatctgaagaccatattgtgtttcataaattatcgacatcagttttaatcattgtccccctgacgtcggagctgtgttagtatctagtatttagcatgacgaagcatgctgtttaatcttactgtggagttgtcagcatgagcccctgcctggcttgtgacaggtcgagcttatgaaaacttgttttgcgactcactctatggctttgcattgctcagctgtaacccaaaacccacacaaaaggtgtctctgcaagacgagcaccgtgctgggttggcctcttaatggtcataggtacctgcaacataatgcttgtgattgtttaaatgtggctgtgggttgggggtcgggggatgtcctcatgctgtcaatagctctggtgcttgggtccaccctcattcatccctggcaagagagggaggttatattggaggtgttgccatgagaaatccaatgccccactaaagattcttgcaaaaatcagaaagctgaaattatttgctgcttagtccagagcctggcacatagctatagatgagtgaatgtttttaatagtcataataattattatgattattgtcattatgatgattaaccctggaggacttactctttgccaagcgctcacattaatttagacatttaatcaccgtgactacgctaataatagggactgtaattgtacttcttttagagatgaggaaaccatggcctagagacattagatggtttaccctaagtcacatagctactgggtggtgaagctgggactccagcctgacgtttgtgctttgttttgttgtatccactgtgctgcttttccatagaatgaatggatgggtggatggaagaatggatgaatgaatgaatggcagtgatatatccatgtgtaggagaaaggctggaacaacctattgcttcttgctagaactgggcgtggttccctggttgtgttgcattatgtattttacatcatattattatattttattatattatattcatacatacttaacatgaagttgtatataagaagttttcttttatcttagccatcaggcctgctgggagctgggagttgggactatgaattaagggggtttagatactttcctgggggttcttggcatccacaggtgttgctttcttggccaagtctttcttgatttcagggcctgtagtctctttcaaaggtggcgaagctgagctgtgggtagtcagaacccctctttaagaaggccttcctccagcctggccaacatcgtgaaaccccgtctctactaaagatacaaaaaattagctgggcatagtggcgggtgccggtaatcctagctactagggaggctgaggcaggagaatcgcttgaacctgggaggcggaggttgcagtgagccgagatcacgccactgtactccagccctagtgacagagtgagactctgtctccaaaaaaaaagaaggccttctcttttcaccctagtgttcactatccctttgcttcactggaacgtattgaaaaaatccagaaagtggctgaaactattgttgacaaagagaggaggtggatgggggatggtatgtcccggccactggtgtggtgccgctaggtacagttgacatgagtcagcagcacagggctgtcattcatctctactggccccatggcagctggagtgaggttctctgctggggtcctcattagcacctggtgatcaggaacctcgaggcaaggaggccgctccctgctccacccagagcagggaggcaggttcgtcaggggaaaccttctggggtgggtctgcgtgtttccaggctctgccgtgctctctattagccctgcccagttttctctctgacctcctcctcctgtagaaaaatgagatcctcagaaaactatttgagactttatgtccagagtaaatattggaaaggcagtgggttgaaattcagatgttccctggaaggaatcccctcgttttctgctcacagctggtgtcgatatttccttcttgagatgagttgtgcttttcattaagtaaattttttgtcttgggattaaaccaacat

SEQ ID NO: 85201 - DNA, 2602 bp, Homo sapiens
ttgcctgttgtctggaagcccttgtggtctctgcaggctcagaaggcatggtgttggtctgggtggcctgggagctgtggagtttaaaatgtccgtccatggtggttggggggttgcgtcctgaagacagaccacaaactcctattgagtgccaggcattgtcctaggtgctttatatgtgctttgtttcaattaatcagattgccacaaggaacggaagcttttcaaagacagatgtcctggccatcaaagggcagcttttacacaaacgggactaagtgtggataagtctgcagggcacgtctcggcttattctgtgacactgttgcatgcagagagagcagggggtatcaggagcgtttgcttggaagactgatcacataaaagccgtgtcctattatagccaactcggagggacggttgttctgaatagtacttgaaagaagtgagctgcctgggccagtcctgtagatacagacgttcacctcaaagatatctgctctcatgaggtttgacttgcgtagcacaacttagtgagctcagtattgcattcctgtctccttactccaaaaatggatttctattgtaaactaagaagtagattttaatttgcgttttaaaagttatatcattggccgggcgcggtggctcacgcctgtaatcccagcactttgggaggttgaggcgggcagatcatgaggtcaggagatggagaccatcctggccaacatggtgaaaccccgtgtctactaaaaatacaaaaattagctgggcgtggtggcgtgtgcctgtaatcccagctacttgggaggccgaggcaggagaattgcttgaaccagggactcggaggttgtgatgagctgagattgccccactgcactctagcctggcaacagagcgaaactccgtctcaaaaaaaaaagaaaaagttacataatttatgtgaatttccccccacatcaaaaggccttggctaggtgtgtattcagccccaaatacattattttgtgccagttctcccctctgatggagagaagggactgtggccatgtgattgatgagatacagaatgtctcccatcagacccttttctttttctcccagagcttaagttcctgccccaagcacagttctatcagaggcagctgctggcactcagagcacaaaggaagatactctccgaggagaaaggggtacctatggttcaggagtaccgccaaggaatggaaagctgtgctccgctcttgcctgtgtcaggaccacccccagcaatccctggaccttctgtcattgggattagtgtactaactacagttagggtgaaatgaattcacactgcagtgcattggtgcatgtgaagaagacctagaagaaagatgattctgtggctggacgcagtggctcacgcctgtaatcccagcactttgggaggctgaggcagggggatcacgaggtcaggagttcgaaaccagtctggccaacacagtgaaaccccttctctactaaaaatacaaaaattagtcaggcgtggtggcacgtgcctgtaatcccagctacttgggaggctgaggcaggagaattgcttgaacccgagaggcagaggttgcagtgagccaagatcacgccactgcactccagcctgggtgacagagcaagactcagaaaaaaaagaaaagaaaaaaaaaagaaagaaaagaaagatggttctgtaagtgtggtagacctccggattatttaaagggttcaagtaaatttgttgggtgagaactttaaaagcagaaagtaacactccagttcacttctcaactcagctagtgccttgctgaggaaggtgctagaagtctgtctccctggaggattcaggaattggcctgtgtaaggtctcagctcgctgcacacgtggtcatattttagttgggaacccatctgtgccccctcctggctggtgctattgctagattttctagatttttcccgtgtctttttctgcctgaagatgagagattattggttgttgtgtccaattttcacacatcccagagactccacacttaattgagacaatctgtaggactacagggacctctaaaggggctggctttaaataactgagtcctatgtaaggaaatgaggtagatctctgagtttcctgagggcctgtatgctgtgctgcattccatatttgaagtccccaagtgagggacacttcctgcctgcttgattgccattgtcagggcttctgatttcgtctgtttctgctttggggcggccgtggtgagtacccagcaaataaatgtaccaccactcccgcattctaaaaccagggcagacattggcaatcaacggcagcatgctttcctcctaagtcgagaaatgatcttataatattagactcctcaatataactccttaggcagaattagcccatgagatgaaaactatctgccatttttggtccccttctgaagaccttccccttccccaacctgcagacagagaagtactttgtatacatggacatttctggagcatttactgttcaggtggctctgtttggtctgggcatgtaaagaaatgtaaagtagaccaggtgcggtggctc

SEQ ID NO: 85202 - DNA, 1523 bp, Homo sapiens
cctgtaatcctagcactttgggaggttgaggcaggcagattatttgaggtcgggagttcgagaccagcctggccaacatggtgaaacctcatctctactaaaaatacaaaaacaaacaaacaaaaaaaactagcctggcatggtggcccacacctgtaatcctaactactcagaggttgaggcaggagaatctcttgaacccgggaggccgagattgcaatgagtcgagatcgtgccactgcactccagcctgggtgatagagatggtgtctcaaaaacaaacaaaaaaagaagataaaaaaaaaaaagaaaagaaatgtaaagtggatgccctccctgcaggtgaaatatgtttccatcaaggaggctgtgcacgtgagaaggtgcagacgtgtccacttgcactaaccctgaacagggataggcgcccccagtgaggcactttgctgagtgtccggggtgcagggaggggccgagggtcttgagaggaagagcattttggatttggctcctgtaccacgaaaggattggattttagtccacatcacatttgcctgctgcattggttctgttgtagtgtatttgttttctcccatgccaagaatttgagagaccatggttccctgaaaagagtggtcccccaaggaatgtccgccccgacgtttctgggcaggtcctccagaactgccttggattttgaaacaaaagcttatcactgtccctacactcaaaagaaattatgccccaacctgggccaggaccctggtgcctgaggcttcctggggcttctcccacgtgaaggtcgttccttccactcagaaccacatctgtgtggtattgagggacgaggactcatctccgtcacaaaccactgccctcagtgctctgcttacgtttgggctggtgcagaaagtgccgaacaagaatagttccaatcccagcatgaaaaagaaaacacattgtgtttacagatacagaatttggcatctgaaacgtgaaagtacctttgggttgggcggccccagggcagagctgttggacacggcccccccagcccctaccctcagccctttggccagctcgttttcctctccccgaagccagacctcagaggtgggcaggtcgatctcagccaactctttattccgacacccagccctgtttcactctatggctcagaaccgggagagaattcacggtgagaaagtgcttggccttctgagctgccatgaggaaggaaactgcttcttgctccaatccacagaaatcaatccttttttttttttttttgacagaatctcactctgtcatcgaggctggagtgcaatggcaccgtgtcagctcactgcaacctctgtttcctgggttcaagtgattcttctgtctcagcctcctgagtagctgggattacaggcacccaccatcacgcccagctagtttttatatttttagtagagatggggtttcaccatgttggccaggctcgtctcgaactcctgaccttaggtgatccaccctccttg

SEQ ID NO: 85203 - DNA, 4836 bp, Homo sapiens
ctcctgcctcagtctcccgagtagctgggactacaggcgcccgccaccacacccggctaattttttgtatttttagtagagacggggtttcactgtgttagccaggatggtctcgatctcctgaccttgtgatccgcccgcctcagcctcccaaagtgctgggattacaggcatgagccaccgtgcccagacgggttttgattatttttgaacttggtataaatggaatcatattctggcttcttttgctccatgttacatttgtggtcttcatccatgtatagtagtagtttcttagtttccattgctggccagtattgtgtgatataaatgtatcacagggtatttctccactccacttacggcaggcatttgggctgttcccaggttttggctattaacagtagcactgctgtgaccatacttgtccatgtcttttgatgcacatctgaatgcacttctgctgggtgtgtatcaagaaggggaattgctgggtcctagggtttgggcatctgttcaatttcacttttatttttaacattttttgagacaaggtctctgtcacccagcctcctgtcatccagctttctgagctcaggcgatcctcctgcttcagcctcctgagtagctgggatcacaggtgcacatcaccgcacttgggtatttaaaaaaaattatttgtagagggttgggcatggtggatcatgcctatcatcccagcactttgggaggctgaggcaggtggatcacttgaggtcaggagttcaaaaccagcctggccaacatattgaaaccccatctctactaaaaatacaaaaattagccgggtatggtggtgcacgcctgtaatcctagctacttgggaagctgaggcatgagaattgcctgaacctgggaggcggaggttgcagtgagccaagatggtgccactgcactccagcctgagcaatagagcaaggctctatctcaaaaaagaaaaaattatttgtagagacgggggtctcactatgttacccaggctggtcttgaattcttgggctcaagggatccttccttctcagactcccagggtgctgggattacaggcgtgagccaccatggctggcctgttcagctttaatagacagtggttaaactctctatttagtggaaagtggttgtacaaatttatatctgtatacagttttacaggcaaagaaactgaggcacatggaggttagttaaggtgcctgaggtcacacagctagcaggtggcagaactggaattggaatccaggcagtgcagctctggaggcttgcttttcaccactgggccaagtcgtctcttatctttttttttttttttttttttttttttgtagagacagggtctcgctctgtcatccagtctagagcacagtggtgcaatcacgtctcactgcagccttgaacttctgggttcaagcaatcctcctgcctcagcctctcagagtgcttagattacaggcatgagtcacctgcttggcctgccacttatctttaatctgcatactccctgacaggaaaactagtaatactgggaagcaaaggtgactttgtacaagtgtctttacttctctgggcctcagttctctcctgtaaaacgaggggttgggtcacaaaggtcatgtaatgatattctgtaggtctagtggaatatactgccttcctgaggacttcttcagtcttccttaacgaactcaccccattccctgctcaaccagaagcagctctataacttgaatgatacattttccaaccctacccctccactggggttccctcaaaggactgctcaggctctaactggaggacctcacttgggcctaccctccaaccctactgacaatttccccacctcccactctccagctcttccacttgcaggggtggggacatgggactctccctctttgccttccagtgtgttcgctagctggtcttctctctttaaatcatgagtgttcaggtgtatgaattttcacaaagtgagctcacctctgtgtctaccactaacatgaagaaatacagtatttccagaaggctcctcccaaccccccagggtaaccaccattttgacttccaacacaatagatttaatttgcctatttttgaactttatgtaattgaaatcatactgtatgttctcttcaatatctggtttcttttgctcagccttatttccttgtaaatagtcttaaacataacttttcctatagtctttgttagtttgatggatgatctcaacttcttggggatactgatcctctcgcttattttgtctgctgacctttgctcatggtgaatgatttccttatgtgttttgtactttctgactgtgagcttatctttatttgggatttcgtggaaatcccactgctgttagttatggaaatgcccctatccatatgattttgcattaattctgccagacattctagaggtatcactggactaggaccaaattttccattaattaatcatcttgaaaattattatatcaaatgaggagtatgtacttggcctctaaaccttcccaggcctggggtttatttttctccctcactgaggactttttctgcctttacccagaactctaggtagagacaaatttttgctgtcaccttagcccgatggacaaagcttcttcgtccccttttgacccagggggcatttggaaggtccaggtttttctgctactgcgattacagctgcagtttcctagctggtctcccttcctttatctttgtccctcagcctccctggtctcttcttaacacagcagccagaggtaactgcctgtgtgttagttccctgttcactcagaggaacacccagaacacttacaacggttgcaaagccctgtgtggtctggcccctgcttcctctctattctcatctcctggcactttgctgctcactcagtctgttccagctcccaggcctccttgctgttagtgggtacacagcttatagccctggtacagcagctgagtctgggcttgagataggcccaaatatgcaaataaatgactccctaggttccttcaagtctttggtcaaatatcacttctgtgaggcttacccggactattctatttatactgcaaacagctcccctatttgtgtctatcggactctctctctctgtgtctctctctctttctctgtcttctcctctctttctctctctccacacacacacacacctgagatcacccttatcctcccctactaactccttttccccataacactcataccacctaagacactatttaatttacttatttattatgttcttaattgttttcccctcctcccatttgttcctttctatcacttgttggaatgttaaggtacataaggtcaggaattctcttttattcacagggggcctggcataagtaggtgcttattaaatatttgataaagaaagcaggggtcccatttgcaactcctgggcttgcaagacctgaggccttatctccggtctgtgtgtgggtgctaaatcctaagctcaaggcattaaagcctgtttccaggtctaataatcagtcagtctttcccctttctctatcctccctgctgttccctccctcctcccacacacctcatgatcactggggtctcagggtttctcttaacactttggctttcagatttttctttcctctagcacctggggatttccttttatttcttatgagatctgctattcattaaatttttttaaacttacatttcatctagtatttctagatgcttgcagtggtaggggttctgcattacctcagtccaccttgttgccagaactcgaagtaatatattttaatctttcacacatctggaattaatcgtgacatatggtgtgaggtaaggatatccattttttcatcaaatatttagccagttattcagtgacaactattgagaaacatcattttttgtcactgatttgagatgccatatttattaaatgcttaagtattatataaacttggatctgttctctggatttttccattttgtttcacaaatctgttttcctgccactttctatctgtttggatatttcagtatctggtaggttcagtattcactcattattcatctgttcattttcacttattctcattgctattcttgcttgcttgtttctttatatatttatttattggctttagatgagtttgtcaagtttcattacaaatgccattagtaatttgacagcagtgttgttaaaatgaacttggtgatagttgaaaacattgtaactgtatcaacatgtctcttgtatgtaatgatttgattatttaaatgtacccaatagggcttttaggatatcagaaaagtaggttttaagtctggtcaaaatcatgaattgtacttatgtgtttctctttgattcttccagatgatttttttttacagatttattgagatataattgttcagtaaattgcacatatataaaaagtataacttggtaagtttgacttatgtatacacctgtgaaaccatcaccacaatcaagataaataacatatccatcagcccaaaatgttcctgctgtcttggtaatccctcctgcccctttccaccatggtgccttctgtcattgtatatctgtttgccttttctagagttttgtgtaaatggaatcatacggtacgtgtggtctggtttctttcaccttccatgcttagttggattatttattcatccatcatgttaagtgcattaatagttcaatcctttttatttctgggggggtattcattgtattgctataccacaatttttccattcacctgc

SEQ ID NO: 85204 - DNA, 1042 bp, Homo sapiens
gccaatcttttagaaattttagccattccaatagatgtgtggtagatacccttccaattttaagttttacaatttggaagtatagaacatctacatttatttatgtcttcttttatgctattcagtaaggttcataaatttctttatattagcatcacacattttttcagaagagtttacttctatgtatttataattttgattactattatgaaagggattttttccttctcattttattttctaagtgggtattacaatgtatagaaaagctatgaactatatatacatttttatgtattttgcaaccttcagctttactaaactctttttaattcgttctcacagtgtttcagtttctctggacttcaactatatatatgaatattttagcccttcttttccaatacttgtactatttatttttcttgtcttactgcattggatagaatgtcaaagtaatggtatatataataatggtaatgtactcttgtattactactgatttaagtgagcacatttctagagtttcattgttaaatatgttgtttgttgctagtttcatatggatgttctttattgtactcaatggagagacctctattcctgacttactgggagggttgctctttcttacttttttttttgtttgtttttttgttggagagataaggtcttgattggttgcccaggctggagtgcagtagcatgatcaatcatagctcattgcagcctcaacctcctgggctaaagcaatcctcctacctcacactcttgagtagctgagactatgggtgtgcaccatgcccagctaattttttaaagaaatttttgtagagatgaggtcttgctgtgttgcccaagctgatcttaaactcctgggttcaagtgatcctcctgcctgagactcccaaactgtgctctttttttaaaaaatattcaagaatatgtagaatgttaatcctttagatattaatcaaaatgatcatatcatttttctgctttgactattaatgtaatgcatttctttaattgatttctg

SEQ ID NO: 85205 - DNA, 1496 bp, Homo sapiens
acgtggtgaaacttcgtctctactaaaaatataaaaattagccaggtgtggtggtacacatctgtagtcccagccactcgggaggctgaggcatgagaattgcttgaatccgggaggtggaggttgctgtgagctgagattgggccattgcactccagcctgggcgacagagtgggactctgtcaaaaagaaaaaaaaaaaaaagacaactaactgtgtttaactttttgaggaatgccagattggttttcaggcagttatactgttcctaggaccctagaacccaccagcaacatatggggatcctagtttctccatacccttgaaaacacttactatctatcattttgattatagccattctggtgggtgtgaaggggtatcttgttgtgcttgtgtgatttcctaagtttgaaatattccagcattcttggaatgtatctatttggtgatgtgttattctttactaacattttattttagatttttatgcctatattcaaaagtgagatttgagctgggtgtgatggcgcgcctctctagtctcagttctcgagaggctgaggcaggaagattgcacgagcgaggggtttgaggctataatgcgctatgactgcacctgtgaatagccactgtactccacaacatagtgagactctgtcccttaaaaaaaaaaaaactgtgaggctggcgcggtggctcacgcctgtaatcccaccactttgggaggccgaggcgggcagatcatgaggtcaggaattcaagaccagcctgaccaacatggtgaaaccccgtctccactaaaaatacaaaaattagctgggtgtggtggcgtgctcctgcagtcccagctactcaggaggctgaggcagaagaatcacttgaacccaggaggcagaggttgcagtgagccgagattgcgccactgcactccagactgggcgatagtgcgagactccatctcaaaaaaaaaaaaaaagtgagatttgtctgaccttttgtcactttatattgccttttgtatcaaggctgttttaaccttataaaatgaagtgggaagtttccattctattttatgctctggaatagtttaagtaacatgagaaatagctggtccttgaaggtttgttagaattagcccatctgagccctgtgtcatttttgaaagtagttatttgacaaccatttcaatttcttccatacttatgtgtttattcagaaatttttcaactgctttttgagtcaaatctggtaatttgtttttttttaaaaatcatttacccagattttcatttttcaagcataggattctatataataatcactaaaatattttttaatgttcatatatggctatatcacctttctaattgctaatagcaaacattttttctcactctctctttgcctaggtttgtttgctttttgtacatttgtgaaagtgataataataacatttgatcatatttaatgaacactcactgtgtcctagaccc

SEQ ID NO: 85206 - DNA, 1501 bp, Homo sapiens
ttttgatattccttttgttcctggagttatttatgaattgggttttcatctccaggaggttatatcctttaaaatatttttttaaatgtccaattttttttgctgtttccggtactttttttttttcctttttggggcggagtctcactctgcggcccaggctggagtgcaatggcgcgatctcggctcactgcaacctccgcctcccaagttcaagctattctcctgcctcagcctcccaaatagctgggactacaggtgtgtgccaccatgcctggctagtttttgtatttttagtagagacggggtttcaccgtgttggccaggctggtctcgaactcctgacctcaggtgatcccacctgcctcagcctcccaaagtgcaggcattatagacatgagccaccacaccccagcctctggcatgttttttagtttggtttttgtttgttttttagaataatctcatgtgtatgtaagatcacctcttgtcagtgttccgcaggaattgaagaggaatcctgtttgtagggcacaatgtttatatttattgactcaatctaattgggattttattctccagatactctatattcttgttttcctttttgcctgcttggggcaaaaaaaaatattcatggaagtctttaacatgtaactcgatcttccacagattaagtgacaaagtcattcaacttcttaaatattaacatgtgcaaaagtacataaggcaaattagcacagagtaaaagcggggggtcacaaaacagtatgcgaaaagtagaattcagagcagagtacattatacacaaagctaggttaatttgtacagatacaggaaaaaaatgcactgtcattaacttgaatggattatgaccccggcctcggactcctccttggtacacaggggaagttggcctctcagttctttcccgtgctcacactctaggatggtggttttggggttcactactaagtgctgccagggatggaattaactgggaataggattagaagcaaagaagaggccagaatgattcctagcctgaagctggagcagtttgagccgacagctggggctgagtttattgctttggctcactcccgtctgtacatgagcatctgcctcattgccttttggcctggcaaaggggatttgctgaaatagaaatcagtctgcaaggaaaggatggtgaggccacagcgactcactgacatggggtgccacctcccgtcatgaaatatgaccccaaatggcttggtttggctgtgggatatgccaacaccacccccgggagctctcagctctgtggaagagcatttccataggcagcttcctacagaaacgggcaggcgacccagcttcacgcctgcctccatttctccttatccttctgccaaggggtgattaattcatggaagaaagatgggatgctaaagagaggagtgtgtttcacagaataccagaaccatgagaaaggctgaaaattaatgagctaagt

SEQ ID NO: 85207 - DNA, 1422 bp, Homo sapiens
actgtatgctactaaattttctaagtgtcatttccgtatcatcattagcaaacccctggagaatttcaacagagtggtccatagaccacttgaatcaaattcttaggtggaatcaaagaaaaaacataaattggactttatcaaaatttaaaacttgtgcttcaaagatacaatcaagaaaatgaaaagacaacccatgggatgggggaaaatatttgtaaatcacgtgtgatgaaggtgtagaatgtgtaaggaatatgtaataaatcttagaactcaacaacaaaagacaacccagtttagaaacgggcaaagaacttcagtggatgtttttccacagaagatacacaaatggccagtaagcacattaaaagatgcactaaatcattagccatcagggaactataaatcaaaaccacaatgagataccactttacattcactaggatggctatacttgaaaagaaaggtaataacaagtgttggtaaggccatggagaaattgaaaccctcatgtactgctggtgggaatgtaaaatgatatggctacttttgaaaataatcccttccgaaaccccccaaataagagtccaggcatggtggctcatgcctacgatcccggtacttcgggaggccaaggtggaaggattgcttgagcccaggagttcaagaccagcctgggcaacatggcgaaaccctgtctctaccaaaaagatgaaaattagctgggcacggtggtatgtgcttgtagtttcagctactagagaggctcaggcaggaggatcgcttgagcccaggaggtcgagttacagtaagctgagattgtgctactgcactccagcctggttggcagagaaagaccctgtctccaaaaaaataaataaataaaaaagagaaaaaacaaaagaaaataatccctctgaaatgagttgtgatacgatccagcaattccattcctagatacacgaacacaccttacagatattataggttcagttccagaccactgcaataaagggagtatctcaataaagcaagtcatacaaattttttggtctcccagtgcatataaaagttatgtttacgctatactgtagtctgttaagtgtacagtagcattatatctgaaacatatacatatcttaattttaaaatactttattgctaaaaaatgctaacgatcacctgagccttcagcaagtcataatcttgtcactgttggagggcttttcctcgctgttgatggctactgactaatcagggtggtggttgctaaaggctgggtggtaatttcttaaagtaagacagcagtgcagtttgccacatcaactcactcttcctttcatgaaagattttgctgtagctgcataatagtattttacccacagtagaacttttttcctaattggagtcgatcctctc

SEQ ID NO: 85208 - DNA, 1246 bp, Homo sapiens
gcctgtcctttgaagctaggcattgacttctcctctgtatctatgaaatggcgtcttcgtccaatagaaagctgttttgtctacactgaaaatctgttgtgtagtgtagccactttttttttttcttttttttgagacagagtcttgctctgtcacccaggctggagtgcagtggcgcaatcttggctcattgtaacttctgtctcccgggttcaagcaattctcctgcctcagccttccaagtagctgagattgtgggtgcccaccaccgcacccagctgattttgtatttttagtagagatggggtttcaccatgttgttcaggccggtctcaaactcctgacctcaggtgatccatctgccttggcctcccaaagtgttgggattacaggcatgagccaccgcgcccggcggaaaatgcttcttaaaataagcatttcttagccttttcctggcttaatgaagtaaaatctctgggatggagcctagaaatctgcactttggtgaatgcattagatgaaacaagtgtacacagagttttaagaatcactgtccactgatttcagtagaattccaaataataattgtaaaaaatgaaatgaaagaaagaatggtgaaaatagaaaatcaccatttgacaaaaagttcgtggtaatagttggaggcaagaatcacaaggtctgctaaagttagggggtaaaaatatgatgaaaaatagaatatttgcataatgctagttagagtaccttcccgcaaccacagaaggaaaaagaataacttacagtgaagaaacctaaagatgccacctgaaccaactgatcagaattaacatcaccagtaatgggccacctgaaccaactgatcagaattaacatcaccagtaatgggccacctgaaccaactgttcagaattaacatcaccagtaatggacatagtgacatcatgtgccacctgatatgtgatatgatggcccaggaagaatactttgcttctgcaggattcttgctaacctgaatttaattttgaggaaatacgagatgatcccaaatgagagacattctagaaaataactggccattactctttaggactatgaaggtcattaaagacaaaaagagactgaggaattgtcatagactggaggagactaaggagacgtgagaccaaaaggcagtgtaagattctgaattggatctagacaaagacatgtgcgggacagttggcaagatttgaataaggtttgt

SEQ ID NO: 85209 - DNA, 1049 bp, Homo sapiens
gaatcgcttgaacctgggaggcagaggctgcagtgagctgagattgcgccactgcactccagcctgggcgacagagcgagactccatctcaaaaaaaaaaaaaaaaaaaaaaaaccctagctggactcccagctctgtcatgtaccagctaaatccagagcctctcagcctcgttttcatctgtgaaacggggatgaccatgtctatgtcctaggatcactggaagggtaaatgaaatgatgtatgtgagatgctaagtgcagtgcctgccttaccaggtgctcaggaaatgctggccctcccctgtggttcaagcacccagagatattttctccatgagtcagctcccagtctccctcttgccctggagcaaaagaaccaatcctgtccactaggctgtttcagcttggcaaggagccatcgaagccccctgtcctgttagctgagaaaaggtgtgtcctgggagagagaggattttgacccaggttgagatgggaggtggctctggcaggcagaggacaccctggggaccctcgggaaggcagcctggcctgggagctttctcacaggctctccttggcaggccacttaaagttacaccgacttcaaacaaaaagggtttgcagacacaaaagaaggctcaacctggccagtgccaggcctggcttggtatttgagttcagaaatccaactccttggagctcgcagacaggccccaccatcccggtaaacactccaggaatgccaagaacctgccttagagctcccctcccgggattgcttctgttgctgaccctgggtccggattcgttagaggtaaataagagccagtgctcccagagcggggactgtgcaacaggccaaggtggggctccttgtacctgtcttcaattccaacccctctccactttgcagtatgtgggtgtatgtgccgggctagttttcttaatggattatttttcctccagctttattgaggtataattgacaaaaattgtatgtatttacaatatgtaacatgaagttttgctatacatatgcattgtgaa

SEQ ID NO: 85210 - DNA, 1051 bp, Homo sapiens
tctaaagcaggtcccctgtggacgttgctgtagaacttctgaaaatgagtacttctcccctccctcccacctccagcagattcggattccctggaggacaaggattccgactgttatctttctgtcctcagggtctagcaggatgctggcacattgcagatgcttagtacatatacagtggataaatacatcagtggaaaatatgaaaaaagagacagccaccttcggcttcttgcttttgggggcagcctatttagagaccatgaataagaaaagaaatgaaggaaatctgtgaacccaaatgaaatgaccagctgtatgaagggccagcaaatggctcatggagctagtggcttcacaggtgaaaagggagtgtctagcctcccttaagcagggctcatgaaggtgggccatgcttcagccacaccaggtcaggcacgtagtccccctcactcaaggacatgtgcttgagtgccttgggctaccaagttgcctttcccagggactgggtggtctcacgtttgccttggcagggatccccgttgggtgcctgacatctgattttttttagatactgtgatagtaaatgcgaggctgccatgaaaaaggagactccagcctgatgggaacgaagggcggacagtgaacacgattctctctcccagagaaagaacctagcaactgggttagcatttccagaaggctttttgtctgattcacaagctaatttcagcagcagagtgattatctagaacaatgtgccacacagagtggatccccgaagagccgagatgttaacttcaggaggaatcacttattcaggcctgcccgaggcatggaaacacgagagcccgccttgggagaagccgcctgcccaggtcggcccgacctgcctcacggggaaattggcttccactttctctttgaacaaggatggagggtgaatggaaggcggggcagcgagggaaggattaaagccccctgtttgttctataatggggatattcatcttgccttgtagaggggggtcttttactggaatgaaaaagtt

SEQ ID NO: 85211 - DNA, 1069 bp, Homo sapiens
aagggagccaaacatgagagaggcagacagtagagtggtttaagagcccacaatctggagttagactacctgggttcaaatccagactcggccacttcctggctgtggctctgagcaagttctttaatgtctgtgcatttcagagtcctcctttcaacaatggagataatgatagtacctgtctcagagggctgttaggagcattaaataatttcatacacgtaaagtgcatagaatagcacctggtacacagtaagccctctatattatcattcatggtgatgcctacctgctacgtggccggcacatgctgaatcctgggtttaatatgacggtgactgaggtgtggttcctgcccacaaataaccctggggaaaatgcagcaggtacagatggaggaacttacgcaaatcctcaaaaatctgaacctagaattgcagtgtgacccagcaatgcctctcctaggtatttacactgaaaacaggtatttagaactgaaaacaggtattcagacaactacttgtatatgaatgctcatggcaacattattcacaatagccaaaaggtggaaacaacccacatgtccgtgaacaaatgaatggataaacaaaatatggtctatccaccctacgtaatatcactcagccagaaaagggaatgaagtacaacttatatatgctacagtgtgaaggaaccacagaaacagtatgccaagtgaaagaagccagacacaaaagggcacatatgatatggttacatttatgtgaaatgtccagaagaggcaaagcagattagtgattgccaggggcgggaggaaggggaaatggggagtgactgcctagtaagttatggaatctcctttagggaagatgaaaacattttgaaactagacagaggtgatggttgtacagctttgggaatgtactaaatgccaccggattgtctattttaaatgactcattttatgttttgtgaatttcacctcaattacaaaaaaaaaaaaaaaaaaagacccttgcagatgggaagactcaagagggcaagtctaaaccaccagggccacgtatgg

SEQ ID NO: 85212 - DNA, 1040 bp, Homo sapiens
ttaagagatcgagaccatcctggccaacatggtgaaacgccatctctactaaaaatacaaaaattaactgggcatggtggcgcgtgcctgtagtccaagctactcgggaggctgaggcaggagaatcacttgaacctgggaggcggaggttgcagtgagccgagattgtaccattgcattccagcctggtgacagagcaagactctgtctcaaaaaaaaaaaaaaaaagtaggcaacaaaggtttaggatgaaggtataatttaaaaagcatgaagttgaaaaaattactcaaccacagtgaccttggttgaatcaccttaggttgtttgctttgcacaggggaaagatcatcatgttcttttgtagtgatagagcattctgatccaaccaacagagccccatggtttctagggaggtggagaaggcctggtggaggaggaaggggagggctcagttcctttctagaacttgagtgtcagttgaaaatagagtgaggaaggtggcagttgaaaatagagtgaggaaggtggctgattctaggcaggtgagtggaatgagtgacagtggcccaaagggtaagggggggtctggcctttctagagaacatgtgtcaatgagacagttggctggaaccttggctcccagtaggagcataggaggagatggagcagagaccgggtatgggcaaggtggtggccaggctaaggaaggtggggtttatctagacaagtggttgtcacattttggcctgcttcagagtcacagattgctgggcccttcctcaaagataggtttggagtggggccctaggatttgatatctaacaagtgcccaggtggtgttgatattgctagtctgtccacatttggagaaccactggtaagcgatgggcatccaggagcagtttttttgttgttgttgttgtttttgttttattttgttttgttttgtttttttgagacggattctcgctctgtcgcccagaccagagtccagtggcgtggtcttggctcactgaaacctccacctcccgggttca

SEQ ID NO: 85213 - DNA, 1065 bp, Homo sapiens
caatggtgcgatctcggctcaccacaacctctgccctctgggttcaagcgattctcttacctcagcctcccgagtagctgggattacaggcatgtgccaccacacccagctaattttgtatttttagtagagacgaggtttctccatgttggtcaggctggtctcgaactcctgaccttagatgatccgcctacctcggcctcccaaagtgctgggattacaggcataagccaccgcgcctggcccgattttttaaaaaataggccttttcttaagttagacccttgggagggaacagtgtgtcatcctcgaatttccaaaaggggctctaagatgcaggaaagagagtggctggtggctggtgtccacaccatatggcggcagtacagactgacccacggctctcttcccagctggtgccttgcactcagcatgcatccacccctccatgagtacaggaatcagctcatctgctcttcaaagtatggagctgaattttcctatccttgcaaatagcctcttgcctcctagcctggcttcctccaccgttcatcaagacttcagtaccaggagcactgtattgatgaatttcacaatcccgtggggataaaagctgctaaaacacttttcccaactgctaaattggaaccttttagacaccgagatctcacttcccctcctaggaattttcctattaaaacattttaaaggtctattcaactagtttatagctatgggaattaaaaaaaaaagaatggaaattaagttctagggacatgtctttttggtcttctttaagaatcagtctaatttccacttcattggctttttgttatttcaaagcagaagaatgaacattttctcatttcgtatttcgtaatgaggaaaccttagcagaacctgtatataaactattttggtttgactatggattaatcactttcactgcgttaaaaacaaaataatgaagccaaggaggttatttccttttcaagaggaggttgaattttctgagcagctttctccctcaaacttctcagagtcttcaccttggaggcctcgccc

SEQ ID NO: 85214 - DNA, 1032 bp, Homo sapiens
gcttcacaccagccccctcccgggtggccctggagcctgggttatttgctgtttttttttttttttttcaagcgggcaccacacccgtggactgtctgccaagaaggaccattgttcgtgagaattcctccctggctccagctaacccttagatgcactattctgattttgtgggcttgaattcttattttcttaagcctcacttctacccctaccccccaacttattcttgccttctctcaacccggccttctcatcaaacctcattttgttgcccaaaaagctttgagaggtgggcggggatgtggaggtgaagcccttcaggaaaattgaaggtggctgtttgacctggtctccggagtagctttgcgtgcccgcctcggagaggaggcagggaggccccctgcattctgggagaggaggctgtcgggtaacctaagttggggaatgcagcggtgatgggaagtgagtgggaggcaggggtgggaataagcgggaggagaagataggctaaagaatgaaaagcaatatctctccccccagaattgagttgattaacctgtagaaagggaggccctgccaagcccaacttccttgtttccagaaaccttggcacggaggccccgtttctggcagaggcctctcctagtcggggaaccagcaaagcagctgctgtgattttctttttcctctcatttctggcaatccggaatgggactgtttacttttttcttcctctttccttccccaccctcctgtagcagggagttggttctggttaatgttgaagatcataacatgattaccccaaagtctcctgaaattaaatcacttttcttcaaagagaaaggggtggggggaccgtctggctggtaggccagcgaggacgagcggatattgaaagcagcctggcagctgtgattcactttgcacagcggaggcccggcaaggcccaagcagccatgcacaggggccgcatttgcaaacagtggctgggaggagtcgcgtatcccacctgggccccagacacct

SEQ ID NO: 85215 - DNA, 1056 bp, Homo sapiens
ttggccctctttcgcgcagtgagttcagcactccctctttgtggctgttttcctgggctgtttcctaccgtttttcattcaagggaatcagaggagtgggaaaccatgtggaagcaggatctggaagatgctcgattcttgttgctggtgtcccggtaccttgagctctttgtttggggccagtgaccagcctgggaggcccaggaatcagtggctatgttgagtgaagactttaggggattggtcttttggcgccaagagggcaccagttaggcagcagagggaccatttgagagaaggcagtggtgccggctctcgcgaaccagtgcgggagggaagcctgacaggggcgaggtggcttcctgcaagacggcgtgtaagctcagcaactgcatttttctgaggaattagggatgggacgcggccagcccgctctggttggagcttggtgctgtgactcattctcatcaagggtcactgagcgtctctctgcgcgtggccttgggctgaactcctcacctggccagccttctcgaaaatgtgtgtcattccttgtgaggcagagccatggagcgggtgagtgagtgtgcaaatcagtggaaattcatctgcaccactggaaaaacaactccaagttcatgacttgttggcttcagaggcgtgactgtgaagaatggagctgacatttttgtttttcactcaacacgcccaagtagacagatccagatgactctcctgtccactttaggagccacctggggaggtgaaacacttcttccactggcctggagggcccttttaccagccccgtggggaagtcagtcttgttactttacggcctcagtttttatccaaagacaacatcacctaggcatgatcactgagcctgttcaccagatttgacacccaagggttgaggctggatgcaaaagtcctatgcaggtccaggggctgaggagctgccactatctgggaaattcaggagtccccaagggcaattctcaaaggcaagtctcaggaatgtgttgggcccattggaatactgttggaataagt

SEQ ID NO: 85216 - DNA, 1026 bp, Homo sapiens
cactctagcaaattaactgaacctgaggaggggctctagggaaccttgacttatagctggttggtcagaagcacaagtaaaacaacgtggggcttgtgattggcatcagaagtgctgggggcagtcttatgcgactgagccctcaacagatgggatttgacactatatccagatacatagtgtcagaattaaattggaggacacccagctggtgtccattgcacaattgtttgcttggttgttggagaaaaaaattccctcacacttcttggtgaccagaggtattgattgttgtggggtgagtgtgaggagaagctgttttttgtacagactcatcttaatgactgaaacgtacttcctctgtggttatctctgtgccaatgaagatcacccaggagcccatcttaatctttgacgtctcaaccagtcacctaatcttgttgattttccccatgtgatgttccatttgcacctgtttcattccatttatcaccaacacccaagctctgttcacatggagaccttcatacccacccagatagtctcctcacctctcgtcctccacccccaaacccacctgccccacccgtccacacatcctgccatgaagtactacctttcatcacaacaggttaacgaggaagccgactgctgtcgcagagagagctctggcctcaggtgggcctttctcaatatcttcactcccgggaagaggagattgatgacagtcccttgcagatatgaatggcaggaggctgggggtcaggggtgggatagccatagaggaagcactttcatgccttaaggttgccttcaaccttaagttaatagttggctgcacattgaagaaagtcagataaatatttaaaaattcacttttaaccttacataaggcctggaagagcacttccatttgccaacttgctgcagggccaagacgttttctccgagtttgggtctgctgggtgggttctgtgttgtctcttgcacaaaccttgtctccagtctgcagttggtttcatgaaa

SEQ ID NO: 85217 - DNA, 1603 bp, Homo sapiens
aaaaaaaaaaattaaggacatatgttttggctattctccaatttctactttttataccttgttaaacacattagagcaatgtcctaggtgacaatttcttgttgataacgcacaagttttgccagaagactgtctcagatgttccctgttctctacccctggtgggtttttcactgctgggtggaacctaaatgttcattgtcccttctgagaacacctgctgtgtgcttcccctgcctgcaaaaaccaccttgaacgtgatgggtgctttcggactctcagggcccttctacctctgctcatcccaaacaccacggcactggagacaaagcttttcgttcgcagccgcagccgcttgcctgtgatcatctttttccagttgggggtttcatctctcttttacaacctggctcctgctaccgacctcctgcagtttctggcggggacttgttagagtggccaaacaaacttttttttttaaacaccaacaagctatctggacacagtagggtagttactaagcaaaattatcactgctcccttctatgccccagaagtcctgaagcccacagcctgtctatccttttgaggccaaagggagagatgggcatttgaggacatggtgggaaaggctgaggctggaggacgggctgtgggtatgtgagtggggaatggtgttgacgcctgtctcctcccaacttatggcattgatcatcttttggtaggagccgggctaccaaactcatctttttttttttctttttctttttttttttgagatggagtctcactctgtcaccaggctggagtgcagtggcatgatctcagctcactgcaacctctgcctcctggattcaagcgattgtcttgcctcagcctcccaagtagctgggactacaggcatgcaccaccatgcctggctaatttttgtatttttagtagaaatggggtttcaccatgttggccagaacagtctcgatctcttgacctcatgatccgcctgcctcggcctcccagagtgctgggattacaggtgtgagccaccgcgcctggcctaactcctcatctttcttacttaccaaagcaggtaaggactctctgtgactcactaagcaagaaagtcatggatgtttctggtcatttaggagcagaaagagggggatacagatgccggtttataaaggctgagagtgcaggaggcagccactcaggagaccttgctaaggctggcttcccgctgcttgtcttctctggccatttctctgcttgggtacagaaaccaggccaagtgcctggggaacatttagctttttgttgtgagaagggaagaattagaaagtcaaatgctcctatggactgggagccaagagaagggggcagggaggctggcagggccttgaggaggcttggccactctgagggtgggtgcccatctaaggcaagcctggagctgggtgggcaagagccgggcggccccgctcctcctttccatgtcctcccctccaccgggaccctcagcctgggcccagcagggaaacccagggcgtgtgaagccgaccaaagggagatggattgaaaaacagccagctgaggagggcactgg

SEQ ID NO: 85218 - DNA, 1021 bp, Homo sapiens
gagcgctgttcacagtgagctggactgcagaccctgggagctaagaggggacaggtgaatgccttaaggagcctgcggagcaggtcttgcaggatggctgggaagggtcattgcagcatatctggcctgtctgatgcagcaggtggaaacagagactgctgaaaccatggcactggcgagaacctcatctgtgaggttcctgtggcgtcagacacagccagaagctgttttcatatgatctggactggagcagactatgggaggatgctgggtgtttccagccacacctgcatatgaagaaaacaagcacccccagtagctggggtgtggagaagagagaggttagtgagatgctgctgggaatgtaaatcgtaggggagattatggtttttagggagagaagcgatttttctctcacttctccattggccaggacagcttttgtttttaacctctaatactcattttctttctgactccaaaaacaatgtgtattaattttagaaatttaagaaaatatagaaaaatagaaaaataataacctgaaatctttccttctagggaacacactggtaacattgagtatattcttctggtatatttccattttcgttttcctttgtacatgaatttttttaatgaaatggaagtatgctttgcatattgttttgtaacctgggcttttcatttgctatatgggaaacactttgtccatgttgttaaatattctgtaacattgttttaatagtctcattggccgggcgcagtggcgcacgcttgtgatcccagcactttgggaggctgaggcgggtggatcacctgaggtcaggatttcgagaccagcctgaccaacatgttgaaaccctgtctctactaaatacaaaaaaagttagctgggtgtggtggtgtatgcctgtaatcccagcaactccggaggctgaggcaggagaatcacttgaacccgggagacggaggttgcagtgagccgagtttgcgccattgcactccagcctaggcaaca

SEQ ID NO: 85219 - DNA, 1001 bp, Homo sapiens
aatccagtccagggcccatgacagcaacctggccaggtgagtggggattttagccttgtcttatacaacacagcacaagccaggatttcttcctaatccctgccttgccttcttattgggggattgtgaactgcacctaaaacataaggggtggcccagtgtggtggctcacaccagcactttgggaggctgaggcaggaggattgcttgaggccaggagtttgagagcagcctgagtgatagagggagaccccatctctacaaaaaataagaaatgtagccaggtatggtgctgtgtacctgtagtcccagctgctgggaggctgaggcaggaagattgcttgagcccaggagttggaagctgcagtgagctatgattgcacccatcactgcacgccagcctgggcaacgagagagactgtatcaacaaaacaaaacataagaggaaataataaacatgatctggtgctccactccattaatcatcaggaaaatgcaaattagagccacaaggcactatcagagtgcctaaaatgggaaaagacaaagaatatcaggtgttgataaaatactctgctggcaggagtataaacatatcaaataacagttttgtggctgtattagtccattctcacattgctaataaagacatacccgagactgggtaatttatgaaggaaagaggcttaattgactcacagttcagcatggctggagaggcctcaggaaacttacaatcatggcagaagggggagcaaacatgtccttcacatggcggcaggaagaagaatgagtgcttagtgaaggggaagccccttaaaaaaccatcagatctcgtgagaactaactcactatcacaggaccaggattggggaaactgcccccatgattcaattatctctacctggtccttcccatatccccataacacatggggattatgggaacgacaattcaagatgagatttgagtgtagacacagccaaaccatatcagcggca

SEQ ID NO: 85220 - DNA, 1056 bp, Homo sapiens
ggccagtcagcttttccccagttttttcctattataaacattgttgcaataagcagcattgtccatatctcctggggttatgaatgagatttctcaagggtagataccaagaggcataaattggtcatttccagctttactagatattgtcaaattgctttccgaggtgattgcagcaattcccaccagctctatgtggaaattttcatcggcctatattctggctaacacttggtattgtcagacttgtgtatttttgccattccgatggtgtgtggtttaaatttgcatttgcattgttgatttaatttgcatatgtctgattattgtgaggttaagcatcttttcatatgtttattggctatttaggtttcctttgctgtgacatgcatattcatagctagtgtgtgtcttttctcttgggttgtctttttcttatttatttgttggagttctttgtatattctggatacaagtcctttgttgtacatggtgccattattttctcccagtctgttcctgtccttttcccctgctgtccttttgtatcctctgacctgatttttgcttcatcaaatgcttaaacgagtgcagaatgatgcttccccaccaggtgcaacctgactcaaaacccagggtgtgtatccgtgagaaaacttgacgacatcccttgaggtgctgcctggtgaggtggggtgagcagaatttcatctccttcccctacctcctgcctcttttttttttctttttgagacagagtctcactctgtcgtctaggctggagtgcagtgatgcgatcttggctcactgcaacctctgcctcccaggtttaaacaattctcctgcctcagcctcctgagtagctgggattacaggcacctgccaccatgcctggctactttttgtgtttttagtagaaacagggtttcaccatgttggccaggctggtcttgagctcctgatctcaggtgatccacctgccttcttggcctcccaaagtgctgggattacaggcctgagccaccgcacccagcccctcctgcctcttttctatct

SEQ ID NO: 85221 - DNA, 1506 bp, Homo sapiens
ggagtcttactctgttgctcaggcaggagtgctgtggcgcgatctcggcttactgcaacctccaactccctggttcaagtgattctcctgcttcagcctcccgagtagctgggaggattaccggcacacgccaccacgcctggctaatttttgtatttttagtagagatggggtttcaccgtgttggccaggatggtctcgatctcctgatctcgtgatccgcctgcctcggcctcccaaagtgctgggattacaggcgtgagccactgcgccctgcccagcatgatcttttatcaagatccttgacttaattacatctgcaaagatcctatgtccaaataaggtcacgtttacaggcagttaggtcatggacatatctttttgggggtcattatttgacccactagactaggcaaatgctatgaatttcagagaatagctagcctaaaagtgaagtgtaggtgtgtgtggtggtggtggtaggagaggtgaagggggtgtcaaggaagaaaaatgcatctgggagaggcaggttcttctgggaggcacagttcccccagagaggagaggcaatgcagctgattcttaaacaacttagggggtttagaggcactgactgcccctctgcaataaaaaatctggatatttttgactcccccaaaacgtaactactaatagcctgttgacaggaaggcttactgataacatcgacagtcaattaacacatattttgcatgttatatgtattatatactgtattcttacaataaagtaaactagagaaaagaaaatgttattgggaaaatcgtaaagaaaatatatttactattcattaagtggaagtgggtcatcatgaaggtcttcatcctcattgccttcatgttgaataggctgagggggaggaggaagaagaggggttggtctcactgtctcaggggtggcagaggcacctgtaaatggacccacacaattcaaacccatgttgttcaatggttaactgaacattttagttgtctattgaactaaaattcagtggtcaacggccattgtggattttcacatttttcatctatttagagtccccagaaaacagataacgggtgttcaaggaagatgcctcttgggtgaacaggtacaagccaggcgaaacctagctgtgcccattgatctgccccactgctatgaagctgcgcctgtggctgtatcccctgcaagggagccccagtggggccaaggacaggacactctgtgaacagctgctgtagatcctgcctttttgaagataagtaaagagaaaccaagtacatttctacaattatggaatccacaaataatgaggttcagcaatactattcctttccttcacctattcgttacaatttgtgtaaccccaaaataaatactcagggccctttcatggtcattcatgatgggcacagagaggtgaaaaatttgagttacctggtgtgcatgttcccagcgagattatttcagctctcatactgt

SEQ ID NO: 85222 - DNA, 1370 bp, Homo sapiens
ttttggctgtaagttcagtgctggtgaatcaatgatacgttttgtatacagaattttttttatttttatttttttgagacagagtctcactctgtcgcccaggctggagtgtagtggcacaatcttggttcactgcaacctctgcctctcaggttcaagtgattctcctgcctcagcctcccgagtagctgggattacaggtgcccgccaccacgcctggctaatttttgtatttttaatagagatggggtttcactatcttggccaggctggtcttgaactcctgacctcgtgatccacccacctcagcctcccaaaatgctgggattacaggcatgagccaccgcactgggcctgtatacggtatttttaaagcagaaatacatataaaaaaagggtacatactgaccagtttgcgaaaatgttgtgactaaaggctcacaggaacttaaccctgtattttccctgggagcaatggttcattatttgctgactattcatggcagcttgatagaatgtgaataccacagctaatgagcatcaactgtatctgaaggagcccgcttctgaaaatgattatacagcaagctccgggagaacatgtcaggagattggcaccctcttattgcaggaagacactttctttgtgcaatccaagcagactttgctcaggagaggacagtccgagactagaaggcagcagaatgagatggaaatagagatgtcatatagggagagagtataggaaaaagccaactgcagaatcaaaatccatatggtacagagtaagaggcagattttgttcaaggatgttcactgcaatgttgtttataacagcaaaaaaagatgtccaacgatgggagatgagctaaataaactctaatgtagacataaaattaaatatatatgattcaggccaggcgcggtggctcacgcctgtaatcccagcattttgggaggccgaggtgggcggatcacttgaggtcaggagtttgagaccagcctggccaacatagtgaaacccatctctactgaaaatacaaaaattagccgggcatggtggtgtgtgcctgtaatcccagctactcgggaggctgaggcaggagaattgcttgaacctgggaggcggaggttgcagtgagctgagatcacgccactgcactctagcctgggtgccaaaaaaaaagaaaaaaaaaaaaaatatatatatatatatatatgattcagctattcagatattgtgtattatttattgacttaaaaggagtaagggaaaaaaaaggaagattcaagtgtaagtatgacgggtctgatacttttaaaaaatgtgcatatgcttacttagaaaaagctttgcatgattctattaa

SEQ ID NO: 85223 - DNA, 1035 bp, Homo sapiens
aatcccacactttgggaggccgaggcaggcagatctcctgaggtcaggagttcgagaccagcctggccaacatagtgaaaccctgtctctactaaaaatacaaacattagctgggtgtggtggcgggtgcctgtaatcccagctacttgggaggctaaggcacggagaatcgcttgaacccgggaagaggaggttgcagcgagccgagattgtgccgctgcactccagcctaggcaacagagcgagactgtgtctcaaaaaaataataaccataaataaataaataaaagtgggatgaaagatgttaccagtataaactgttgggcagcacttcttcctcttttctctcatagctcctggtttctactgacctgcagagtttatgaaactgctgttcccatctgtctgttcatgtctgtctttggattgtgaaccacccaagggcagtctgtatttctagaacctgacatggtgggaggcttctgtgagagaagatgctacctgcatttttcttgggtggatgagtggtaggcttggaagatggggcaggatgctggggcgccaggccgggggtgcagtagaaaattctgctctgtgcaaactcctgttcgtcagttctgtgacagctcccctctccttctgcctcagctccttgagagaaaggactgtgtaagtgggtgaatgaaaaactaatgaacttgagctcattcatttgggtgggccagacagcaccttaataccgattcagtaagttcaagcctttgagagagacttttgagttcaaggatgttcaactctttggggtgagcaaataggcaatggaggtggttttgaggtgttcaccaaagacccacaatgctggcgtcagccttgcatgtgttccccagggtctcccgggggtctcctgctcaccagttaaaggctttccttctcagagctcattgtcgggaagagaaagccgggctcctggctggaccagtgtcctcatccacgtgacgttcctggagctggacagatcccggctgaaatctggag

SEQ ID NO: 85224 - DNA, 1048 bp, Homo sapiens
taaccgggcgtggtggtgcgcacctgtagtcccagctatccgggaggctgaggcaggagaatcacttgaacccaggagtttgcagtgagctgagatggcgccattgcactccagcctggacaacaagggcaaaactctgtctaaaaaacaaaaacagaaacaaaaaccggttcagtggttttcagtatattcagagttgtacaaccatcaccataatagattttaggaccccaaaataaaacccatacccatcagcactcagtccccatttcctcccacccaccccctttccagtgctgaacaaccaccgctctactttcggtctgcctggatttgcctattttaggcatttcatagaaatgaaatcatataatatgtgaccttttatgtgtggcttctttcccgtgacataatactctctaggtctatccagtctcaaggttgtagcatgtatcagtactttattccttttcattgctgagtaatattccattgtagagatatattgcattttgtgtattcattcactggataagggacattttagttgtttccatttctttgccattgagaataatacttgctatgagtatttgtgtgtggacatgtgttttcatttctcttgggtatatgcctagaagtggaatagccaggtcctacataactttgtttaactttctgaggaactgctggactgtttttcaaagtggctgtaaccatcttatgttcccaccagcaatgtatgcgggttctggtttctccacatccttgccaacacttgttattatttgtctttttaaaaatgtattatttatttatttatttatttatttttcagacaaagcctcactcttgttcctcaggctggagtgcaatggtgcgatctcggctcactgcaacctctgcctcccgggttcaagcaattctcctgcctcagcctcctgagtagctgggattacaggcacacaccaccactcccagctaatttttgtattttaagtagagacagagtttcaccatgttggccaggctggtcttgaactcctga

SEQ ID NO: 85225 - DNA, 1060 bp, Homo sapiens
gtgtgatgtggtgctcattgtggttttggtttgcatttccctgatggctaatgatgttgagcatcttttcacaggcttcctggctatttgtatacgttcttttgagatgtaactatacagatgttttgcccagttttaattgacaagttagttcttagaagtgcttatctggccgggcgtggtggctcacacctgtaatcccagcactttgggagaccgaggcgggtggatcacgaggtcaggagttcgagaccatcctagctaacatggtgaaaccccatctctattaaaaatatttttaaaaaaattagctgggcatggtggcgggcgcctgtagtcccagttactcaggaggctaaggcaggagaatggcatgaacccgggaggcagagcttgcagtgagccgagatcatgccactgcactccagcctgggtgacagagcgagactccgtctcaaaaaaaaaaaaaaaaaagtgcctggaaggagtgccttgcccatgggaaatgctgtgcaacttactattagggagagtacccaagacttggcacattgggcttctctcccccacgttaaggattttgggggccctgcataaatgtccaagcgtgagggaacatggtgacttcacattttctttagttttcttcaaatagtcccctacttggggagagactgcgatggtttctcccccacacaggtcatattcccacctgaccccttctgatttgatttcccccaagtccctatggtggggtgcacctgctgcctacatctggctgcctttggtgatgacttcagtgctgcttagtatctggattctgttcatctgcaagcgcccccaagaggctgctggtggtagtgtgggttgatgtgggcagagttggtgggggtcccagggagtccccccagccccttcccagcgtcatagcgacatggtctggggcttacattacccccatgttgtttttgtacagcaggaagctgcttgctacccaggtggccattcgacttcatattaaggtctcctttccattttctttttgcttaaaaatactcag

SEQ ID NO: 85226 - DNA, 1030 bp, Homo sapiens
agtagctgggactacaggtgcccgccaccacacccagctaattttttgtatgtttaaagacggggtttcaccgtgttagccaggatggtctcgatctcctgacctcatgatccgcccgcctcggcctcccaaagtgctgggattacaggcgtgagccaccacacccagccctctgagttacattttttgaaagcagcaacactcccctaaactctagaatcctctacagtttggttcataactagcaaatggtgacttgaatgagaggctttgggattggggcaatgtctttatttcccagtgctcctcttaaccagattaaaggggtgctgtgaagtttgacctagtggaggggtgggtctcgggaagcattaaacaccaagcagtggttgggttgttaggcatcgcccagcccctcatcttgtgcttttgtttctgcttaaactatgttcttattgtatttttcatgtggcaaaggcaatatctatttggtgtagaaaaattataagatatagattaggacaaaaagaagaaaacgcaagtaacagtttatcccaccagccagagtgacgatgttaataccctgtggtgtgtctgttgcctggtggacctttttctatttgcgtatgtttccactatatgcagtcatacttctttttacttaatacattgtttccatctttccactttattaaatagtcggctttgtagttttgcatggttgcatagtatttgtattgcattttgtgggtgtaccatgactccgttaatcaggcatttaaatttggacattttgctgtttttcaggttttttccactctaagctttgttgggctgagtgctcttttaagttgatctttgtgccattctcagtgtccccttcagataaattcctagatgtgcaactgtacatcttcaaggaataagcacatgtttaagacttttgacgcgtttgtatcttgctctcccccaagtcataccagtttatagagtgtgaattttttttctttgtttcctcaggtatattgca

SEQ ID NO: 85227 - DNA, 1057 bp, Homo sapiens
agcacagatagagggaacaaaccaggtatactgggagtcgtggccttgagggcaccccactgtggaaagttgcagatatcagctcgagggggctgtatttggctgacttggcaatggggaaccaggatggtgtttgaatgaaggactcatgggctcattttcacttcgaggggagaagggaggctggtagcagggtaccacgtgtctcatgcatatcctggagaaggcctgagatagggcagccgtgcatggatcagggaggcggagggaggccctagggacatgggatcagagcagtgggcaggagtgagattgtggtagggccgggggggggcaggacagggagttaggattttattccaggtgtaaagggaagctaagggggtgtgtgttgagctgggtggtggcatgaacctgctatgttttaataagattgtcccggttgctctgcaggaggcaggggtagaagctgggaacagccaggaggccttggaagttttcaggtgggagatgacgggggcttggctggaggagaggtggtggtgagaagtggccccctgtgggatccgtgtggaaggcagtgtcaccagaactaggtgggttgtttgtgggagcgaaaagaaggaaagcaatgacccgtgagtccttctcaagggtttgtgtgactgaggagcttggtgccactcattagaggacacaggtcctgtgatgtaggctggcacgatggctgcctggtccctctttgtagcactggggagcgtggtgcaggctggagtgaaggacggttggagtggtggcaggtgcagagaagaggccaggctttgctgctgaggacccctggacacactcggtgtctactgggcacacttggtgttaaaagccacagtgggcacagggggctggagaggcaagtgaccaggtaccccaggcttcctgcagctcagacgggggaactagaaagtcctctgagaaaacatgtgccaccaccaatgattctactgatgggccagacatgagcggcttgggttggagctaattctaggatgcaggaagagag

SEQ ID NO: 85228 - DNA, 1145 bp, Homo sapiens
tgagtagctagaattacaggcacgcaccaccatgtccggctaattattgtatttttagtagagacagggtttcaccatgttggccaggctgatctagaactcctgacctcaggtgatccacccatctcggcctcctaaagttctaggattacagacatgagccactgcgcccggccgttaccgtcttttatatcgatctccccataatgaactcatccagtgcacaaaccctcctgtagagccatgtgtccagcatctagtaggtctcccatagctgcctggacctgctgtcaggagtgatcatcgtaacatcaactactgttcccctgggtcagccactgttgacagctgggcaccattactgtcctcattcctagataaggaaactgaggcatagaggtgatcaaacacacccaaggtcaagtgcacagtgctagcctgagacacacaggatttgaactcctgcatcggctcttgactcccctttgtcacctccaagttgtactgaagttgaggcttaggctcccagagggtgtgggccctgggctgagtgttttatgggccttatctcatctgataagagggtgcttgtaattactcttctttcactgaatagcaaagtggacaaggagagatcaggtgactggcgcaggccgcataggtggatggaaggctggaacaggccccctcttagcacctcgctccccggcctcccagcctcagtggggtttgctgacgaaacaagcgagcacatggaggaaatgcggtccagcttctgcctaatgaatcccgctgtttcagcctgtttgcatttgtcaagttaatttgccttccagacagaaccacagaccagtgtccctgcctcctcgagggtgggagggaccccaggaccccctggagaggcacacttgaggaggcagacacaccggtctgtggtctgtaccccacagctatctccagctccaggtccagggagggccagaaggtggagcggcgggggccagtggcgaggacagtgcgccaccccccgaggctggccggctccccagctgaggcaggcgcatgaaatccgaactctggagggaaatttactgcacaataaaggaagaatggcctgctttggggacaattaaatccacattact

SEQ ID NO: 85229 - DNA, 1036 bp, Homo sapiens
tgagctagggatttggcccgtgctattggctctcaaaacaatttggaggaggaaagtgaggggctaactcgccgcaggactctcctttcctggtcagtcccttgttggattcttgcctgggagtttcagagccagcgaggcactggggttgcttactgtccccatatgtggaggagatgtccaaaatactcagtagctggtgcttctgggtaataccccggcatcggtgttgagatgctggccatagacagctgccttgctacctctctgtggaagatcagtctgccctaaagcttttgaacccccaaaggcctgttcagaggatgttcagctatggagccaccatctctccatgaggaagagcttgtggctttccccaggctgttttccctggctgtactagataactcaggacatcattgcagaaggacaatttggattcttcccgcatttgcccacagggaagctctgctgcgcagtccctccccgtaaggactcagggtcatttgcagactggaaatcccttccattagctcacgtgtaagaatattaacaaggccatttgggaggccgaggtgggcagatcacgaggtcaggagatcgagaccatcctggctaacacggtgaaaccccgtctctactaaaaatacaaaataaatgaataaattagccgggcatagtggcgggcacctgtagtcccagctactagggaggctgaggtaggagaatggcatgaacctgtgggcagagcttgcagtgagctgagatcgagccactgcactccagcctgggcgacagagagagactccgtctcaaaaaagaatattagcaaggccaatgctaacctcaaacctgtaaggatctgacatcccagaggcaggaaatgtgtcttctaaggctctctgagttggaagggtctcgatcagtctagttccacctcctccccagagccggagtctcctgtaccgtatttttctacttgaaggtctccagggatggcaaagtcactgtcccccaggggtggcccattctagct

SEQ ID NO: 85230 - DNA, 1357 bp, Homo sapiens
atggcacagatcttggctcactgagacctctgtctcctgggcttgtcagatcctcccacctcagcctcccaagtagctgggaccacagacatgtgccaccatgcccagcgaattttttgtatttttttttgtagaaacagggtttcaccatgttgcccaggctggtctcgaactcctgggctcaagatatctgcctgttttggtctcccaaagtgctgggattacaggcgtgagccaccacacccaacctaagaaatatatatttaattcatgcactcaaaaaacaaaagcaggaagagaaaggaacacactcctatttctaccaaccacagttgctacagagatctttcctttcaggctttcattaacatttgttcagttgtggagctatttaattctttcctacaaacacggatcatacttttatacatctagttttgtgggggttttttttcataataatgaacattttcttgtgtcaaatactgatcttcacaatgtttaaaagatgtccgggctgggcatggtggctcacagctataatcccagcactttgagaggccaaggtgggcagatctcttggagccaggagtttgagaccagcctggccaatatggtgaaaccccgtctctactaaaaaatacaaaaattagtcaggcatggtggtttgcgcctgtaatcccaacaactcggaaggctgaggcaggagaatctcttgaacctgggaggtggaggttgccatgagccaccactgtactccagcctgagccacagagcgagaccctatctcacaaaaattaaaaactaaaaaataaaattcctctggcactgtgttgcatggctatgcatagtgggcctcttggagttggaagtggaggcatttaaaagaaggacctcccagggttgggcacctataggtcgtttcccatttttcactattataaatgtcaactacctttgaacataaaggtaaccaccttgaaccacctttgaacatatatatttgtgctctgctccaatgactgttgtagtgcaaatttctctagatggaattactgggttgaattttgaacctacatgtttttatatttttatttatatttatttatttatttatttgagatggagtctcgttctgtagcccaggctggagtgcagtggcgtgatcttggctcactgcaacctccgcctcccaggttcacgcgattctcctgcctcagcctcccgagtagctgctattacaggcgcctgccaccacacccggctaattttttgtatttttagtagagacagggtttcactatgttggccagactggtctcaaactcctgacctcgtgatccacccacctcggtct

SEQ ID NO: 85231 - DNA, 1031 bp, Homo sapiens
tctccctggcccagctgtgctcattccctggacacccttggcccatccatgttttcacctccctggatgtgagttctctgatctctcaggaccactcttgtccccaaatgccacatagaaattcctggaggattggctgggtgcggtggctcacgcctgtaatcccagcactttgggaggctgaggcgggtggatcacctgaggtcaggattttgagaccagcctgggcaacatggtgaaaccctgtctctactaaaaatacaagaattagccgggtgtggtggcgcatgcctgtaatcccagctactcgggaggctgaggcaggagaatcgcttgagcctgggaggcagaggttacagtgagccgagatcgcaccattgcactccagcctgggtgacagggcgagactccgtctcaaagaaaagaaaaagaaaaagaaattcctggaggatctccaggggttcctgtgcttgagcagaaaagactcctgatcattgagctccccaagttaacggaagttctgggtttggccagagcgttaagggcattttacttgaggaaatagtgtcttttgggctttttgttgccaggagagcacttatggggccgggggcaggtggcacggggatagtaaacaggtttgggatgcagagctttgaaaagcatggaacttggtgttattcagaccacagttcaggctccacctctggaggcaagacatttactctcagtagcctcagctttcttatctgcaaatgggaagaatagtccctcctccctcctagggctatggtgcagattaaatgagatgatgtggaggatgtccgggcatgtagcatgcgttccatgtatggcagctattatgattatttgtgcaagtcagagaaaacagaaacactagaaccctctgccattgtcagcacacacacaaagcagagacactttctttgaccctctggttgctttggttctttcggtgagtggtggccctcaggagaaccggcccctcttgcttgaagggctcagcccca

SEQ ID NO: 85232 - DNA, 1951 bp, Homo sapiens
tagctggtgcagatatcataaatatcgttcatgctggttattgcttctcaaaacgacagaagttactagacctgctgctagatcctgatttataatcattaataaagaagcactcgcgtaacgtaaccataccatcaatctgggtctttaaagatatttgggcagcagcatttcagtattattaatttcctttgtagacctgtatattttattttagcatggggaaatgtttgtctgaggaagggtccacaggcttcaccagtccttggcacaagaaatgttgcatagctctggctgtcggcactcagagtgtaccgagccctgccagatgccctgctgagagcatctcaggcctgcacccagagtcctggtcctgggatcacacaggacttttgtgtactggtacttggggtagaagagggcagaaagtgacagtggggcaccccagcatggacattcatgctggtgctggggactctttgcctcccccagaaaggactgtagcgagggatgggggagcttgcaaacccatgtggccccctgaatattttaggatacagactggattttggagagtattggcagtgcgctggaaacttgagggaagacagattcggcacttgcacaggcatggtccacagccagcaaacaggaaaggacagaaatgcgtttcagggagtgccagaggcagctctgggaaagccaaagacagttgagtcttgcgttgtttgcagagcctttagggacttttggttgagccccatgcaggggaaatggcgaagagaagggattgaaggaagcagcatgacagggagactggatgacagagctaaggtgggagatgaggaagctctctctgtcacagcacaattcaaaggaacatcctaaattacttcagctctaggggagagcagttttgaaggtagaagacacttaaatgaaacttcgattcttgctctctttgatgtgacatttgtccttgcctaactgagactcacctggacaagattttaaggctgtgcacaccgcggggggctgaggcttccgagcaggggctgtgtgacagctcatgcaagggcaagacagacctcaatgatctatctctccatctccgtctttgtctctcactccccccatttctctagtccttgtagcttgactttgagtttctcacaaacccacaaacccttgattttgaatttttccccttccaagtcagaaatgggcaaatggggaaaaatgtggaggggagggatctcatgaggtttctacataggctacaagaagctggtataaaacttccgaggttcttggctccgccagacaaaagattccggagcagccgcttataaacactggcagcctccttttttgaaatgtcttctttgagttgtttaacttttcggactgcttttgattttgttactgtttatttcctttcctcattctgaacctttaaaagcatggtttaaaccgaagcgagcagtaaataaacacccttataaaatatcttcctcagagagaggctgagtgagcaggttggaagcctgtagcaatgtttgtagctttgaccagacctgcgctgccctactctgggggtcctcggatgcccagggtgtctgatgctctccccagagaaccggagccatctctgggacacaagtgctggaccgtggggcctcctaccacagggaggctgggtatgccttgtctcagcgtctgagacattgcaggcaggaggccaggagggccccctgggaagcggggcccgggagctcagcgctctcaaacctgtccactcttgccgtgtttgaataggggaggcctctgtgccaggctgcctgagaaaagcttgtttacttttgcctgcgtaccagaggagaattaataagctgagaatttgttctgaaagctgatggacataaccttcccctgaactcatccccttgaa

SEQ ID NO: 85233 - DNA, 1085 bp, Homo sapiens
aaaaaatcctatgtagtaacatcctactaggaaagaagataaactcaagtatccactgaggggtgacctgaaaccaaagagacatggaggggcagccagtcaaaagccactgccttttacaggtgccagttaaaggggttctggtgagtgtggttgtttggctcatggagctggcatgaccagggccacaggtggtgagcactagagaacagttagcagagctcagacccttgggtcacaaggtagccagggtgagacagggcagacaaatcagctaatcccagaatgggtgagcataaagaaacccaaaacccccactggcaaagaatcagccgaagattgttagaactaataagagaattctataaggagccgttaaacaattaacgtacaaaggtcagcatggcctgtagtaagtactcagtgaatgcatatcagttttatgataatggaaacaaaatctcaactagaataccagtaaaaatatgaaacacagaaataaatgtagcaataaagtacagcacatatgtaaagaaaagaacaagacttttccaaggaacatgaagaacagaagaaaaggagggtcttgccacgttctgagaagacaagacccaaaattgtaaagctatcagttcgcccagaaataatctgtatattagcataattctagtcaaaatcccaattacatgaaacacgattcctaaattcagccagaaaaataaatgggtgaggattgccaataatttttttaaaagaagattaatggagggtgatttgccctaccagatatttaaagatattgtaaacaggattatttaaatgagtgtggtactggtgtaggaatagagagatcactaatgctgagtagaaagtctagaaacaggccaggtgcagtggctcacgcctataatcccagcactttgggaggccgaggtaggcagatcacttgaggccaggacttcgagaccagcctggccaaaatggtgaaaccccatctctactaaaaatacaaaaatgagctggacatggtagtgagcgcctgtagtcccagctacttgggaggctgaggcacgagaatcacttga

SEQ ID NO: 85234 - DNA, 1068 bp, Homo sapiens
tcccagggagccctgctcagctcagctgaatcacccttcagtgctgacagcagttctagtctgtgtccactgttggctctcgctggagaagcctatagagagccaactggttccctattgggacagctttgttttccctgctgaacacaaaatcccctgttcactgggagagctgacaaggagaccccatggggctggcccggtgggagcagataccaatgaatgcagcgcccgaatggcttcagcttattaaaggcgaatacacaggataactctgcccgccgagtgggagatagaatggagggcacagagctgttacagcggattagcagccgcagacggatggaggcaggtgcagccttttctgcaatttggaagggtttatgaaatactgatcctgtgctctataaatccttcccttgacctcatctgggctacaggctgaaagtgggggatttcttgttcagccaggcttgatagtagcttttagtattttccctgctccctgccaactcctagaattccctgggaattttgataagaggatttatgcatgtgtccatttattcattttctcttcattcattcatcactgacacatttaccaagagcctgggctaggtgctggggttacagagctgagtagaacatggagttttatcctcaagggactggtgtactgtgtgagaaagacacagaaatagaatattctaattcagattgttaattgttaactaaatccacacgtcagcagataccaacataacctttggtgggcctgagccagtggcaggcgtcactaagagactgctaagtcttctgcagcccaagtgaatgaagcctcaagtccaacaaggtgtcttgttgcctctctggatgggctgctgttttttttaatggcacagatggcagataatagaggacgatacttagaactagtggcatagctggaaacttgagttcctctagcaaaaactctagaaagttcatcttatgaggcagaatttgcatcttgaagaaggcgtaggaggctgctggcaggtgtttctctggctcgaatgcagattt

SEQ ID NO: 85235 - DNA, 1004 bp, Homo sapiens
cccctctgtcctgtgctggagtggaaggcagctgtgttagggaatgggcccccaccggccagtgactttggatgctgaacacttgtacctctgttttctcctgtgtgtaatggccatggccgtcctaataccacccgaactgcctcttcctatgtggctgtgcagcttactcgggacattgggtggaaagcactttggtgagagcttggcaggtgtagactcatcaccattccggttgctcctgccgcagacgggctgagctccaactggggcatgcctctgaggctgaggcagcatctgtaggctgggaacagggtgacccctaggtctgggactggtggcagagcagggtctggggtgacttcgcggtagaagcaatttcctcagcagagttgacactggctggggaggactgggactgagcagctgagggtcaagagaaaattctggatgtccaggagctggttcagccagctgaggtctcctgcctccagtcaggagggctttttgcagtcccaaatgctctgggcaagaggctttaatctaattacatgctttatttgagccaatttgttttccaatccatcttgttcagcaaaaagaaagagcctgctggggactcatttgcaccctcttgttccaagtggagaagaggggttgagctcccatctcacatggtcagtgcagcccccaacctctcccagcccggccaccccacccctgagccaggctgcagactgccctgccctcggggggagggggctggggcggctcaggtagaaaaagcctggcaggcttgccccctcccagaagtccaccccagcgtgcctctccgtgccttccctttgggggtcccggtgcactaggcaggaatgacacgggatgggcttccaggccaggcagcctgggaggggatttcatcctcaggaggtcacccagcctcggaaccttcctggctcctcctgtgagagctgccctcagaatccaatgccccatatttttaa

SEQ ID NO: 85236 - DNA, 1035 bp, Homo sapiens
gctgctaatttcccctgtgacctcttttgttgaggcctgaccccagccagaggctccgcaccatgaaagccagcgcctgacacagacccagggcgcggggtgacaatgaggcctctatcggctttaatcaggctccagttgagtcttaagaatagggagaatctgtgtggtgctcagaagccctgggtggcaggagccccccgagactctcacggaggccagggtggttgcaggcggtggctgagggattcgtcaggccagggagggggtgggtgggtcggacgggggccctttgtccctcaggcctctttagaagcgcaggcctttcctgaatggccgcctgcccgcccggcctggcccatgggtatcacaggcctctggctatttagggaggcggcctcctactctgcccgccagcctattcatcgccagcctaattagtttttgtctgtgctccccccccacccccctgcagactgcgattcctactgcaaggcctccaaggggaagctgaagattaacatgaaaaagtactgcaagaaggactatggtgagtgagagtccccttgtctggggaggatgggagggggccacgtgaccagcgaggtgctggggctggggtgcagctggcccccgatgggtgttggtcgtgaagaccctgtgaccgatgggaactagccggacggatcccacgcctgggaatttctcatcttttcctccttggccctcagagacgggggcatgaggagcccagtggcctggtttctccccttcaccctcctgaggctgggacacccaggctggcctctggctttgactctgccgctgatgggctgtgtggccacagaccagtggctttacctctgtggtcttctgtgtctgcatcatactgcggggatttgacccgagtccacgtggctcaaagggaagctctctgggcatcagacaagggctgggagctccccggtgcatttccagtgttccgccaggctgtagcggggccgggagtctgcgctgtaaacggctcaccactca

SEQ ID NO: 85237 - DNA, 1049 bp, Homo sapiens
gacagagtctcactctgtcgcccaggccagtctggagtgcagtcatgtgatctcagctcactgcaacctctgcttcccagattcaagggattctcctgcctcagcctcccgagtagctgagattacaggtgtgcgccacgacgcccagctaatttttgtatttttagtagagaccaggtttcatcatgttggccaggctggtctcaaatattcaccctcaggtgatctgcccaccttggcctcccaaagtgctgggattacaggcgtgagccaccacacccagccctgagctcctttcaaaacaacccagggcccctactttcctggcttggagacgcacttcctttatcttaaagtaattgcaagtttcatttctaaatctaggtttattttcccgtgggaggtggaagtttctgcactgccctgggatgtatacagcttaacgcagcttttaggaattgactgtagacccctgaagggccttgaactttgatgcccatagcctggcagcttctgaattgatgcataatacctgccagctgctcttcttcaccctgtagaaggccagaaggcctgtggggaatggggctgaattactggggtcttaccctggcttcagtgtgtgcgtagggagtgtgcgtatgaactctctcacatacacacacacacacaataaacgagaacattttagaagttctccagattcctttagatacctttgggcctcgtcattcatttcactgtgctaaaaggtcctgaccactgtccttattaaagaagaaagccttgttcaagcagctggcccagttaggatctccatgaggtctgggtcccagggtagggctgccggacccccacggggtcagggaagggacggagctcagattctggatagtgaggcctcctccacaggtggccttcgcttctcacccctcttcttccaccgccgtttcctccctcctcctctttcctcaccagcttcctttggacgcagaggtcactgtttgctgggagcctgttaggcacccgtgctctgtcctccccgtata

SEQ ID NO: 85238 - DNA, 1052 bp, Homo sapiens
cctccaggacctagcaggggaaactgaggcagcatccacactgctttcagttctgagagagagggtcatcctgttctgtctttggttgaggggaaaccttcagccagctctacgttgggtgtcctcatgttgtctaagtcctggggcagggccccggtggcaggcacatggcaggagatccctgaggactcctgagggcagcggtggcagttgccaggcctggccacagtgagcctccagccctctgccttgtttgatatagactgggcaggggccacggtgaccccccgtcccgggtgtggcggccccctctcccacactccccggcaaggagtcaggagagggcagatgagcatcactgagaccaagccttggctctggcggcccttcctcccttcgcagggcctgggaagcatgtgctcagagctgcatttcaggaaagcagctgcagctcgtgacacgctttccacagcgggagatttatggggctgtgcggctttcatggtttctgtggggttcctattctccccctcatttgtcctggccgctgtctccgaggcagatgggtgacaagcctcccctagctggaccggcccaacaggaaggtatggctgtgtaggggaggggagaggctgaccacctcagcctccttcggagggggaagctgctgggagccactgggggcccacctcgagcagcccataaatctgcgagacctccaggaggtaggaagcctccccgcggaggtgtcccacacacttaggccttgccagggaaaggagaagggccagcagcccccagagtctgtgctgcggccactcccccagggcccagcctgcaagttgtttattcggggctgggcctttcccgccctgtgtcggttcccaacaggcagatgaatgggcagcatctataacttctgcaccggccggacagctttcctacaacctggcccgggcggggagctttgatcccagcaggaggtccaccaaatctgcaaggaggggcatccgtcagttcccatctactcctgccaccaactttctggggtg

SEQ ID NO: 85239 - DNA, 2054 bp, Homo sapiens
gtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacactatgccgtctcgcagtcttgattggtggcctgggctgtgggaggtgggcgtgtggggaggcaggggaaggatggagttttcggggagtttgaggaatatggcttcaggccgaagaactcccctgcaagtcagagcctgggttttacccagagcctcagagacagagccctaactaactcccccgagaaggcaggagaagagcagttttgcttggaatgtcctagggccttgctggccgtgctgttttgagctaaaaggttctcgaatgggacagtctgtattgcaggctgcaggaaaccactccagggacccatccttgccattccctggagttccaagacagagtggggggaaaggggtcccctcccactttgccttacctgcaacccccgggtgggcggagagccacctttgaccctccccatttgattcagaacctgcaggtagtttctgacttttacataactgg

SEQ ID NO: 85240 - DNA, 1085 bp, Homo sapiens
acccaagtctaggcccagtgggccagatgcctccaagtccacatcttggggatcctgtcccatgcttccacctagtgcaataggacagactgttgtgaggatgtgagcgtgaaccagggcccaggacaagggctctcctgtctctatggagcctgatccctgcttccagagaagctgccaacacatgcagacccaggctagccttgggatgtcgaggcccttgaagcagagttagaagaatgaaacgggctgcgtcgagacaggaggtgcaaagggctgagaggatgaggagcaggggcagcagtgaggatgagccatactgccgaggacctggattgtcacaggaaggagaaggaaaggaagcgggcttgttgtaggtgcgtgtgttcctgaaggagaggagccacgctggacaggggaccaagggctttctggtaaggcgccctgggatgcgcctcctcgtcggggtggggtggttgctaacggatcatccaacggacgatcaagaatctgcagagcctcatcttccagtcttgtgcgaaaccccaaatctctacaaacagtgtctccttggagggagccccccactttggggctcgggggaggcggcattgacagtctgtttgactttctcacctcctctcgacttgctcagcacggagccccggcaactcgtggggcgtctttgaaccagagccacggagtcctggctcagtcagactgaaaggccttttcaagcaaaacactgagccgatgtctgcacacagcggcttctgttcttttggctgaatgggctctaggcccgaccccagcactgctagctgtgtgaccctggacaagttacttcatttctgtggacccacaggcagggcagggtggataaaaagctacccaggaggttagaatgcagggacctgccgtctaggcttggggcagcgcaggccacacagggtggggacgggccgggtaggaaaaccccggctcccctttgccttcctcaaggggtgggtgacatatgagacccccaccccaaccaggccagaagtggcaagcattacccaagtggctgggatgtgtcccttttg

SEQ ID NO: 85241 - DNA, 1023 bp, Homo sapiens
agacggaggttgcagtgagccaagattgtgccactgcactccagcctgggtaccagagcaagactccgtctcaaagaaaaaaaaaacaaaaaaacaaagactcagagctctggagagctgcctagagcactgggcccagttgtggccctttgagttttgactttggtcattttcgtgctggccggaggtccctcggggtcccctacctcatggtggccagtgggttctggccaccccgcagtactctgggcatcctggggacactggattaataggcagtttgaaaccttgacgtctggcctgcttgtggaagccacatgtctgtgtaggaaatgggtgtatattcaaggccacgtgtgtccaggtagcggggaaggagtgaggtgagggctgtgcggaggagccacacaggcctgtgtctgagtgtgtaaccaccaccgtgctgctctgccccacccgagtcaccccgccaggctcagcactcctcctaggggtgccagcctccacttcacaaaaatattcctgtgggaactgctattagccctggaagcgcattctttttcatctccttggtgacaatcaactctcatctttcagggctgacacatctttataagcagccagaatcaagtctgtggaataaggcaggtggggcaggaggtggtcgggctggaaagcactgtggagggttcagagggatgagattaccgtggcgcctcacctggctccgacagagccctgtgtgttgagtgtgcgcagcgcatgtgtacgtgtgtgtgtctcagaaagggcagacggatggggcaggcctgcggaggacgccaggcccatggatggctgagttcgtgttagcaggggtcagggggccaagcaccatgtgctctctcttatacgtgtggaaagcaggctaggccagctggccttgctctgccctccaggacgaaaggggaaagaattagggttgatgatgggtgatttccaaagcacaagatttcactgagaagaaggtaggggattcacagc

SEQ ID NO: 85242 - DNA, 1050 bp, Homo sapiens
gatgtccatcactcaagttcattttcatttatttatttatttatttatttatttatatatttatttatttatttatttatttattttgagatggagtcttgctctgttgcccaggctggagtgcagtggcacaatctcagttcaccacaacctccgcctcccgagttcaagtgattctcctgcctcagcctcccaagtagctgggactacaagcgtgcaccaccatgcccggttaatttttgtatttttagtagagacgtggtttctctgtgttggccaggctggtctcaaactcctgacctcagatgatccgcccgccttggcctcccaaagtgctgggattacaggcgtgagccacagcgcctggcccattttcattttttatagataatgtgtgccctgtcatgcctttcctggggcacagtttgtctaattcacagcatctgtggtagaaaaattagcagcttagccaccactgtattaataatagttccactagacccacccaccatgcgctaaaactgtactatgaaaggtctctgcagctcttctgtggaagagcattcttctatcttgtctctgtagtattgtgggttggcattggccactttttgaattttcttactcattggccttcttgccacattttctcagcttctccctctctgctgaccactccttctatgcctctcttgactcttcttatcccttccaaaaattcaatacatttactcatttgttttatacacacacacacacatgcacacacgtgcgcgtgtgtgtgtgcctctttcctgtgccaggctctgttctaggtacgggggatatggcggtgaacgagaacccacagtccctggtgtagatgttcatgtgtccaggagagacagacagtaactgagtacctaaataatgattcaaggccgggcgcggtggctcacgcctgtaatcccagcactttgggaggcccaggagggcaaatcacttgaggtcaggagttcgagaccagcctggccaacatggtgaaaccctgtctctactaaaaatacaaaa

SEQ ID NO: 85243 - DNA, 1073 bp, Homo sapiens
tcacccaggctagagtgcaaaggcgcatctcggctcactgcaacgtccgcttcctgggttcaagcgattctcatccttcagccacctgagtaattgggattacaggcacatgccatcacgcccagctaatttttgtatttttagtagagacgaagtttcaccatgttggccaggctggtctcaaactcatgacctcaagtgatccgcccgcttcggcctcccaaagttttgggattacaggcatgagccactacgtccagcctgaagttgcatttctaacagtctcttcagtgatctgtgctcctggtcccacgtcacactgtgagttgccatgctgtaaacacaaacatttctgtcgttaggtgatttttggtaatgtcttgagaatgtctcccaatagagggtgacaaaaagttacaaggaatgaatgaaacatgaactgaggcgatttgattcaatacaaaatgggcccagttgtctgaaattgtgagtctaaaatcatctgtgataggaacccatgagcatctggtaaaatcccatcatttcactacaatgcaactctgttcatttaattgcaaagtaaatacagaacatattctcctagaattttaaattcatatcactaatggagaatatattgattttgaatttagcaataccaactggacttactttactggaatgctttacagttctttaaaaccactactccttgattacctattctattgataatttgtatgctttcattcgttcatttcttcactcattcattcatttctttaacacatatttactgagcacttactatgtgccaagtactgttctagctgctggaatattcccatgttaactaccatcaagtaagaaagtcctttgagactgggcacggttgctcacgcctgtaatcccagcactttgggaggccgaggtgggcagatcacaaggtcaggagatcagaccattcctggctaacatggtgagaccctgtctctactaaaaaatacaaaaaaaaaaaattagccgggcgtggtggcgggcacctgtagtcccagctacttgggaggctgagg

SEQ ID NO: 85244 - DNA, 1110 bp, Homo sapiens
gtcttcacccagctttatttacttttagatctcaacagatcacctcatcagaaagccatatctgaccaccccattaaagtaactgttgtcataacatcttgtttatttccttcttaatgcttctctatgatttgtaatcattttattgtgtggttgtttgaatgtctgactcccccattagcctgtcaattcctcaggcacaggtatcatgtctatcttgacccttgttgtattcccagaacctaacatggtacctggtacagagttgggtagaagcagatggaggctgactggcttctgtgtattcagcctagatgccttcatgagccattgagaccctgccttcactcattgagaccctgccctcactcattgagaccctgccctcactaaccttcacccactatcatttccagctatcccttctcttatacctccatccacaccccgtgctccagagaacttcaggtcctctcatttgagaaatagcggtagggacattctccagagtgacaaggaagttaaccagaaaaggatgtgttccttactcatttttaagtcatgaagatgttcatccgcattaaacctactgacgctgtaaactctagatttgaaatagccatggatgttaaaaggtgattctggctaggcacagtggtatgcacctgtagtcccagctactccagaggctgaggcaggaggatcgtttgagcccaagagttcaaggttgtcgtgtgttaatgatcacacttgtgaatagccactgcactccagcctgggcaacatagcaagatctcgtctctttaaaaaaagaaaaggtggctgagtgcagtggctcacacctgtaatcccagcactttgggaggccgaggcgggcggatcacgagatcaggagttcgagaccagcctgcccaacatagtgaaaccccgtctctactaaaaacacaaaaaaattagccgagcgtggtggtgggcacctgtaatcccagctactcaggaggctgaggcaggagaatggcttgaatccaggaggtagaggttgcagtgagctgagatcgtgccactgcactccagcctgggtaacagagcgagactccatctcaaaaacaa

SEQ ID NO: 85245 - DNA, 1014 bp, Homo sapiens
cacagttaggatactcacagtagaggtgggtctgcacccagccccccacccaaacaggaaaatttcccctgtggctcactacccaaaagacaagttctctgtaatcccagtggaagaaaaccaaatatcgtgctgtcaaaacttgctcgcagcaattccaagatttctagaactaggctcacgatcttctccagccctgcttttcttctgttttctatctcaatgagcaagaccaccaaccactccatttctcaggccaaatacccaggaatcatccctgcttctgctcagcccctacatctcgtccgatgccagttttcaccaattccacctcctgagtgtctatgaaatccacaacactgcttttccttcccacagcctcaccttgacttcagcctctgtcatcttctggatcactcctgtcacttcctgcatcgccttcctgttccagttctgccccctctagtccattctccacgttgaagtcaggaggagctttggaaaatgcagatttgcgtctgtgaaccctccccctccaccattacttcttcccgctgaaacctctcagagcctctctattgcccagattccttgtcacacctagggccctgtgcaatccactctcctgcttatctgtggcccacacacatagacacacaactctgcatccaacatctttgtaattgttactgaggtgtgccctactgtgcctccacatcaatttccttacgacagattgtgctttcttaacctgtctaagccttagtttccttgcctgcagattgagaatagtcctagttgcctcacagtaatttggcaggttcctgaaagatcctgttgctatttgagttaaatgtttatattaacatggagagaactgacaggcacacagctctgagtcttcccatccagaaatatggtatggatctgtctttgttcatattttcttttacggttcctcagtaaacttgtggaattttcaaaaagtcgttctgtccatttttgttcattcct

SEQ ID NO: 85246 - DNA, 1038 bp, Homo sapiens
attgtttatctccgtatctccagggtgcagaccattgccttaagtgaatgctgtatgaattgagaagaaaatattttattttctccgtagtttattttctttagctaagacgatcagagttaaacctaaccttttttgcttatttgttttggtgagccgtcttgtagttgatcattggtttattaatttgaagatttacacaaggcaagatgctgattttttaaaaaaggaaaacttagagacaaaccatacaattgtacatatctgaaaagagctgtgcagatcccctgtatcctgctgaggaaatttcattgcataaatgggttactattagttgatggaaaaattaagttaactggaatccccagttcactgaccatgccagttaactgaggtatgagtgtcctgtttaaactctcagagctattaaattaaacgatcatgacatgaaacctcagaaaagtcttattgttgtctagaaagattgtgtacaggtgttgctagcctactttagaataaaaaaggcttcagtattctcaaaaatcatttcctctcccgaggaaatacaccacagtaaaacagccttttccagtactgtaattgctggctttctgcttcaaaagaaaatcctcgaatatgattcaggttacaatttccatcagacttttctgagtagactataataattttgtgtttgattaataaaataattccagaaatgaaaagaaatagaatttaatccatagagaccaaggttgttggaaacatgcagttattgaaaacattgcttttaattttgaaagatgcatacagttcaaccttattaaatgaaaagaatgtcgttctatccattgcgaaagctccacattccaagttctcatggtacttttcttgagtttatactttaaccccagtgacatgaaaacactgagaattctatttcttttatttgtttgtttgtttgagatggagtctcgctctgtcacccaggctggagtgcaatggcatggtcttggctcactgcaacctctgcctccc

SEQ ID NO: 85247 - DNA, 1091 bp, Homo sapiens
tttatccaagcctggtagtcccaaacagtgatcaccctggttaaataaatacaaaaaggcaaaacatcttttggaattgttacatgctggttatatcatgcctgaaaattgcaaatgaaactagtacatgtaccaatgcctggtcataaatgaacacattgtttactacaaattctgctgaaataaacctgtcttcacatacagttgctaaggcacttgtgcttagaaaaacaaatactttaaagacaaacaataccttcacattttcccttcaaaagtgactaatttactcaatacttctgaaaaattgtaacgaacttcttctggaatccccatattaccgcatcccacacttgccaataactatatggagcgctttggaaacgccgagggaaatagcagacttggtaaggcttaaaaaaaaaaataaggcaagatcatagatgggatgaaaaactcaacttgaatgcttccccgtgaagtcagtctacgtttgatccaaatggttgaactccaaaagcacctcagcagttcagctctcttgatttcaaacccctgcccacatggctcaaatttgcaacttaaatattcggtatgaaaacgaaagttatttaactgttagcacaggctctcttctccaaaagagagtaggaagggcatacgtttcggcccacacacatacgccgatctttgacttctaaatatcagggcacaacacacacaattattttggctttgggagacaacactgtctgttatgttggggtgggtagttacaaaaaaatattgtcttgaacactgccagagctgacgattttatgcatgtgtagtacaaacggttctttttcattttggaaagaaaaagcacttaaaaaaggtttggtagggaggctctgcagcgatatttcacctcaatacatctttcaagtttgatagcttgtaagctcacggctttggttcttgtcttcaaccttcagacaactctaagctggctacagcagctgcagaggctgagtctttaaatgaaataaagaaataattgcttcagggaacaaagggaagcaaaaaaaaaaaaaaaaaagtcctgttag

SEQ ID NO: 85248 - DNA, 1024 bp, Homo sapiens
ttttttttttttttttttgagaccgagtctcactcccatcgcccatgctggagtgcagtggcgtgatcatggctcactgcagcttcaaattcccaggcttaggtgatcctccctccctcctgagtagctgggactacaggtacccaccaccacacccagctaatgttttgtgtttttagtggacacgaggtttcaccatgttgcccaggttagtcgtgaactcctcggctcgggtgacttttcggcttcggcctcccaaagtgctgggaggtgtgagccactgcgcccagccaaaacatactttttaagaaaggcaagctttttcctgatactgaatatttaatctcagtaattgaagcatataattctacagtgattttatacaacacacacaaactctatttggttgacagtaatatttgttcgggttgattctacttctggatcctcatttcttcctagaacttgttccatgttcaccatggctatgcaacattccctttttgaagctgaccttaggtagtgcggaaacccccaaagggttgtctttttcagcagaggacattagacaagaatgagcctcccaggggacagggttactgcaccctaataagaagcatgtacgtcctggactgggtggcaatgtgtgcctttccccttttccaaacaggagcttttggtagcatcctcagggcatttgtctacaggtatatatcggatatattggaaataactaaattacttggtcataatatggagaactatttatgaactgggttgagaagatgaccattaaccagagatctgggacttgtaccacagaggcccctccttccctcgctatactgtagcaagatgtgatttgagatttttctcccgttgggaaggaagtgaatgcagttttggttgtgcttgggataattatattttgataaatgtatcaaatttgcttgaaattgtatatacctgtgtgtgtgtttgtgcgtatacgcgcacacgtgcttgctgagcagccaagaggaga

SEQ ID NO: 85249 - DNA, 2613 bp, Homo sapiens
ctctgtgctcacgtggcctttcctctgtgcatgctcagagtatgcaagttcagagaaggaaagagccctctggtgtctcttcctcttcttataatgacatcagtcctattggactagtaccccactcttatgacctcattttcattttcattacattttcaaagttcctgtctccaaatacagttacattgaggatttgggcttcaacatatgaatgttggggtgatacgattcagtccataatgcttaccaacactagagtttccctggcccctagttcttccttatgtttcatcaatgaagtaccctcctctgcacacaccttcttaagaatcctttcccatgcattcttcccatccctggaagtctctaaggagcgattcctgattcctgtctgctccttgttgtctgctctaaagagtgtaagactgccaaagctcctgtttatgaaacgcctggcttcagatgttccaccctcactcagagctgatcctgatggagaagcaacagttgccttccatgcaggaatcttctctttcagtgattctgttgtatttccagctttcctgagccattgaggcccaccatagggttttgcacatagtaagggctcagaaaatacgagttctcttcctctttcactttatcaccattaggccttccagccagacttcatatctttcctttccttcctatcttgtgttacgccatctctctcactaagagttctttgctgaccctggggccaaattagcaagatgtgaccaacagcactgcaatagacatcagaagacccaaaccctaggccacctctaggctagccgtggaatcttcatcatttgcttcatctataagatggagaaaataagacttgggccaggggcagtggctcacgcctgtaatcccagcactttgggaggccgagacgggcagatcactaggtcaggaaatcgagaccatcctggctaacacggtgaaaccccgtctctactaaaaatacaaaaaaaaaattagccaggcgtggtggcgggtgcctgtagtcccaggtacttgggaggctgagacagcagaatggcgtgaacccgggaggcggagcttgcagtgagccaagatcgtgccgctgcactccagcctgggcgacagacagagactccatctcaaaaaaaaaaaaaagtactataaatggtgaccacataaaaagttaaacatgacatctggggttactgcaaagcttaaaatggataacatatatgtcacggttctttgcaaagtacaaagtgtcgtattcacttcaaaattaatgacagtattctatttttatggtaacattttctgggtagaccgccggaccttcttacacctcctatctcactgtcatcacttatccaaggaccttaatcaggtctttgagaattcttcatagctacctcatgcccaagttataatgttctcattaaaaaaaaaaaaagtctctaaaattccacatcttctgtgaggtcctcataagctgattacaggtaggggatgacttccccaggaagccgtgtaaggcagtggctgcagacactgttttgaggggtctacaatctgactttctggattggaatccagctccattggttaccagctgtgagacctcgagcatcccttagatactcctagaatactgcctagaaactagaagtattcatgggatctacccaacattgggagatttgtgagggtgaaatgaattatagcatgtgtattcttcagaacaatgcttggcactttgtaaatgctctcactattcattattatttttctttatctacctaggagacatggaggtccctggctgctgtgtcccagtggttatttagtgattgtacccaattcaataatattggtgaaatgaatttaaatttgcttaaccaaccagtatccatgatgataccggatattcatgttttgttctattttctgtcaggttactttaatctgtcttgaaaataatcttcctagagttgcttgctggttgggtgtaaggccttgtgtttggagagaagatggggggcatgagagctgaatagctagtggcatctgaggacttggggcatgggaactgcagagcacattcttagaaacagccagagagcattcagcgaggggaagacttgttggctcaagaggaaattctgctgcttccaaaccagcttggtgaagcaagatgattctgcaagccctagtaagccagggccaggactgtgagctgtgctgctgaaggggttcaatgccaaagtaaagaaaggggattctttttagttggaggtgagaggaggaaactccttcctgtaggcctcagaataaagcatgctcgagattagccattagcaggtagctggagaaatatgagtgcctcctctttattttgtctgctgtaaagttatctttctgaagtctgtgttgtgttatgaaagagacaagtttaataaacagattctatttttgttcaagctgtggcttagaaaagcaccataaatctctgaactgggaacccactgggctctgtatgcctgtcactctcccttccaccacacggtggtgacacacctaagctgcaggtctcccacg

SEQ ID NO: 85250 - DNA, 1028 bp, Homo sapiens
gtgagactcttgtctcaaaaaaaaaaaaaaaaaaaaagcgtaagaatgaagacggacgcaggcaatcccctcttttccttccaaatcatcgaggttttgtggctgaaatacagttcctcggtttgcttgggaaatgacatgcagacacagtaaggctcagcattctgtatagcatagattgggaattaaccatgtgaccacatttgcaccatctgaagttggaattcacaaaaaaaatgtggaaaactatgatgagctatgcatccgggagaaaaggtcactgtgcctgcgtgagtgtgtgttggagaaggcttgtgttggtcaccagtgccatctgaagtccagaagcagatgtgaacccaagatggcctcagactgcaaactcctaggccaaagggaaatgaccttctaccaacagagaatcaaggaaagtgagagagggctcgcaaaacaccgacaagagaaaaaccaggtgggaaggtgagtgcatctggctaattggtcacagactgtaaattcccctcaagcatcttgttttaagccacatctgctgctgctacttagaagagcctggatcttctgaggagttgcaaaggaatgcttgcaaggacagatgctactcaggtttggtttggttttgttttgttttgttttgtttgtttttgagacagagtttcgctcttgttgcctagactggagtgcagtggcgtgatctcggctcactgcaacctccgccttctggtttcaagcaattcttctgcctcagtctcctgagtagctgggattacagatgtccgccaccacacccggctaatttttgtatttttagtagagacggggtttcaccatgttggccaggatggtctcagtctcctgacctcaggtgatctacccaccttggcctcccaaagtactgggattacaggcgtgagccaccatggctggcccggtttttttggtttttaaagtggaataacagaagtacatttgctcacagagagttacttggaagagggaaagacaaagca

SEQ ID NO: 85251 - DNA, 2150 bp, Homo sapiens
aagccaacttaaggaatgcaggacaaactaagaggtcagtgcatttgaaagcatataaacagtaggtttattaataaatataaaaactatctatttgaaaaggcagattaaataggcaaatgtctgccaagtattttggcaaaaaagaaaaaaaacaaaaccaccatattaaggatgagaaggggtatataaacacagatgctgagttaaaaattagagaatactatttataaatttatactaattaacggttcaatgatcttctagaaaacttcaagttcccaaaatagtttaaagagtaattagagaacataaatggaacagtaactgagaaagaaacaggaggagtgtacaaagaattatcctccccaaaatactctggtactaggcagttttatgggcaaactatttcaaactttccaggaaaaataatttctatgttatataaactatttcagaatacagaaaagaaggaaggcatcctatttcactatatgaatttagaataactctaataaccatacccaacaaagataacatttacttacaaatctggatgccagtctcacttatgaatatagttaccctaaaatgccctacctaaaacaatagcaaaataaatctagttttctatttaaaaagtaaagcactggccgggcgccgtggctcatgcctgtaatcccaacactttgggaggccgagacggacggatcacgaggtcagatcaagaccatcctggctaccacggtgaaaccccgtctctactaaaaatacaaaaaaaaaaacaaaaatggccggacatagtggcaggcgcctgtagtcccagctactcgggaggctgaagcaggagaatggcgtgaacgcgggaggtggagcttgcagtgagccgagatcgcgccactgcactccagcctgggcgacagagtgagactccatctcaaaaataaatataaataaataaataaataaaataaaaattaaaaaaaagtaaagcactgtgcccaagccaaattaatctcaagtgtacaaagagaggttaatattaggaaacatattaacatgattcatctcattaataaatggagtaaagccttgtaatcaccttagtagatactaaaaaggcatttaatagagctcagtatctgttcttagttgttgttgttttttaaaaattactcttcagaaactaggaattaaaggacacacactgtattatcatgctaaataataactatcacaaactaaacattactaatcattttgcctaatggtgaaaaactagaggatcagatcaagaacaaaataaggggccaggagtggtggctcacgtctgtaatcctagcactttgggaggccgaggcgggtggatcacgaggtcaggagatcaagaccattgtggctaacacagtgaaaccgagtctgtactaaaaatacaaaaaattagccgggcgtggtggcaggctcctgtagtcccagctactcaggaggctgaggcaggagaatggtgtgaacccgggaggtggagtttgcagtgagccgagattgcatcactgcactccagcctgggtgacagtgagactccgtctcaaaaaaaaaaaaaaaaaaaaaagaacaaaataagaatgtcccatctcataactaatacatatcattaatttggaaggcacaacctctgcaatatgcaaaataaataaagaggaaaagccaaaattaacatcttacttgcaaatatttccagttgtctacttggaaatttcaagagaatcaactgaaaaactaagaacgccaagtcctttgccagatataaaataaatatacaaaaattgtattctcatataacactcataaccaggtagaaaacatcacagatggagaacagattgcattcacgatagctataaaagctcaacaagaagtagatctacgaagaaaactacaaaacatttctaaggttcaaaacccaactcaaactagctgaagcaaaataaaagggggaggggagtttaccataattgtgatttggggaggtcatgactcacaggttttttaaataattggggaattttctttttctttttctttctttctttctttttttttttttttttgagatggagtttcgctcttgttgcccaggctggagtgcaatg

SEQ ID NO: 85252 - DNA, 1053 bp, Homo sapiens
cacaccaccacacctggctaatttttgtatttttagtagagatgcggtttcaccacgtgggtcaggctggtctcgaactcctgaccttgggatccgcccacctcggcctcccaaagtgctaggattacaggcacgagccattgcacccggccgactcctcctctttcaaaatcttcaattctgttccatccaggaatgtctactcccataagtgaagtacagcaatttgagatatcaaactaggattgtgttctctactgtcttccaagataagtctagtatagtatttagactttgggttccaaaatcagtgtagatctgaatcccagctctaacatcgagaccttgggtaagttacttaacctctccaagcttcaggtatttcatttataaaaattggaatagccttactataaatcaaatgagaacagatctccgtggaccacccctccccaaccccacaagattcatctcagcccatcctgtcccactctcctcccaaaacaggtgcacactctttgctcacatacaaaagcagctccaagaattttgataaattatagcctttactgaaggttttgtattgagacaagagcaggttacattgtacctcacaaagcagatcttcactttaagcagacaggtgggggcaagactgaattcctccaggtagtgaatagtctatttataaggaagaagcagatgtgttttattctatcaaaaaggctcagctttacttagagagttagcaattcctcgcgtatttccaagagcgattttaagtgagtgcactgctgtattttggaatgcctgaggttgcaatctgaatctgcaattcagtagctgggagtagaaagtcaacgctgatactaacagtctccaccacgaagttctcttattaggattttggttatcagggtgcctgtttttttgtgtgtgtgtttgtatgttgttttttttcccccttttgccagaaaaatgagggttcattttctgtctccagctcatggttacattcatttaagttactttcctagactttttctttccgaa

SEQ ID NO: 85253 - DNA, 1099 bp, Homo sapiens
ctgagcaaggggcctgcacaccttcaccttcctcttagctatgaccagctgcaccctctgcctcaggatcagcacgcttcggggtctgctgcttccaatctgaccctaggccctctgagccctctccctcccctccaccctattgcccttacaggatccaacctcttccctcccaaataaatgacagctgccttattccctcatctctgcctctttccctgctctatcatgtctggcagcccttggccaactctgtccagttgccatttgcttggctgtgacgggctcctaccgctcactttggcattactttgcctcaggcaggcagctccagctgcaacggcctgagtggtccgatgggactcgaagtggctctgcatcctcccccatttggcaccgaagcttttctgcctctgctcacatgcctgccattcagacccaggtgggtgggctacattgtgggctttccaggggattcttcataattgggtctttctgctcttaacacgctcatggccctgtcctggatccagtgtccctcacccagtgactggaaaatcacccagccagccaagtggcactgtagaaatagccgtgatgccagagagcgagtgatttagtttcagccaggagttcatttcaagtgttggaaaatgagctggtcctgactctcttttctcttccttcagcccttagcaaaatgtagaatattgttgccattgattgaacatgcctataaaaggaggtgaaagtaatttcctgtagcatcctcaatgcagatgtttggcactttggttgtttttggttttcgtgttttgttttcgctatggccataatgtttctgtgggaacttttctaggtagtctgtagatttcagaatcccagagcaccttagtcccattatgctctgggaattcattagggactcagacaccatctttttttttttttttttttttttttttttttttgagatggaatctcgctcttgtcgcccatgctcaagtgcagtggcgcgatctcagctcactgcaacctccacctcctgggttcaagtgattcttctgcctcagactcctgactagctgggactacaggt

SEQ ID NO: 85254 - DNA, 1152 bp, Homo sapiens
gagactcgatctcaaaaaaagaaataaaataagagatggcagaggagagtaagtggtccctaggattttgaggagtatactacttggctcatcctctatcccagtatggacattgaaataagttatcaacctcctttgaaatactaatgagctctttttcttccacaactcaagcagtgttttgtattctgggaaaaagccttttctctttaatttttgtgcttcaaagtttcttttttaaatggatgtatattttcctgtggaattctcaagatagtttttcatgtgtgtttgtagggacgacatgttttagaaatttctttccaatcctcttaggcattgtctgagagtttttctgacgtgtaaagctctcagttcccttttattgtttcctgagctgttaggactacctcattccattttactttaaacttaacattttccagggaatgattggaattgaaataggcattcattcaaatgttcagaacttcatttctcctgcacccacttctggctgtggccttgtaggaataagaatggaaactaacaaaaagtgataataaaaggggaagaccttggtgagtaaatatcaaacataccatttcaccctgaagctttttttttctagctatatttactacccctctaaatacccagttagaaattgaaagtaggctgggcacggtggcttacacctgttatcccagcactttgggaggccgaggtgggtggatcacaagatcaggagttcgacaccagcctggccaatatggtgaaactccatctctactaaaaacacaaaaattagctggacgtgttggcgggcgcctgcagtcccagcaactcgggaggctgaggcaggagaattgctttaacctgggaagcggaggttgcagtgagctgagatcgtgccactgcactccagcctgggacacagagtgagactccatctcaagaaagaaagaaggaaggaaggggaaggaaggaaggggaaggaagggaggaaggggaaggggagaaagaaaggaaggaaaggaaagaaaggaaagaaatctaaagtattgtctattttcctcattcctggcatggtcgttttgcacctatccacctgtgaagttgttcttggcagatggatcttgatcattcctt

SEQ ID NO: 85255 - DNA, 1067 bp, Homo sapiens
attttctggaaaatcaggagttgaatgttccatcctgtgaatttaggatttaaatgatagaaaaccatgctagtgtttatcatgttttccttttgcagataaatttaagtactataaattcccgttacttaacatagccagatgcctttaatatcttctaattttcattttgtgaaaatgttcagtgaaacaaatttttaaatggcattttcccagatcgacattagaggacaagtctgtttgagagggctattaattgctcagagagtctgcatgttggggaaaatcacagccctttccagctttgataaatgagagaaggtcacctgagggaaaggagcagctgccctctttgataggctgagaaaacaggagttactggcctcggcaggtgtttggagaattcccacgcaggtgcacattccaaatgaactatttattacacgtgggcttctgtgacatggtcatctttcacccattcatcacatttttattgaatcccttcagcaatgctgtgctatgggaggatcccgcggttgcgtcagccttagagtcctaccttcaagttgcttaaagtccagcaggagagagaaagaaacaccacaatcatgctcatacaagacagaatctcatcagtgtttcttagctcctaaatgaccaacttaaagcattcataataatagtcagagtaagcagtatccatggcgctttcaaagatacataatgtctctttcggtccttacgccaattctgtgggaaagtttgattccagtcttgtctgtcttatatatgtgatgacagaagccgggcacattcctgtctcataaagaaaaagccctttctgagcataggccaatagacagagtacacagcaggaatgaggagtccttttttttttagatggtgtctcactctgtcgcccaggctggagtacagtggcgcagtggcgcgatctcggctcactgcaacctccacctcctgggttcaaggaattcccctgcctcagcctcccaagtagctgggattacaggcacctgccatgacgcctggctaattttttgtatttt

SEQ ID NO: 85256 - DNA, 1394 bp, Homo sapiens
gcatgggaaccagctgtgaaatgataaatcaagacctctttaaggtccaggattattttggcatctttcacatgagaggctttaagaagcaggaatatggctaaaagcatggggtttattttaagagagaaaacagttacaatgatcagtttggctgtttaaatagacgtagcttcatcatggctccaatgtggctgttttgcacctagcagtagagagaacagttctaattaacccctttcatctgattttactgtctctgggtaaactgagccccatccatcattccaaaggctctataaaaacttggagtggttgagagtacccggggcaacagtgtggtttggtttctaaggctacgtatcgaagaatcacatctccactgcttcttgaactggagcagaagcatttctgggttttgtggtccagatcctcttggggcatgtttttcttagaaaccttctccatctcctggctccagctgtccttaccactcagtgcatcctcacatttgcagctttttttttttttttttttttttttgagacagtttcactcttgtcaccaggctggagtgcaatggcacaatcttggctcactgcaacctccgcctcccgggttcaggcgattctcctgcctcagcctcccaagtagctgggactacaggcacgtaccaccacacctggctaatttttgtatttttagtacagacggggtttcaccatattggtcaggctagtcttgaactcctgacctcatgctctgcccacctcagtgtcccaaagtgctgggattacaggcgtgagccaccgcgcccggccatttgcacttttatctgcacatctgtctcttgatctccctgtcatttcctggcactcaaaaagtttaaaccaaattcatcatttgcaacccctcaccccactatcataaacacacgcgccacacacacttgaaacccagacaagaagccagcccacaccggtatttgtgtttggcaccactgttcttcccgtagctctggctggacaattcctttcctatgtggagctctttctcctcctccagtgcctactgcccctcaggccatagcatgtcttgcacgcttagggctctccctttgcattttctctgtcaccattctctgaagggccccccactggatcatcctgaaacactactcttatcttgccaggcccttgttagtgtaaaccttggagagctccaacctggctctggagcaggggtccccaacccctgggccaggactggtaccggtctgtggccttttaggaactgggccgcacagcagcaggtgagcggtggttgagcgagcattaccacctgagctccgcctcctgtcagatcagtggcagcattagatataggagcgcaaa

SEQ ID NO: 85257 - DNA, 1031 bp, Homo sapiens
aggcaactgaaataatgtggatgaggattttctgagccttcaaatttttttaaaggacttctcagtctggaaagatgaaatttgaatagggatagaaagtttattagattatgaatggtttggataggctatacattggttcccatattcttttttttttttttttttttgagacagagtcttgctctgttgcccaggctggagtgcagtggcgcaatctcggctcattgcaagttctgcctcccagattcatgccattctcctgcctcagccttctgagtagctgggattacaggcgtccgcaccacgcctggctaattttttgtatttttagtagagatggggtttcaacgtcaggatggtctcgatctcctgaccttgtgatctgcccacctcggcttcccaaagtgctgggattacaggtgtgagccaccgcgcccagcaggttcccatattctacaatgttcatatgtaaaagaaataccacctgtcacacaggataaattccttcagtttagtagcttgcagttacatactatccaaccaccattatttatttcacaaaagccttcacacacaccatacaatggaatattactcaaccacaaaaaaggaatgaagtagtaatccatgctaaaatataaatgaaccttgaaacattatgccaagtgaaagaagccagaaacaaaaagctatatattatatgatttaatttatataaatgtccagagtaggcaaatctatagagacagaaagctgatcagtgattgccagggactggggagttgggagaaatggagagagactgcttaatgggtatgaggtttccttttgggctgatgaaaagttctagaatcagcctggccaacatagtgaaacccagtttctactaaaaatacaaaaattagctgggcatggtggcaggtgcctgtaatcccagctacttgggaggctgaggcaggagaatcgcttgaacctgggaggcagagttttgcaatgagctgacgtcgtgccactgcactccagtctgg

SEQ ID NO: 85258 - DNA, 1051 bp, Homo sapiens
ggcagatcacgaggtcaggagttggagaccagtcaggccaacatagtgaaaccctgtctctactaaaaatacaaaaaattagccaggtgtggtggtgcgcgcctgtaatcccagctacttgggaggctgaggcaggagaaacacctgaacctgggaggcagagattgcaatccagcctgggtgacagtgtgagactccgtctcaaaaaaaaaaaaaaaaaaaaaaagacaaggaaatcactacattattatgacattattacatataaccacattaaaaacattcattattcaccatttaacattggcctatatagatgttcattatactatcttttcggcttttctgtcaggttgaaatctttcaacataaacagttggagagaaagatggaaagtatagacgatgaagctgcccatgggttagtgccttagttcccatgttaatatttttaatatgtctaaggagtgaaggaatgcctgatgaaatttctttctaggtctgctactaatcagcacttttatatctcatcctgaaagataggaagattttaaaagataaaaacattttaggctgggtgtggtggctcacgcctgtaatcccagcactttgggaggccaaggcgggtggatcacccgaggtcaggcattcgagaccagcctggccaacatggtgaagccctgtctctactaaaaatacaaaaattagccaggtgtggtggcgggcacctgtaatcccaggtactcaggaggatgaggcaggagaatcacttgaacctgggaggcagaggttgcagtgagccgagatcgtgccactgcactccagcctgggcaacagagactccgtctcaaaaaaagaaaacaaaaacaaaaacaaaaaaaaaaacactttagtgtgagcaagatgtcgcattaggcaaatatgatagatgctaacttctagggtcaatcagaagagcccagctactcaggaaagcaacaccaactgctctcattacagtagttcccccttggtcttgctttccacagtttcagttacctgtggtcaaccac

SEQ ID NO: 85259 - DNA, 1053 bp, Homo sapiens
caagattgcgccattgcactccagcctgggcaacaagagcaaaactccatctcaaaaaaaaaaagaaaaaaaaaagccttagttccactgagaggatgctggatataatcccacccaggtttccctgtagcactggtgacccccaaggggctggggactattacatgtaagccaatcaaatacagccataatgttcccatccttaaatcacatctcctgccctggggtattgggtgctcccggagtttcctgtactcatcctcacttctctctttgtaatcttttccccctactctctcctttcctgttttctctcagttccagtcttcctcccttaattactgtcctctctatttatcatcttggtcaagaatatgccttttaaaggcctcatgcccaagctgcatcccacccttcagccagcattcctagcaccctgccatcctccggtttcttttgtgtggcctcaccagccgctttctctcctcaatgtgtcaccgaacatggggccatctggaagtgtgtttagaagataacggagcacaggaatagtcccaagaagtgcatttaaaaactgttactgtgtaataactttatgatacattctgccgcatcctcttaaaaataccttttgtatctgttttcttgtcatttccattatgccttttaaagtgggttgaagaccgtgaatgaacaactgagtggtgtaccatggctgcccttttgcaaaattgaagacctttttttcccttctgtttagagacagggtctcgctcagttgcccaggctggagtgcagtggcatggtcatacctctgtgctaagctatcaggaggatcacttgagccctggagttcgtcccctgtagctgaaactacaggtgtgcaccaccatgcccagctaatttttttgtttgtttttttggtagagatgaagtctcgctttcttacctaggcttgtcttgaactcctggtttcaaacgatctaccttggcctcctgaagtgctgggatttacaggtgtgagccactgcacctaaaaattgaagactgaag

SEQ ID NO: 85260 - DNA, 1009 bp, Homo sapiens
acctttgctgatcctctcctatcatacagggtggccgcatcaagttaaatacatgcagagttaaatcatacctgaatagagacttttaccttcagtgtgtttttattatttgaatttttttttcaaacatatatagtttttctcattggaacaaaacaagaaagagattatttatttatttatttatttatttttttttttttttgagacggagtctcactctgtcgcccaggctccaggctggagtgcagtggcacaatctcagctcactgcaagctccgcctcctgagttcacgccattctcctgcctcaacctccctagtagctgggactacaggcgcccgccaccacgcctggctaacttttttgtgttttgtttagtagagacggggtttcaccatgttagccagtctggtcttagactcctgtcctcgtgatacgcccacctcggcctcccaaagtactgggattataggtgtgagccaccgcgcccagccagagagagaatttttaatggaagataaggagaagatttggcaggttttagtatgtattagggcaggaaaataaaggaatagaattacagagaatctttacttctgggttctgtgttcaaaagtaattggtagatagagattccttatgtttttctcccaagttggcattatagctctagggctgtttttaattacatgtttgtttgtttgttgagacagagtctcacactgtcatgcaggcccgagtacagtggtacgatctcactgcaacctccgcctccctggttcaagcgattcttatgcttcagcctcctgagaagctgggattacaggcatgggccaacaccccggctaatttttgtatttttagtagagacggggtttcaccatggtggccaggctgatcttgaactcctgacctcaagtgatctgcccacttcagcctcccaaggtgctgggattacaggcatgagccactgcgtccagcctagttacatgtttaaaagtgagct

SEQ ID NO: 85261 - DNA, 1046 bp, Homo sapiens
acagaaaaatgtaaaagactgtaactttgaccatatttatataaactgcaacccccagagggttatagtataataatatatcaaataccggccaggcgcggtagctcatgcctgtaatctcagctctttgggaggccgaggcgggtggatcacctgaggtcaagagtttgagaccagcctggccaccatggtggaaccccatctctactaaaaatacaaaaaaaattagctgagcgtggtggtgggcacctgtaatcccagctactcaggaggctgaggcaggagaatcgcttgaacccaggaggcagaggttgcagtgagccaagatcgcgccgctgccctccagcctgggcaacaagagcaaaaaactgtctcaaaaaaaaatataaacaacaataataataacatagcaaatatctacctagctatcattattacaaagataaataaggcaggtccctcttcttaagttgttcttattattatttttaaacatgtcttcttcaatcagtttaaactgttcccctccccagacatacctggagtattttcaataaatgacttctccatcatgaagataatatatactaagtagtgaaatggtatagtataaagctcttaggagacctgcttctgtaatctaagagaatactgtggcactttgatgaatatattggcattgctggatattcatttcaggagctaaaatgtatgactcgctgacctttctttctcttggtgccctgaaagattcactctatcctgtaccctgcgattgctcatggggtttggataatgcgcgtgttaagtgtttgtggtcagaatatcgtttatatgtgaccacatcaatgttgtctgctttgattttgagttcctactgtggaaaagcctgtttttctgctaacagcatttatttggggagtgggaataggagcagtaagttcaaacgttgacgcttcagcttaatccaggcaaattgaagcctttgagagaagtgcaaaattggaaaacctttatttataatagaaggtggttgatagggactg

SEQ ID NO: 85262 - DNA, 1076 bp, Homo sapiens
tatatatgaacacatacaaatgcataatcaaactgcaagcaaggtgtactttaactatagggggtgggaattaagcagcccagtggagtgtaactcaattaccattcacagggcaattctatcactgtttaagaggacttgggtgcagtgtggatagcagccgccacatcatcattttacacaaaggagtgtaaaaataggttgtgaatcatgaaatggccttttgtttcgctacccttggcatatcttccttgatgggccgatgtatcagtcatagatgcttgagcagtgagagaatttctagttatgaatacagactgaactgcaaggggccacacaggagagaggcccgatgatgaatttgtttgttcagttcttaacaagggattcaagtacctctttgtgaacctttcactcaggagcacaggctttaaaatttttaccgagatttttgtgtggattttcctcccttttcctccctcaaccccaccccaatgatagcatcaagtagaaaacaatactgtttttttttttttctagcttctaaatgcaaattagactgatatttttccactggtacctctatgtattttcagatctgttacttccattaaggacatttacataaaagtaggatctttgtaattgcagtttaaatattcagtgtgcttggtcctcattagaattcaaaatagagccttgtctgagtctgacagagggcgccaattgtgaaagaccagactaagaattctgaatgactcgggtggatgtacagtcttgcttctcagcatattgactattacgtaatgttgtctaagcacgtttattgtgattttagtagtgtttcagtgatgtggttagaaatcaacccagctgacattgcattaatgctgtctcaatcgacgaccattggatctgccttcagctcatctgaatgtgatcttcttagggaggtggggcaggaccctggttaagagtagtagcatgcagcacaggtgtggcgtccgacagtcctggggcacaatttgggatctgccacttacagcctgggtgacttagagagctgcttgccctct

SEQ ID NO: 85263 - DNA, 1503 bp, Homo sapiens
atttgctcctgtgaggccgggtgtggtggctcacgcgtgtaatccctgcactttgggaggccgagatgggcggatcacctgaggtcgggagtttgagaccagcctgaccaacatggagaaaacctgtctctactaaaaatacaaaattagctgggtgtggtggtgcatgcctgtaatcccagctactcgggaggctgaggcaggagaatcacctgaacctgggagacagaggttgcagtgagctgagattgtgccattgcactccagcctgggcaacaagagcaaaactccgtctcaaaaaaaaaaaaaaattgctgctgtgattagttacaagtcactttaagtgttgattttgaaccaattttagatttatagaaaagttgcaaaaataatgcaaagagctttcttatttccctcaccctagtttccctaatattaacatcttaccactgtgttccttggactatgtatttgtgtattttttaatcctccgtcaactcaagttgactgaatactcactttttactactaggactttaatatttaattgaataatgacaaagatatttaacttttgagacttttgagttccatgtacttgtattcttttatagcttgtctataccacttttagtacagtgacttccaacatttttagatcatgcatcccattagtaggaattatgagcaaccctctcgaatatttttataattgtatctgaaaaattatatatactactgttctatatattaggttgcttctaaaaaggctgagagattaagaagtaaatgcagcatattaatggaaattttagtattttctttccacattccagtgaatcatcttgtacacccaagtttgcagattattggcttgaattacgattttggcttaaaattctccctcccttcctgacagaaatggaacctagtgaggaaacgatcctgttatgtatattgttttaacattgattatcccggactatgtaacataggaattttccgatgtgcaatttggaaacagctgaactgcttttgagaattttacaaaccaagtttacttgaaaactttgtgattaattaggcaaaacaatttctcttaaagcaaagctatggactgtgtttttcctggtgttgagaacattcgttttatagccagggattttagagtcttcatgctacaacaaaggcttttttcagatctaagcacagtatgaaaaataagacactttgcaaggtgcttgggaaagttctaagcagctcccaagtggggaagcctttgttctggaggaagaggcctgaattcaagggttaatcagagagacattgagaacatcattcactgctagtataggtcagagagaaaagttcacatctgggtgttactgaccaccaagcactttcttgtggtcctttcagaagtgatatattgttaagtatcccaagagtacaaacctctagggtagatttattggaggaaaatgctccttgtccacatgataa

SEQ ID NO: 85264 - DNA, 1740 bp, Homo sapiens
ccctgaagtactctgtgtattccttaagagaaggggccacattttttcccattcttttttcccccacatacaaaaaatggtaatatttaatgcctacaacatgatgagtttggagataggtgtacatccatgaaaccatcatcacaatctatggaggaggaacttcttatctccagtagggccaataggtagtttttgactgaatgaaagaatgaatggatgcttttcatgagtgatattgtgggccgaagagattgagaaaagcttatagtgatgaaggatctttgatttcatcccaaaccactaattgagcatctgtgcaatgcaagtgctcacgacaaagctatgaagtggaaattactatttccgttttgctgattttgaaactaaagacttgggttatttggttaagaccgtctagctcatcataagtgaaggagacgtgatttgaacccacactggcctggggtccaggcgtatgccttgtcttccacatcaaaacgctagtgtcaaagaataaatcttaggagtgcattatgacgatggtgattttgagattataaagcatttgggagctcacaaaggaagcctgtggttttgtagaggactagaactattttcacaactggtttccctgactgcatccatatctgtgtggccttaatattgtttgactcacaaaggaaacttgttgatccagagtgaaccagttcaactttcttctcctcaatctcaagagtattccatggaggaaaatgttctaaactgcacctgagctataaacaatttactctgaaggtaacagtgttagtattccagtacgtaaacctttagctaataacaatcaaagtagcctaatttggaaagtacacagaaggttagagggaaagcttgtaaatgttttcaaagactctgtatttaattctatcaccagctagcaaaataaataggccagctgctagctctgaaacagacacgtggtggaaatgaaatgttaatagttgaaatgccttgctcattcgaaaccaaaaggaacatgaagtacactttctagtttatgagagacaaggtgaaagttcccaaaacacatttgtggtgactgcatttaaaattgcttcctcatcttttattttagtggctaatactttagtgtggcctatgtgtgactagagggcattttttttttcttccgatttagatggaaggtttggaaataaatggagagtggaaatcgggagatgttaaattctacttttccatgtgtctaagttgtttgctctagtttgtaagctgcaggccagacttttctgaggaatgggaggttactttcaataatgtgctaagattgacctgagatatttagccagcacatctgcttgcaagctctggccgtatgtgaggagcttatactggaattaattaactctgtttggtattctgaaatgtttgctccacatcttgttttaccatcacaaaacttacaaaatcaattggaacttttttatttttacttaagaacttaaaaaaaaaagccaggtgaaaaagagaatctgaaaagcagttgttttcctgcttgaagcaaactttcaagaacgagcattagaatcagaatttattttttcaaatacttctttttaacttaaaatgatggtgaagtgtaactctttcatccattacattaatgccatttttgaaatgtttgattttattagaaaacaaggagattgaagtgagaggggt

SEQ ID NO: 85265 - DNA, 1090 bp, Homo sapiens
acagtggcttgttcctgtaatcccagcgctttgggaggtcgagttgggcaaatcccatgaggtcaggagtttgagaccagcctggccaacatggtgaaaccccgtctctacaaaaaatacaaaaaattagccaggcgtggtggcacatgcctataatcccagctacttgagaggctgaggcaggagaatcactggaacccaggaggcggaggttgcggtgagctgagatcactgagactgcaacactgcactccagcctgggtgacagagtgagactccatcttaaaagaaagaaactatggcttgggagtaatgtagatgatggataggagcggggttgggatggtagacagggaaaccagtcaggaggtggcttgaagtagttcagtcatgacatgatgttggcctagactggagtggttaggatgagaagatagggagagaagtggatggatggaggggaggttttaaaagtagtaggaccagtgattgattgggttctgcctcaggcagctgcatagatgacaatggccttgactgccatagggcacacaggaagaaaaacgtgtgtggcggtaaagtgagaagacactgagttcgaagacacgtggggtgctctcagcttaggtgtgtcagaaatagtatgctgcttttgaatctggagctcaggggagacctataaactggaattttagatctgagagtcagcctgtggatggtaatcaaagccatggtgccaggcgcggtatgtaatcccagcactttgggaggccgaggtgggcggatcacgaggtcaggagattgagaccatcctggctaacacggtgaaaccccgtctctactaaaaatacaaaaaattagccgggcgtggtggtgggcgcctgtagtcccagctacttgggaggctgaggcaggagaatggtgtgaacccgggaggcggagcttgccgtgagctgagatcgcgccactgcactccagccttggcacagagcgagactccgtctcaaaaaaaaaaaaaaaaaaaaaagccatggtgctgagcatagatggagaagagctcagcgtcttagggcagcgccttggggagccc

SEQ ID NO: 85266 - DNA, 1051 bp, Homo sapiens
aataagaaagaggaagcaaaatatcaaactcaaattttctaagcagtgaaacttttgttccgttttctaagaattcatggtgtccatctctctctctctctctctctgtatatatgtatatttttgtgtatatatgaatatatttaaattgcacatttgtttatgaagtattcaaaaataatcatttttggaaaaatctagcaacttgggtatttttctatttttctttaaatattcattttttattgaaaggagaacttagagatgggtttatttataaagttataaaaataatttggacatatatatcataggagttaaattatatctcttggaataggaacttttactgaatgcaaagtatataatattttcacttcattagacaccacgaaccctagcaggggtcatagctacatcagaggtaccattttatttagaaaaattttaaaaactatggtttccaaagggaattagtgcttactttggaaagttacattaaacgtggagatgatgccttgtgtaagttctcgaactgagatgtctgtcgccgtagatcacacacttagtaacaaagtgtgacatggaaagatgagacgaaatggcattgacttatgggatcctgttttttctccacagagagatacatatatgtggaatcaagttctgaccactccaagtctagcttgaagaagttgttaatgggattatggtgtggattagatctggaaaaagtgaataattcccaagataaatgctggaagggagggacggtataaacaaaggagataattttaacatatatgccagaagatttgagggcttaagtttgtgtaagcaccattgctttaagatagagtgaggaagtgatataagtaaggctgtcttattcatttttgtgttcctggtactgagcgcagggcccagaacacagtccatgcttggcaaatcttttttgtgttactggacaaaaaggcaggacctcttatggaggaaggctgcaaaagaggccttgtttcaggatgtcatttggacttcctgcattgctggt

SEQ ID NO: 85267 - DNA, 1052 bp, Homo sapiens
ggcaaagccctcattgaggctggaagagcacagagattatggtaggcagaattatagcccccactagagatatccatgtcctaggctctgtaatctgaagatgtgttactttacgtggccagagactttgcagatgtgctaaggaagggtatggccttgagatggagagagagttttggattctctgatgggcccagtgtaaccaccagagttcttaaatgtggaagagggagcaagagagtcagtgttagagtgatgtgatgtgagagactcgagcagtcattgctggcttagaagatagaaggggccacaagccaaggagtgtgggcagcccctagaagctggaaaggcaaggaaatggattctcctggagcctccagaaaggaagacagcctttctgacacgttgattttaacccacggagacctacgtcagacatctgacctctggacctataagatgataactttgtattgttttaaggcactaggtgtgtgggaattggttatagcagcagtaggaaactagtaacgagatggaaagaatgatggctgcttgatgactttgcagaacctcagcattagccaactctagagcaaccctgcatttcttaccatgagagacacatttctgtgatgtttaatccagttcgagtctcattttctgctacttgcagccacagctgtcctaagcaagatgcatacgtacttagcagagttctgtgtctaaggcggactctaaatgagtgtttgctgaatagtgaaaaaatgcaggagaaaaaaaccccagaatccacatctaaagaagcagggctgttttccgattcatagtaagtgtaataacttagaactttttttttgttttttaaaaataaaagacacaaaagatgtttggaaagatggataaattatttgaatgctgagatggcctagaacttcagcaggtgcactttcaaattgccagattcatttcctatagtgacctccaggcattcagagtctcttttctgaaataacatttcagcagattctgtgaacatgccaagaagtgat

SEQ ID NO: 85268 - DNA, 1058 bp, Homo sapiens
tcttctgctcccatgataccttagagttctgtttttaccctctcacctagttaacaactctatgtcttgttaatggctctctctgccttaaattctttctgttaaaataactggagtgggccgggcatggtggctcacgcctgtaattcgagcactttgggaggccaaggcaggcggatcactaggtcaggagatcgagaccatcctggctaacacggtgaaaccctgtctctactaaaaaatacaaaaagcattagccgggcgtggtggtgggcgcctgtagtcccagctactcaggaggttgaggcaggagaatggcgtgaacccgggaggtggagcttgcagtgagccgagattgcaccactgcactccagcctgggcaacagagtgagactccgtctcaaaaaaaaaaaaaaaaaaattaaataactggagtgatttctgtcgcctgatcagaccctggccgatacgcctatataattcaggcctctgctgtttggcttcagcttcgttcatcatatgacactgtcatctggaagagcagtcagtcctctaagcagcctctctgatccatacttcatattgcattgggagtgctggatttctttgaggaacaagagcacgagagcaaactcgaagttagaacctctcgtatattttctagcaagtcatgcattggtcttctcaaagtcatgattacttttgaattattttaaaaacttatttgatgtgtttttgaagaatgtggtagaaaacaacagatttcaactcaactctcctgtgcttaagagccagcatattggcagggcacggtggctcacgcctgtaatcccagcactttgggaggccaaggcgggcggatcacgaagtcaggagatcgacaccatcctggctgacacggtgaaaccccatctctactaaaaatacaaaaaattagccaggcgtggcagtggtcgcctgtagtcccagctacttgggaggttaaggcaggagaatggcgtgagcccaggaggcggagcttgcagtgagccaagatggcgccactgcactccagcctg

SEQ ID NO: 85269 - DNA, 1230 bp, Homo sapiens
agacggagtctcgctctgtcgcccatgctggagtgcagtggcacgatctcgcctcactgcaacctccgccccccggcttcaaacgattcttctgtctcagcctcctgagtagttgggattacaagcatgtgccaccatacccagctgatttttgtatttttagtagagatggggtttcaccatgttggtcaggctggtctcgaactcctgacctcgtgatccgccgaccttgacctcccgaagtgctgggatgacaggcgtgagccaccacgggcggccctttaggcaagtttatttacccgaaaggcttctttcttgagtgggaagacaggctgtgatgtgtactctgtgtaaatgggcaagatatgccagtcggcaggtttctttctaggatatatggttaggtaaaagagggcacaagccgattcaggaccatttgctataacaaaactaataacataaggagaactccaatcttggggtgacatcttttatatgttttatttctttttacccctgtgtctatcctagaggctcttctttgactcattctctagcctggacaccaacaccatgcgcactcccaggcaaactttcctctccagagaaggctgttccgggggttccagctgggggcaagtactgcagactgcagtctacacagggcagggctgtgggcagactggctcagctgttctgtagacagctctccactcagatgccctgattcctgccttataaccacttctttgtaggccattctgtggctgccaatagccattgactctaagcttggagcctctccagggttctgtcaaaaagaaagagcttcttatctgcagcctgatgtatttccagctgtatttcacccattccccacccccagttttggtttattggtcaatacagtcccaactctattcttgaagagaatctccaaaatgatgtcttcattgataacgcttcttcgtgtcttcagtgccaccatggatttattctttcaaaaatagcttgactgccatttcattgtgctctttggaatgaaggaggcaaccatgtgtgctttctctactgtttggagctcaaagtctctctcttttgcatttttttaccaggtcatagtatctatagaaatcattttgctgaaacagctggtgttctggaggcttcagtaaaacaagttttttttgtttgtttttgttttttgctacagagtcttgctctgtcgcc

SEQ ID NO: 85270 - DNA, 1043 bp, Homo sapiens
aaaaaattagccaggcatggtgttgtatgcgtgtaatcccagctacgcgggaggctgaggcaggagaatcgcttcaacctgggaggcagacgttgcagtgagccgagattgtgccactgcactccagcctgggcgatagagtgacaatccatctcaaaaaaaaaaaaaaaggaaagtaagctttatagaaaatctgcctatctggtgtacaattgttcctcatcccaaggacatttagcctattcgatgggtgagactagagaggactctagccaccaaactgatgatcatgtgttgtgatatacgtgcaggtaagctgcagtgtctgcgggtggatggctaacaagtgatggtgctttacatgcataatttggtgggatgatttactaagttcccatatgaaagcaccgtttctttgtccagcataaggcaatcaagccgcacgtctttatcttgtctttcgtctggtttagtggttatcatactttgctgcatattagaatcacctgggctgcttttaaaactccaagagcccaggccatacctgtgttagttttcttttttgttgttgttttcattttttttaatttgatttttaaaattagcttcctcaggttgaagtgtgttagttttctgttgctgttgtaacaaattaccaccagtttagtggcttaaaacaacacaaggctgggtgcagtggctcacgcctgtaatcccagcactttgggaggccgaggtggatggatcatttgaggtcaggagttcgagaccagcctggccaacgtggtaaaaccccacctgtactaaacatacaaaaattagccgggcgtggtggcaggcgcctgtagtcccagctacttgggaggctgaggcaggagaatcgcttgaacccaggaggcaggggttgcagtgagctgagattgcaccactgcactccagcttgggtgactgagcgagactctgtctcaaaacacacacacacacacacacgtgaccgagcgagagactctcaaaacacacacacacacacacacacacactct

SEQ ID NO: 85271 - DNA, 1035 bp, Homo sapiens
cccatagccaatctgttcacatgtatatgccatcccgtaacctacccatcctacccagcccctaggttattttgggagcaaatcccagacatcgtatcatttcatcagtggatatttgagaatatatatctgaaatatgtttggaaaagataaatactgttttggaaaactatagtcacatgccattatcatccttaagaagttaacaatatttcctgaatctaatcaaatactcagcattcaagtttccctgattgtgctgtgatgttttcttttaggtagttcaattcaggatctaaatatggcccatacattgcaactagttatgtctcttaagtttctttaatatacaggttctttttccaactcttcctttttcttctatgcagtttcttcattgaaactgcatttgccctttagtttcccactatccagatcttgcatttctgaatgtctacagataggaaatatccaaacacctaatggtttcaaggggatttttaaaaaatgattgtattagttttctattgctgctttaataaattagcacaaacttagtgacttaaaacacatttatgatcttacagttctgtaggtgagtagtccaatgcaggtcccacagggctcagatcaagcagttagcttgattcttttctggaggctcattctggagaattcgttcccttactttttgtagcttctagagggctcccacatctcttctttcgtcttcaaagccagtaagttatctctctctgacccttcttcatactccctctgatggcagctgggaaaggttctctgcttttcaggactcatatgattatactggatccacctggataatccaggctaatcccccgtctcagatttttaaccttaatcacatctgcaaagtcccttttgccatgtaagggaacatattcatagtttctggggattaggatatggacatcttaaacatgggggatattattctatctgtaacaatgatccatccatttttaaaaattcaaatcattgtaaaatagaata

SEQ ID NO: 85272 - DNA, 1011 bp, Homo sapiens
ctacactccagcctggcgacagggcaagactgcttcaagaaaaagaaagaaagaaatgccatattcctctttgctagcgagctgtttttcaaggacaaatacaaaaaatggaagtaatcttcacacagaacccttattagccttttctctgcctcaagaatcttgacaatgtgctgaagttgctatggctttgtttgcgtccttgccaggtcctgcattaaatgaaaataaagagccacaaaaggtcatttctgacttcctttagcccgtggaatcccttagccattctgcactctagctgacccttagaaactttgaaaatcatcccaaaattacagtttactggtagaacatagactgaagggcagggaatgccttccttgcctaacctagaagtgaagcctcatcgtaacaaattagccaatttggcttctgtgccccttcagctgtaatttgaagcatgaaatgggcattaggcagaagatgggtgggtgatgacaatcacttaattgcctcaaagatccctgagatagaaggaacaagggtacttgtttcttgtttcaaaatgctttggttattatacacccttgtccctgagtgggatcgcagaccttggagaagtatgaagtgtcattccaccttcacccaggaggtctttcttgatggggtttcttcatcagcttcatctagtcttatgaattttctatagatgttctttctagactctagcaggaaattgtgcaatcgttctagatttctgcgttcttaggtctcttggtgtttgcatgtgaaatggggctgtagaaggtggctagccagactccatttcacactggggaatcttagtagctaacctttgaacccttgcagtcacagcttcacagaaaactttctttgaagataccctttcttgtagctgtcacctagactagaaggattcctttcctaaaatcttaaaacaaaaataaaaacatctattcttaaacttgctctgagtcttctaacatagtg

SEQ ID NO: 85273 - DNA, 1059 bp, Homo sapiens
aaataatatttgtacctttggggtcacgtagcctctgagacaaactttgtcctaataaaaaggccgctgttcggccttctgtttttgaaatttaagaacctcatttattaccaacttcttttaggattattaactcaaacatctcttggaggattagtacaaatattatgttctcccatcatctctataacaggctgtaattctgaggaccaagcttgtgccttattcatccttgtatctcgtccagcactgaatacagttcctggcataaactaatgatgcaataaattgtgtttgaattgaattttcaaagcattcaaggctggccacctctgcacttgtgggagtaatttgcatttgagctgcatgttttgagatatatcatgcatttaatattgttctttaggtccagcctgatgagtgaagaggctaagcgaggagcacccaacccttggctctttgaggagccagaggagaccagaggcttgggttttgatgaaatccggcaacagcagcagaaaattatccaaggtactaaatatcctgaggagtgtgggctcagaaaccttgccagaatttttttttttttttttttgagacggagtcttgctatgtcgcctaggctggagtgcagtggcgtgatcttggctcactgcaacctccacctcccgggttcaaacgattctcctgcctcagcctcccgagaagctgggactacaggtgcgtgccaccatgcccggctaattttttgtatttttagtacagacagggtttcaccctgttagccaggatggtcttgatctcctgacctcatgatcttcccaccttggcctcccaaagtgctgggattacaggtgtgagccaccgtgcccggccaccagattttctactggagccttgtttgttcctcatccccattgaaaattggagtgaaaactgctggtcttttaaagcttttggtgtgtgcctcaggatacctgaggaatagacagttgctgtcactcatctcggtggctcatggaagtggtgattttccattgggcaagagcagagagagca

SEQ ID NO: 85274 - DNA, 1073 bp, Homo sapiens
gaagtgattgtgaaactttttggttaaatcttgataagacaagatatctaacgtatttactgatgtggcatttatttgataagtttcatttatttgaaaagtttcatcttgaaataatatggatagaaatcatttattaaaaaaattcaagtctgttctaagctcagaagcatagtatttagcatttcctttctttaatttcctttgcagaggaaaaatgcctcttacttgtcatttccaaaagtgaggctgagctacaaggtgttttactgaccaaattccctttcaagtaattctctccatctgctcaaacagtatcagtctttgctgctgaagtcttgaaggcaggtagcagttgattaagttttgctttgcttgatttttaaaaaacatttcaagataaaaatgttaaatgcttctctcattttgtttttaagaaagagagcttaaaaacctcaatggttttcctagttctggttcataaacatttactgaatgcttatgctctggcatattccgaggctctgtgttttggtcctggggatataaacataactgtcatgtggcctcttccctcacagagctcataatttaggaagggagacagatgagtaaataactaactacaatcccgcttgataaatgccacgttagaggttgtgaacatagcaccatgggaataccagcgagtgattgattcaagggaagggggatggggctagggatcaggaaagcctaagcagcagaattgacatttgagttgaaccttaggggaatgaatagaattttgccagatggacaaagggggtgggggtggggacactccagactcatgcaaaaacatgagagtgtgaaagttttgcctttgtctgagcggtggggagcagtctggagggccgaagtagggtgtggaagcggggatgttgaggagatgatgtcgtagagagatcgtagccatgttgtagcttctggggagtcagggaagtttttgaatagggaagtgatagggtgagatctctgttttaagaacaataattcttgcagcagagtgtaggatgatttgaatgagggta

SEQ ID NO: 85275 - DNA, 1026 bp, Homo sapiens
caggaggctaaggccggagaatcgcttgaactcgggaggcggaggttgctgtgagccaagattgcgccactgcactccagcctggcgacagagcgagagtccgtgtcaaaaaagtcaaaacataccaatgtgtaactcaaaagttcatactctctctccctttctgcccctccagtgcctttctcctcaagtaaccaggattggctgtttggagtttcccttccccacatttatctatgcttatacaactataaatttacaaacatacatacctaaaaaaagttttcctttcctatttttaaagaaaacagaactgtactatacattttcctctgtaattttacttttcttcacttaaatttggacattcctccaagttgatgtgtctgacaaattcgtcagttgtattccacaatataaatatgcaggcatttttccagccactccccatttgatggacgttgggttgtttagttttttgccattacaacgagtgctgcagtaaatattcttaaagaccatggcttctatttctttagcaatagagtcctcaaagtggggttactgggacaaaaggtatgagtgttaaagatgtaataggtaccaccatgtctttttcttaaaagttgtggcatttacattcccttcagcaatctgtgtgagggcccctttccttaaaccttagctgtcagtgggcgttacagaacttgatggattttgttttgttgctctgatgggtaaaaaatggtatcttcttttgaattgcagcccttaactactggtatagttgtgacttttggtatggaaaataaaaacattctttgcccctgcatgtattaattttaagtctttaaaaaaatcatttgagaattgaaaaagaaggaaaactccagtttctgaataaacgggaagaagaaagtagaattacctaatcacgctgtattttagttcattatgttaattttaattttaatttttttgagacagggtctcgctctgtcacccaggctggagtgcagtggtgag

SEQ ID NO: 85276 - DNA, 1035 bp, Homo sapiens
tgtgtgtgtgcccttccagaaggattctacacgtatccaaggatacatgcacgggcccatatccccagtctctattccaacttgtttgtgttttttaaaaaaacaggaattataatataatatgcattctttactgcacgtcatcttttttacttaacagtgtatcttggagatgacgaagtagaaggcttaaagtaatactcttaagtatcttgaaactaccttcgaacttgacagagtagctattcgaagtttttaggttatgtatgttctcacaagactgattatcgccagaagagatctctgtagctacttagtccggatttttttttttttccctcaccatgggataggaaaggaagctctattaacagcctgacttccaaatagagactaaatgtaaagaaagattatctctttggatgactgatggagcaaagaaaaccagagaccttgagatctgaacaaatggtcattgcaactccatgtcattgatcaagtcaagaaaggtatccagccattaccatgtgaaagaaaatgaagcacagcctgtccacacgtggttagcagtagcaacctggtagtttctctcctcagaaggttttaaaagctagacaacaaagaaaaatcaaatgaaaaaattttaaggctgctgtcatagtactttaaaaaaaaaaacatgaaatctgtagaaataagtaaaatgaaagatgtatgagacttctacactgaaaactataaaacattatttagggaaattaagtaaagctgaagagataaataaagagtagtcccctgcttaagggcagaggacacattctaagaccctcagtggattcctgaaagcttgggtagtactgagccctgtatatgctatatttttacttgtgaatatatacccatggtaaagtttaatactgtaatggaagttatgagaatgtggtctctctctctctctctcaaaatatcttattgtctataatattttcggagtgtgggtaactgaaactctggaaagtgaaactttgagtaagt

SEQ ID NO: 85277 - DNA, 1052 bp, Homo sapiens
cactcgctggccttttgggttgttttatttaggctcaagtgaaccttagtcattactttaagtcttcaattcactttttaaagaagctgggatgtttacacctatcacttgtcttcctgaagaggcttaggagaagtacttttgaagtgcaagcggtttttttgttttgttttgtttcgagatggagtctcactctgtcacccaggctggagcagtggcacgatcttggctcactgcagcctctgcctccgaggttccagtgattctcctgcctcagctcccaagtagctgggactacaggcacatatcaccctgcccagctcatttttgtatttttattagagacggggtttgaccatgttggccaggctggtcttgaactcctgaactccggtgatccacctgcctcggccaccgaaagccgtggcattacaaggcgtgagccatcgtgaccagcctgcaagcaattttaacgtgacacattgatacagtttcatagagctggtttcttctgcagacagataatcttgtatatattttgttaattcttgtttaattctattttgagaagtagtagcttctgactttttctacacattctggtgaaatgttaatagataatttggtgcaaggactgatagaatgacaaagggagtatttgaagtaggaactgataaaaaaaatttggaatatatgttgccttagcacatttttttccagtctttatgctgcatcatcttttttttgcttcacagtatatattgaagacgatgaagcagaatgtttagggtaatacgcttaactaatggtctgataccagccatataatgtgtacagtgaccatgtttttcttggagagagaaactagatatgtcatatgatgaggtattttttgggactcttcttggtggaagagtcggtttggttgatagtgttaggtcaaaatgttgaccattccagtggtttatgggaatgaatatttgtttttgaagaatgttttttaaatataaatttatttttaaagtaatttgttacattgttaaactgtacaa

SEQ ID NO: 85278 - DNA, 1625 bp, Homo sapiens
cacctgaggtcatgagttcgagaccagcctggccagcatggcaaaaacccgtctctaataaaaatacaaaacttagccggttgtggtggtgcacgtctgtaagcccagctactcgggaggctgaggcaggagaactgcttgaacccgggaggcagaggttgcagtgggccgagatcgcgccattgcactccagcctgggcgacagagcgagactctgtctcaaaaataagtaaataagtttggtcacggggaggaaagtaatatttacctggtatatttctcaatgaaaaacttgtgtcatgatccacgtcagtgtttataagtgcctctgcgatggtcctgccaaggtcctttacctgacggcctggtgaaggtgaaggtcagagcaggaaaaacgcaagagtggtgcgcatcccttctgggtagtagtgattacagtctgtaaaagccacaactgacttgaagagctaacttaataatgtaatagttaaaacgaggtcatttattcaccattgaaccttaacaagatatctgcagaacacagcttgaaggggaccgaagacagaacctcttggatgatcttgtaactcgagagagactacttctggcatcctttaagaatgagggtgccgaaccagatctaatcaggtaggatgtttttatttacagggattacttggtgggcgaagacttctttgcagatactacagctgtttcctgaatggcttactttaggaattaatcaaaatctattctattcatttatggtgtttgactataattttctactcaatttagttttcgttaatttttgtttgtttgtttgagacagagtctcgctctgtcacccaggctggagtgcagtggcgtgatcttggctctctgcaagctccacctcccaggtttccaccattctactgcctcagcctcccaagtagttgggattacaggcgcccaccgccaccgtgcccgactaattttttgtatttttagtagagatggggtttcaccgtattagtcaggatggtctcgatctcctgacctcgtgatccgcccgccttggcctcccaaagtgctgggattacaggtgtgagccactgcgcccggccagttttcgttaattttctgggtttagtaaaccaggtatgttcagctgaatcccatcttgggtggaacatactaagggagactgtgggtgaagtcagaacatttctttggcattctttggttgagttttctgctttgttaactgccttctaaactcctgaggtcactacttctctgtgtgggcaaagcagttttttgtttttttttttaattggcatattgagaacatgagtcctaataagactggtccggggctcacagaggcaaaggagttggatcctcctccccattcttcgccagtgagtgattcacacttcaaagagctgacagctgctctgagcccggttctgctggaagacctggaggacgggtcgggctttccaaggctgaggttgatgaaccgtaaattgctacctctttagaattggcctccccctgtttctagaacttccttagcttcatcgtgggaaccatcacagaaggcaatgagcttgggtggaaacccgcctctcctcatc

SEQ ID NO: 85279 - DNA, 1014 bp, Homo sapiens
aaaaatgtttgttcataaatcaccaatggagtgactttttaatcctttttttgaggcataattaatgtttggtgacttttttaatgtgaatatttgaataccacatttccttactgtgctggatagttgagaatttatgatacttaataaattgatgcctttctacacttgtgaacttgtccaaagaacactaggagttgccagaaaagtcctgtgcaaatgctttctaaacaatgaaattcatggaattaaggcatgagatgttatgctctctcctgaaaaagtatttttctcctggcaagaataaaagtcaagttaaaatggaagttctgtgcttttgaatccattagcgtgcaattaataaaccgaagtcttgcagtcagagagtttaaatttctgaaagaccttaacatctgttcacagtgtttctttgagataggaactataattgtcttaccagctgagaagagggttatgctgtgggaggctgcatatgaaattccagatagtactaaagatacttagtaccatcttcttagagttggcttcacatgaaacttatccttttgttggcatttcacaggaggcagcacctttacttattttaaagagaataaagaaaatctctttacagaggggtttgatgtcaaaaagtactttggtgtcttgggagaaggcctttggaaataagttttaaaaatctataaataaattttctcatcccaggcactttgggaggccgaggcgtgcggatcacgaggtcaggagatcgagaccatcctggctaacatggtgaaaccccgtctctactaaaaatacaaaaaaaattagccgggcgtggtggcgggcgcctgtagtcccagctactcgggaggctgaggcaggagaatggcgtgaacccgggatgcggagcttgcagtgagccgagatcgcgccactgcactccagtctgggcaaaagagcgagactccgtctcaaaaaaaaaaaaaaaagaaaaatctataaataaatttt

SEQ ID NO: 85280 - DNA, 1021 bp, Homo sapiens
tgttacagcacagttggtctatcatataaagggtttttattttacccaaatcaacaagtcctaatatactcactgcaccattgtgcccagctaatttttttttttttttttgagacggagtcttgctctgttgcccaggctggagtgcagcggtgcgatctcagctcactgcaagctctgcctcccgggttcatgccattctcctgcctccacctcccaagtagctgggactacaggtgcctgccacctcgcctggctaattttttgtatttttagtagagacggggtttcaccatgttagctaggatggtctcgaactcctgacctcgtaatccgcccgcctcagcctcccaaagtggtgggattacaggcgtgagccaccgcgcccggcccaatttttgtatttttagtagtttcagatgggcaggactgtttcctctgctttcggtactaagcactgggaagtctacacatggcaaggtgtgtaaattcatgttagtgttacctaaaacacatatattagaaaggtaactacatattgtttcatgatataatatgcatttgcttccattaaggtaacattattagtcaccttatttatgtgctaaccctatagggcaagaaaaatatacaaattaagagcttttacttttttctattaataataatttctgctagttattagagagtactaagaataccacagttataattgactttgttctcctaaatgcttacagtctgaccatctgttgaaatcttgcagatttttggttttgtggtcgtcccagaattacttcccaaattactgaattaagcagtaagcatcaaaaacactgaacaagagttatttaaaacattacaaaaatatttaggggtcttaatgtggataatttagaatttaccaggagacatcaaaaattcaactggaatacaacaactttctttaaaattctatttattttttcaaataattgatctatttctactgtaacaacctgcagccagtactagggatggc

SEQ ID NO: 85281 - DNA, 1051 bp, Homo sapiens
ggtgagtcccgggtgagggcggcggtgcgtggagggaccttcggggaggccgggcttccggagagcaggcaatcacttcgcattgccgctggtggcctttcgggatgaggggaggggcagcgagacctttcctttactgagggggctcagccacatcccgccacacttggtccttgcaagggtggcccgggaaggagaccaggtggtccgctggagagctgaggacttacgccaaatctctgaatattcctttagcttttctgggctgcatctcgttgcggggatttcccgcccatcctggttttggagctagctggctggtgcaggcttccctggactcctataaaagtgaagtcgaaataacgtttttgtagcatgtcagtccatcccggtaaacccccttatttcacaggtggagaaaccgaggttcagaatccatggccaccagccagttagtaaccagctggggctaagacctagatcttgggggcccttccagatacaggaacctgggagggaaattgtgcacttgtttataaggcattttgcactttcttgagttaatatcatgaagtcttttcctttagcagtagcttctgcagtaaaacaatagctgataagggtgatttatttagcagttaatcccaaggactgcatgatgaaagatgcaacttttgatcccaaggaacatattgtttgatcccaaggaacgtattgttattgaacatagacttgacctttctgcttaataattaaaaacatattacagctctataacgttcttgttggaatatgtgtcttatgttgttatttctaatatagtttataattgtttaagttgcccacatcctggatattagaagaatggattccaagaacaaagttgagttacctggaatctaggttatttgggccaattatttaatttagcatttacttttttaaacctaattttaggccggacgcggtggtggctcacgcctgtaatcccagtactttgggaggccgaggcaggcagatcacctgaggtcgggaggtcgagaccagcctg

SEQ ID NO: 85282 - DNA, 1053 bp, Homo sapiens
ggccagaagaatggaatattctaattgggtgcagctgggttgcatgcctgtgggggtgaacgtgggccaaggagagcttttatagaaatggaacagtttgcttccccaaagaaaggaatgctgagcagataaacatatgtctactatactgtgtattccacaagtttatagtgaacacattttgaaatcagaaggatatattttttaaaaagatactgtttgtcgaatgtttgttatgtgccaggggtgtaacttgatgctttgcacaatttatttctctacctgacacagagtagacaataaactcttgaagtgattgactaaattagttatcatgctttactattataaggataactcctattttacagttaatggaaatttaggttaagttgctcaaggtcactcaacttctacttggtggagatagaattgaacctggctttgtctatttcaaagccagtgtgctgggttccttttcctaaagctttcctcatgctttctcaatttcccatggcgggagagaggagacttagaaataggtggtacctctttctgctggctgcgtaggaaaagccctcttatcctgttttttttactctctcctctccctggctgtaccaggcaggtcttcctacttgtaaggtaggtgggatagatagcctttccattttccttttctatctcttggtagcaggaaaaggcattgattgggcttaagggtggagaagatccccgagaggttaagtaacttgccccaagtcacacagttattaagtgagagaactaggacccaaatccagcaaactcaactctgtaacagggttccttaacttcaacactgttggatgtttgtggccgtttgattcttttctgagaacggctgtcctgttcatggtagcattagtagatgccagtctagatgccagtctagtaggcatctagactaggcatttgactatttgtgatagccaaaaatgtcttcagagattgccaaatgtcctttgggatgggaatggggatggtgacaaaatcaccattcccctaacccag

SEQ ID NO: 85283 - DNA, 1034 bp, Homo sapiens
attttttgtatttttaatagagacggggtttcaccatgttggccaggttggtctcgaactcctgacctcgtgatttgcccacctcggcctcccaaagtgctgggattaaaggcatgaaccaccacgcccggcctgttttttttcccccgtttattaataatctatgggttaaaaatggtttttacaattttaaaagtgggagaaagacacgcagaatatgcgacagagaatatatgtggccatatgtgacctgcaaagtctcaatatttgtcatctggtcccttatgggaaaagtttgcaaacttccagattactgggttatgctgtcatttgctgacacgtagagggcaaggaaacggatattttgttgtcgttacttgagaaatggtgagaatatttatgaattttccttagacgtttgacttcagttcttagaaagaggtatgccataagcccaattgtgattctcatcttcacttttattgcatgcttaatcagagatatgcattttgaagcttctcagaagaaatggggtgaacgctgacattattgtttggctacctaacttgggagctcccttttatttgagattttgcctgatgaaggggtagaatattcaacttaaaataacagcactcttggccgggcatggtggctcaggcctgtaatcccagcactttgggaagccgaggtgggtggatcatcttaggtcaggagttcgagaccagcctggtcaacatggtgaaaccccatctctaataaaaatataaatattagccgggtgtggtggcaggcaactgtaatcctagctacccaggaggctgaggcaggagaatcactggaacccggggggtggaggttgccgtgagccgagatcgcgccacttcactccagcctgggtgacagagcgaaactccgtctcaaaaataaataaaaataaataaataaataaaaataataacagcacttgttatagtaagaatccgagggtataacttactgatcttttctgattccaaaaaaaattcatttct

SEQ ID NO: 85284 - DNA, 1098 bp, Homo sapiens
tgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaatcccatctcgttttttttttcttctgctctgtgtgtatcctcgagatgcctagattcatcccatgtaaaataaactgtccagagacactaggtccccctaggcgaccctctttcctggagggctgccacattcttcatgtgacctgtcttggcatccctcctaggctctcgagattggtggtgatttcacctccgatgacttagcgggagacaaagggcatctggacactggcacccaaatggatgctatgctcctggcctcaggcccctccccctggtgacttcctgtctctgtgggttccagccctttgcctccctctcatctctggagctcctggctgtttcttttctcatccatccatccatccgttcatttatatatatatatatagagagagagagagagag

SEQ ID NO: 85285 - DNA, 1035 bp, Homo sapiens
ccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaaga

SEQ ID NO: 85286 - DNA, 1039 bp, Homo sapiens
tattcttagcaccaaattgtgtgtgacatgttttaaccaatctggactccccagtgtaaaataaaactgccatctttagagagggaagcatttcttgggctcatgataggattgggggtcctaggaataccctagacacacacacacacacacacacacacacacacacacacacacacacaaaatgagaaccaccatcctgaatccttggtatctggggtcaggcttcagggggacacctgagctgggttctcatggggctgggttgcccccttccttccctggctctgctttcttcttcttcctactgccatcccttttccagctttccagcggccaccatgaccccagggggaggagaaggcttggctgtggggctcagggtggggcacagagtcatggtgaggataggatgcttcatgatggtgactgtggtctttttccaggagacgacctcatgcgctgtgtggatctctacaaccaggcccagtccaaatggtttgaagagatggtgaccaccacattggtaagcgggcagggatgtgtggacatggcagtacagaggctgacacagagcagcccctggtggttgttggtgggcgcggggatgatggggtggagtgaccctggagatggtcatcaaatctacttcagtgttggggtcgaaacctcaatgtgagccagcttatgtggattcagatctctgctccagcgcttcctagctgtgtggatgtgggcagggttgggttggatatggctacatccttcttgggctgtcccctgagaggtcagggtcaactgaggactctcctcaactaagtggacaagggcctctttaggaaaaatagccaagctataggaagagaggaccgccccacacatgcacacacacgagttgcaggtccttggtaggagatccttgcaaagtggatggatgggtgaggatggagctaggcagtggggtgggggaggcctctcaccaagggtgaacaacaggcggcagggccgatgatgctcttgagtatttcttgtaaagggg

SEQ ID NO: 85287 - DNA, 1029 bp, Homo sapiens
ctgcctcagcctcctgagtagttgggattacaggcatgcgccaccacacctggctaatttttgtattttttgtagagacaggatttcaccatgttggtcaggctggtcttgaactcctgacctcgtgatctgccctccttggcctcccaaaatgctgggattagaggcacgagccaccgtgcccagcctaggaagacattttatgaatgaagttggaaatgagagattatgaaggggaccaagcaagagaataaaaaatctagggcgagcagacttattagtcaacaggtatgaagcaccagtttcgagagggatcttaaaacccatcctactctgcctttttttctggggcttttatgtgtgtccaacattagcgcaggaagctctgccattctggggcttgtgtggagcctgtggggtggggtgtgggaatgggaacctgtggtgcggcgggaagttttgggctacagggaggatctgtctggatggacataaccagagtgagcttttaaagggttaggtcccagcgagtcagtgaaactcctagtatgcattgaaatgatctgtaggttatattctaataagtgagtgggcaaggaccatgtgaattgattatcaagtaacaagtatttgctaaataccttccctgtgctgggctctaattaaccacttggatggcttcttgcgggggtggtgtgggcgaacacaatgcgaatggcttcttgtttgcaaagacagaatgcttcctgaagtggatatgagattgttaaaatgagactttcctttgggttggagttcatttcctttcctgcctgagtattgtgctgaaagtcctttccacctctaaacaccctacgaggctgtgagttgccactcctacgagctcatcacccaccagtgtttgagacggtgcctccctatgcaaagctggcatgaggtcccatcgatgagattgttattgttggaggaagaccttggagtggggtaatagcttttttgttacttcattctgagttggattccaaagta

SEQ ID NO: 85288 - DNA, 1065 bp, Homo sapiens
agaggatgtaatggcaggtcttataatttcaaagctttaaggtcaatagctcaaaaattgtttggatctcagcatttttgctattaaaaaaaaatacgcatgcactctgctttcaacttagctgaggctaagtcaaagaatttggggcggccgggcacggtggctcgcgcctgtaatcccagcactttgggaggccgaggcaggtggatcacgaggtcaggagatcgagaccatgccggctaacatggtgaaaccccatctctactaaaaatacaaaaaattagccgggcatggtggcaggcgcctgtagtcccagctactcgggaggctgaggcaggagaatggcatggacccaggaggtggagcttgcagtgagccgagatcgcgccactgcactccagcctgggcaacagagtgagactctgtctcaaaaaaaaaaaaaaaaaaaaaaaaaaaaaaagaatctggggcttgtactgttttcatttgtacattctgcttagcaccctggcatccggacaagatgaacagcattcctgccttcaaggaacctagagtctcgtgtgcagcagttcaggccttggaggtttggaggagttgtaaagtttcttctttcatttttctcttctatggagatctttagactggggcatcctaatttgcctctactttggttaggatgagtgtgctggcctgtagtcacttgtctctttaccattcattacatggcagagcccagtggcttagtggagtccaggcactaatcccatagcaggatctctaccagtcattagatcaaccagtactcgttaattacaggccaaaggaagtacaggtccactgtgcattgtgtacctatcaggaatgacttttgcttgatttgaactctttttgaaaagtgctggtctgtgattactggactcctagggaaatggcattataatgttttggggatggcagggaggtggcaggcaggcaaggtcaggacctctggaatccaggagagctgtcttgcaaagacacagggagggtagatgtcacttgctggattgtcattagactaga

SEQ ID NO: 85289 - DNA, 1363 bp, Homo sapiens
tatgtgtggctgaagtctcaggtatggtttgtgttaagcctctgaaggacagagcacaatcccaaaatagttttcatgggaatgaccaaggtagagaccattggtttggacctataatatcagagaggccacaccccgattctttacaaaacgtaacagtgaccacacctcagtggttagtgtcaaggttaaggaatgttgatatcaactttcctccgaaggacctgattcagttatgtatgaatctatttctcccggtctgagcctctgtttagacttacaggagatggttgatggtctccgatcaggcccaccctgaaccagggctgggcagggttaatggagagtgtctgggatgtattttcaaagaactgtcatggtgtagggggactaggacaggtgtttgcagacattcctagcttgaggttggcctgattattctgtgtgaatcaccaggcaggtattcagcattggtcctattggtcttccttctgattaccccctagccagagggggtgggggtatagggctgaggtaagctcagaaatggggcacttggccaggtgtggtggcgggcacttgtaatcccagcactttgggaggctgaggcaagatcacaaggtcagcagttcgagaccagcctggccaacatggtgaaaccccgtctctactaaaactacaaaaattagccaggtgtggtggcatgcgcctatagtcccagctacttgggaggctgaggtaggagaatcacttgaacccaggaggcggaggttgcagcgagccgagatcgcgccactacactccagcctgggcaacagagcgagactccatctcaaaaaaaagaagtgggacacttgtctgcatgaagaagtgaagggagttggaataaaatggaaggcagaggagcctctgctgtggtgggctggaaactccactcccgccaccccatccctcccccatatttcatcagagccttttgtaaaggatggcagaaccatggagctgggagaaggagctatcacttgcctgcagtgtcagcaaagagaggccaatttttaatgctttgtgtacattattaactcacttgatccttgtaacaggtattattattaatacttacatcatcattattattttttgtcttcacgggaattgctgacttgagattgtccagctagatcaagcaacttgtcctgggaaagcatggatttgaacccaggcagtctggctcccaagtctactctcttcaccactacactgtcaggacttggtgacctagaaatgctccccctgactccaaaattcagtgaccccaggagccaatccaagcagagaaaggctgtcctgatgtcctgcagaatga

SEQ ID NO: 85290 - DNA, 1048 bp, Homo sapiens
ttctttctttctttctttcttttttttttttttttttgagacggaatctcgctctgtcgcccaggctggagtgcagtggcacgatcttggctcactgtaagctctgcctcccgggttcatgccatccttctgcctcagcctcctgagtagctgggactacaagcgcccgccaccatgcctggctaatttttattttttttggtatttttagtagagacggggtttcaccgtgttagccaggatggtctcagtctcctgacctcgtgatccgcccgcctcggcctcccaaagtgctgggattacaggcgtgagccactgcgcccggctggtatggttcctctttcattctgtctcccagcaggcctaggggatggaggtggggaaatcgagatcctgagaagttggcttcgtggctgacactcccaaggacaggtgtccacactccagaactctgggctgtgggcttggtctcccttgggctggttgggtgatgtgtcactcagggttctttgattataaatattagaaactgattctggctgatgtaagccaagtggaatttattgcaaagacactggaaggttatagactgggcagagaccggggaaacctcctgaaaacagatagaaaccaaggtgctcagcagtgtgaggccaggaagtaggaataataagaacagtcttatagcaaaaacagcatggtcaggcctgtgggtcaggatggatgacttccatgcatccctttcttgctcctcttacccataatttaaagtatcagcacgaagtgtcctgagggggccatcggtcacacacctgtaccctgtgaaggagccaccggggaccgcttggcgtttgttgtggagagctggcacctggattaatagccctacagagaaagtgcccagcaggggagagagaatccccttaaaaaagagcgggctgctattaagatatagggaaaggggccgggcacgggggctcacgcctgtaatcccagcattttgggaggccgaggcacgtggatcacctgaggtcaggagttcaagacc

SEQ ID NO: 85291 - DNA, 1189 bp, Homo sapiens
gggatttttacaggcgtgagccacgatgcctggccagatttgaggtctaagaggtcaaagagggtcagataatggaggaatttgtgtccctcccactgtttttttctaagcgtgaagggaagcctttggaggctggtgagctgtaggcgacacaatcagtcttcgtgtcttgcaggatcacgctggctgccccatgcagaataggttgaagctggttttaaattgaggcagacggacagatgcgaggggtcactcagtctgggatgataacagtggagatggtgtcatgtggaggatttgagtccctttttgcaggaggtgctgtctggatttgcagtgcattgaagatctcatctttgggacagctagttggcttttcctgtgagaagaaaatgcatcagccgcgctgccttccccagtctggaaaatctggcttgccttttccacagcaccgttgatgcggagttgggagaaaccccgagcttagccccagcaactctccaaacctctggctggactaagtgtcaaaaataactaaagggtttggatgtccccaggagaaattcttttctgaggcccaacccagaaacagatttcatggtttgatctgatacccagaggaagtggctccccactcacccagcctcccccgtggatctggggaggcttgttcagaaaggaagatgagcaagttggcctcatgccacacagttacagtttgcattagtcataggacacttcgccatggggacattgtgattaattaatagaagacggagacaacatttgggaggcatttgtttttattcggagtgtctggtcccttcagacggtccttggtgttgttccgagctgaaccacccccctgctcagtggggccaactcgctaagtcatgctcttgttctttaaactgtctccccacatctgaactccaaaaagtctcgtcttcatctctccctaatattacagcctcaagtcttcccctactgttttctgctaagttgagttctctgttgatcttctgctgacaatttatttccttctcagagcataggcatccaggcctgagcattgaaaacatcctcctttgctggtgggtacccccctccccccagttcggaggtctgtggatgtctgcagtgggtctcataagcttattggacatggagctcagaggtggtaccagag

SEQ ID NO: 85292 - DNA, 1457 bp, Homo sapiens
tgatactaaccaggaacataatatctctacataattaagttagactctgtcccctggacaaatggtttcttcacgtagggcttgtatgttccttgtgttaggtttattcttaggatgttgataatttcttcttgttattgtgagtgaaatttagttatgttttaaaattggttatagatgatacatggttccagaatgttgctaataaatagctgtgttcctgtctttagtgggaattcctctggagtttcctcataactccgatactggctgttggttttagatagcatttatattttctatttagcattttaatgtcctttttgtgtctgtttttcagtgtcttcctggagaatataaaactaggctggcgctaataccaagaagaggtatttttaaaggcacaaatagatgtgggattttatcaaatgatgtcttgtcagcatctctcaagatgatcatatatttttttcatttttgaaatattaatatgattaacaatatgaatagactttctagcaggatagaatattgaaatccaaggtgacttgatggaaagagcataggacagagtacctggaaacctcgattctagttctaggtttgttttttttgttttgttttgtttttgtttttttttgagacggagtctctctgtgtcgcccaggctggagtgcagtggcacgatctcggcttactgcaacctccacctcccgggttcaagcgattctcctgcctcagcctcctgagtagctgggattacaggtgtgcaccaccatgcctggctaattttttttgtactttttagtagagacggggtttcaccatgttggtcaggctggtctcaaactcctgaccccatgatctgcccacctcggcttcccaaagtgctggtaatacaggcgtgagccactgcgtccagcctctagtttggttttttaatttcaaatttgacctggacaagccagtatgttttattattccctttaacaaatatcccacattcatatttccttttctgtaaaatggcgatagttatgcatgtcctcccttccttactagggagttggaaggataatcatgagttaagaagtccttcctttacatttatttaagtgccttcacatctgtaaaagaactttggccggatgtggtggctcacgcctgtaatcccagcactttgggaggccgaggcgggcggatcacgagtttaggagatcgagaccatcctggctaacatggtgaaacccggtctctactaaaaatacaaaaaaaaattagctgggcgctgtggtgggcgcctgtagtcccagctactcgggaggctgaggcaggagaatggcatgaacccgggagatggagcttgcagtgagccaagattgtgccactgcattccagcctgggcaacagaagcaagactccgtctcaaaaaaagaaaaaaaaaaccttgaaaaaag

SEQ ID NO: 85293 - DNA, 1088 bp, Homo sapiens
aaaatactttggtgtccagggcttgcagagagcttgtcctcagtggctgtgtctgaactccactattgagggtgcctggagggggatcttgattgggaaggcagtggggagtttgaaggaggggctgtttatagaggcttgagcagggtagaggatggggaagcacgcccagagaggggaaaagggagggaggcctgcagcaggagggggccgactgctctaaagaagccactgctactcccaaccccagcctgcagcctgcagcctgctaggagggaactggtgaaaataccccaacctcgctttcctcatgaaccttcatctcctacctatgactttcagtggccaaattgtctttcactgtagccagagggtgcgagggtccctggagtccctgtgggtcagccttctggtgcaggagctgcaggagaagggccaaagctagctcccgacaggcaagtggagagtcaccagcccagagatgtttctagagctttgtcccatgttaaaacacaaaattatttgctctgggagaatatatttaaaacttctcttgacgagtttggaagagagctttggcctaggaactgatctgaaattaaatgcagacatatggggtgggggatcttgttcataaagatcctcctcctgcctggcttgagtcaagaaacaggcgaagggcacccatggctgtggcatggagggctaggacaacagagacactttgcaggaacatgggtttaggaggtggaatgccagaatgggctccccagggtagaggtttggagaaatctgcttacgaaggaaatattatcaaggaccaaaaaagtgatggaaagagagggacattgtggcggagctaaggatgggtggagcaagaagaaaaagtcagagttgggaaagaagctaggtcggagttagagaatctcgtctctaggctggggcaatggaacaagtaaggaagtcagttgcatggttggaagagaatgtattcccttcgaacctgactcttggtgagggttgctcatccatgcctgtgtggcatagtggttcagagagtgcggggtgtcaatgccagctgtactact

SEQ ID NO: 85294 - DNA, 1094 bp, Homo sapiens
caaaaaccgcaaacaaacaaacaaaacggagccgcgacccttgttcaagtgcttggatccatctgcaactgaaggccagacactcttgaacttccaagttatatgagccaataaatactgccatgccttcgtctgtgtgtgtgtgtgtgtgtgtgtgtgtgtgtgtgtgtgtatggtttcaatttctatggcttccaacttactgcatcctgtcaaaaacagccatattatgaccaggtgtggtggctcatgccagcagttcccgctacttgggaggctgaggtaggaggattgcttgaggccaggagtttgaggttttagtgttttatgattttgcctgtgtgaagccactgctattcagcctaggcaacatagtgagacccatccctgaaataaacgacaagcaaagcacatacttccttaactttctatattatagttagaggaaaatgtcatattgcgcacctgtgatgtgatctgcctggtggcaagggtgagcccaggcagtcatggtgagattacagaggtttggtatgccgtggagagaccactagacagggagctgggattcacaggctctaggtgcctttcttcttcctggctaggtaacctgggcaagtctcttaagctttctcagcctcagctctcaacatctgtaaaacagaggaattaaactaggtgatcttcgaagtcgcttttagctctatatggtcctgtaactgttttatttaatatctgtgttttaaatgggcagtagaaatagggacaaaatcaaagagaaacaattaaaaataccccctagatctctacgaattgcttgaagatccacctttttttttaatacaatttttagtgtaaattttttaagttgaagtgtaacctacatacagaagaacggtcatacctggccagacagggtcgctcatgcctgtaatcccagcaccttgggaggctgaggtgggtggatcgcttgagctcaggagttcaagaccagcctgggcaatatggggaaaccctgtccctacaagaaattagctaggtgtggtggcacgcacctgtagtgccagctactcaggaggctgaggtggttggat

SEQ ID NO: 85295 - DNA, 1065 bp, Homo sapiens
tccagcttcatccatgtccctgaaaaggacatgaactcatccttttttatggctgcatagtattccatgatgtatatgtgccatattttctttatccagtctatcatttatgggcatttgggttggttccaaggctttgctattgtgaacggtgcctcagtaaacatatatgtgcatgtgtcttcatagaatgatttataatcctttgggaatatacccaatattgggattactgggtcaaatggtatttctagttctacatccttgaggaattgccacactgtcttccacaatggttgaactaatttacactcccaccaacagtgtaaaagtgttcctatttctccacatcctctccagcatctgttgtttcctgactttttaatgaccattaggggatcttgagttcactctagaatgattggcccatgagtccatgagagaagcctgggagaggagatttgaattctgtgttcctttcatcctactcaggtgcgggagctggaaaatgagcttgatgtggaacagaagaggggagctgaagccctgaagggagcccacaagtacgaacgcaaagtcaaggagatgacttaccaggtaggggtcccaaaaacctcctcagtgaatgctgtatggaccaagccccatcagaagtgaccataggtttgcgggcccctgccacgtgtactctgtttgcaggctgaggaggaccacaagaatatccttaggctccaggacctggtggacaagctgcaggccaaagtgaagtcttacaagaggcaggctgaggaggcggtaagcacaggaggtccccggcagtgcccacagacagacagtccctggggcatcctgggtgtccccgccatcctggttggtaaagtcccctgagcctcaggcctgagtttgtatttgcaggctataaacacagagacaactgccctcttcctctcctggtccatgttaagccttcacgaccttcaccatctctgtgccctcttgcctcaccctacttggccagccccctccatccccttcatcctgcccaccgtgactcacttgacaccc

SEQ ID NO: 85296 - DNA, 1009 bp, Homo sapiens
ctgctccgttagagaagacccttcagtgattctgtctctaggtggctttgtattcttgcacatgccactgaatcccttaggacctcagatttctgatctacaaaatcagaagaccacacccaacactttccaaagccccttctggttctgcagactatgattctatgcgttttccccacagttgttttctctggtcttctctatgaccgttttgtatatggtacttttgaagttttaagtttctattctttacttgtggttcctgtctgcctagtgcaggtgaggcaacacatccctgtcttgccaacacctcatctgaacggctgccctgtattctctcctgtataaatgtcatgaatgaatcgcccatccctgaattgcctggcaaatgcctatactataaactggagcctgttgaaacagcctaaatcaagcctgtcctttgcagaagagatttccgacttaactgagcagattgcagaaactggcaagaatcttcaggaagcggaaaagaccaagaagctagtggagcaggaaaagtcagatctgcaggtcgccttagaagaagtggaggtaagtgtctaggatatgacattcagaaattcaggaggacagggaactgaaagaggctgcccttcaccaccccatggggcctttcctgccaggagaccctgagtctccattgggagtaacattcagccatcccaggggctgaaacatccacgggctgctactttatctcctaggcgttctctggcacagttcccctttgaaaataaataaatgtgttcattatgttcttcaatgtcttcctctcaggaagcagaaaatcaatcacctaacatcctgagagcagcgcagaatctctcagttatgtttaacatagaggcacagacaatcatttttggctatcaagaatcctgtataatccaaacacacccagcatctcccgatgcagtaatcggtggtggtcaggatggctggtggtttctagggaaatacgaaccga

SEQ ID NO: 85297 - DNA, 1036 bp, Homo sapiens
tatcttatcattttctgtctccccagatcttagcacagtgccctacacataatagaaagttggtgagtgaatgagtgaataaatgaaatgaaactatttccttctggacacaggtgagctgagtcgtcagctggaagaaaaagaaagcatagtatcccaactttccaggagcaagcaagcctttacccagcaaacagaagagctcaagaggcagctggaggaagagaacaaggtacaccattgaaggaagacttctttgcccttatttttaaatatcacctgtaggaggaaaaaataaaaggcaacttcattcagaaggtggtgatagaagggacacacttggattgtatcatgcacctggcactaaatatatcaggtgctcttctctttttaacttctgcaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagtgcgcagctctgtttgcttttagaagaactacttaggaatgaattcgatgaatttatttttattactaggcgtttccccatctcatgtgtctttaaatgcggtgctgggccattagagggacctggcgttagcacattttattaaaacaaacagctttgatcttggtcagacacaaggcaagttattgatcccagattttgagtagacaggaaattctcctgggcgtataaaaacacatgggtgtctgaatcacatagattagtgattccaacttgatgaatagtgatgttcaagtggatggaaactgaaataacagctgcttctctttcatattctttaaggaaaaaacttgctcagcgccttcaagattccgaggaacaggttgaggcagtgaatgctaaatgtgcttcactggagaagaccaagcagaggct

SEQ ID NO: 85298 - DNA, 1079 bp, Homo sapiens
ggccatcccatcccatcaggggagggagcaccggccccaagttcagagaaaggcatcccaagctcctgacattctgcggtcggaaaatggtgatggatcctgctcatttctaattatacctttcccttggcaacgacaaagatacgtgtggaagaagctggttctcggcttgggggggccactcatcctcttgccaaatatagagaaggaatgagccgcgggggttaccaatggcctataaaagccccggggagcagccagccctctgtggctcgcttgtgggcggaggtaagtcacaggctcctcttctaggtctcagctgcttggagcacacccacccggtgagcacatccacaccccgtgcgtggttccctggccctgcctggctctgctgaggtggcgcctcatgcctttctgagttttcttaggataagcaaggtgtagagagcgaggttccctgggcccaaacacccagcaccctctggctccagcacctcccccaagcaggagccctgcaggttctctctcctccacacactctcccctgtcctcctctccaagtgtcctcttgggcaggatccttttggatgccccgtgagcccagctgccatggcttgaccttctcccattgcctctgtgacccatgaagggtcaacaggactggggacctcactctgccctcaccttccccacctgggctgtacatctgccaggtgtcttgtcctctcaagaccacactggctgtgggcattgcgtgtaaattaatctcagagatattgcctgttcacagacaaggagacctgcccctgccctcgaactgttgactttaagcagggatgcggtccctgctgtccgattctaaatgggagtgaggaagactgaagaaggtgccagtgcaggctgagagaaaccagatttctgcacagctgagggtttttcctccctgcctggcttcctgtgggtcacgtcccatctgctcttccatcttccagcctgcctctttaaagtattagtcttttttttttttttttttttttttgagacagaattttgctcttgtcgcccaggctggagtgcaa

SEQ ID NO: 85299 - DNA, 1009 bp, Homo sapiens
tttagagcttgtattaggtcctaacgtgatatgggtgctctcttaagggaactaaaagaaatgttgaagggaatatttcttttctgtctcctggaggtgagtatggatgtagttatatagatagatgagtacattggtcactgcaaaagggaaaaagcaaaattgccccctatttcatttccacacagttcctcctgtcaacaggtctgggtgttgacgtaggaactgcaagttcccacgtccacccccgccacacccacagcctgccctgcatacaccactgctggagatgtagccaggacagcttgccctgtcccctgaccccacggaccttgttaacaccgctgctcccctcggtgatatttacctgtccgtggctgtcctgaccaatactcccaaggagacagtgcatcactgggccaacagggcagagccccaggggaccactccctttacgacatggacggacactttaggagtgacggttaccctctccttggatgaggaggggctccaaggatggacatgtcagtctcacctggagggagaggggcagtgggtgggggcaacgctcagtggctggtggacaggcaaggggtgagtgagccctgcccaactgactccattggcggccactggccttgcctggcattcacggaacaggcgcttcataaacttgttgcttcaatgtgaaatcacctcaattttgtaaatgcgtctgtagcatccacaggactcatcatctagaattcaaacccttaagggtaaaggctgcgtcttctgtttcctctgcgtcttctcgaagcactgtgtgtaagggccagagcacagaggatgtttcatacacgtgcctttgccctgagaccgcagccctgcctccccggtcccacgcagacctcatggagtggcctccacttcggggcttggtactgctgtgtacggaaggggcggtttctatgggaaacatggacaaacagttctatttggaataagcaaccacagggtgccc

SEQ ID NO: 85300 - DNA, 1611 bp, Homo sapiens
ctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcggacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttcagacaagcgtgatctttttcatgggtgatgagtgggtacatagatggctgcacacagttctcaggaaagagacccacaggctccagcgggcaggtgggtgggacgcttgctgaagtgcagttccccagacccagagctgaattcactgaatctgcagtatgatgcagagacctgcttccatgacagataccccaggtgactcggatgctggcggactgggaccatcccttaagaaagtgttttttggggaaataacttgcctggcacaatggctaatgcctataatcccaaaactttgggaggccagggcctgaggattgctagaggttaggtattcaagacaagcctgggcaacatagtgagaccccccccccccgcccccatctctacagaagatttttttggcatggtggcacatgcctgtagtcctggctactcaggagactgaaatggagtatcacttgagcccaggaattcaaggcttcagtgagctataatcacaccactgcattccagcctgggcaacagagtgagaccctctagatatatctatgtagagatacagaaattaaaatgaatttaaaaataaataaatttgacccttcttttggtgtgtcagccattgaagaaaatgattattgagtgatagaatgaatcttggcttttgtttctaaatttaactgccctagaatcctgggtttggcctttttctgccagaagctgctgccctaggggcaaagttc

SEQ ID NO: 85301 - DNA, 1015 bp, Homo sapiens
attaagaacactcagaaaataagtcccacatactgtagtttgttttttttaacagagaatagagaaaaggaagaaatagggagaaagagtgatgtaagctacagagtaaggcttgaagagagaactggagacttaattctgatttctgtatcaaatatgtggagaaacgtagccccccgtcttgctcctgcggtgaactatcccacagcacttggaatccagttgttggcgctcttttggtgtacattctttccttatgtgggtaggcaagtgctctttccatttgctatcttaagaatgtgtgtataaaaaataataccctcacagacatatagtgcgtgctggggtatgtttgggaggtgtctccagtttggtatttgtagtcacattcctgtctttctttgtcttgccaaatagcagtcaagcctgcaataaattccaaggactctaagtgccaaatctcacttaaaattggattttatggaagtgtctaactaaaaaatctgatgactaatctaagttaaagttagagctgggaccattttaggactttgctgggaaaatggatgctgagtttacgatgactctctggttaggggggcagcatttatgctcccgaggatttgctttccaggtgatggattgatttcagataggattattcagtggaggagacaaaaatttccttggggagaaaaatgtttcttttcctgtttctgtttgaattactaatattaaaactaaatattgttcaaatttatagattatttaaactaatgattagttttctgatttcttctcataaagcgtggtaagcagaattttggcagtaatgaatgacaaccagttctttctaaaacatgaataaacccaagaacttactaaagaaagcagtttttcaccaacacttaattccatgtgatgtctgtttgtaacatgtttagggtctgaggagatatcttactcaaaaatgaaggtatttttcaacaagcattgctattccacaaacattgac

SEQ ID NO: 85302 - DNA, 1048 bp, Homo sapiens
gcgggaaaattctagaatatggaagctttttttgactttagtttggaatttcaagtgcaattctaacgtttgttttatttaaaaaatgtattattaaataatctgaaaagtcttcctaaataatttgagagtatttatttgctgacatgttgcgtcattagctccaaacactttttggtgtatttcctacaaacaaggaccttttctagcataaccacaatacaaccatcaaaattagaaaattgacgctgataattttgctgctgttcagtgttcagataatcttcagggtattgtttatttgtttgttttttgagacagagtttcactcctgttgcccaggctggattacagttcagtcttccaagttttgccacttgatgtctttcagagcaaaaggatctgtttcagaaccataccaccttgtatctagttgtttaccttagcctccttcatctgtaacagtttcccaggctttaactgactcccacaaccttgacagctttgacagttacaggagagttattttgtagaatgccccttagcttggatttgtctgatgtttcctcattcaggtcattcgggttgtgtacctttggcaggaatatcacaaaagtgatgctgtattctccgtgcatctggtcagataccacatagtaccagttgtcccattactgataatgtccagtttgatcacttgattaatgtgtgtctaacaggttttctactgaaaagttactcatgtaattaatggtgtttcatgatttgtattgacatacgtatacttacatattctgttccccatcccactatcaatgtattcatttatttatatctgtggacttgtttcctatatattcattcagtttaaatccatattctctttattttgatgcccaagttgtcccagattgatcagcgggagcccccttggagcaggcttctgtgtctttgacacgtctccaatattctctaagttctgctttccttctgccacaacaagaggttccagcctcattttacactttctttgccgcaaccctggtat

SEQ ID NO: 85303 - DNA, 1030 bp, Homo sapiens
gaacttgttccagtggaaggtgtatttgagaggattttggtatcaaatgacagaaaatcaatttgatttagctttaagcccaggagaatttatgtgctgacatgtgtaactaaatgaccagtgttctagcagggacaggtgaatttaggtattcaactaatgttttcagaaatctccatctttccatcattcagaattgtttctttctatgttggatttcttgtcagttcattttctccaaaaattgaagccttagtttatcagcgtttgtagtagtggcagtgcctgtcccagggctgatgcttattgtgacccaggttgagttacatgcctacccctaactggccagaggaaactgggtttttacgggccaggtctgggccatgtgtctgctatttcacttccccagccagtgaatggggttggaggtcagaccacaagaactgagagtggggaattggataaatgcctagagaaaaattgggtgctgtcaccttaagaacaggaaatgaatgctgggtaggcaaaaataacagctgtccactggagagaagatccaattcattgggactaaatcccctctaggagatccacaatacatattatcaccataaaggctctgagtttaaagataaaaacaagctcacttggcaggggataagatcacccccagaaatagttttctcttaagagttaatataactcttaatggttaatataaccttaatggttaatatcaccaaggttaatacaaccttggtgataatattcatgttatatacttgctaagttatcttctgatttgattcttctattaatctgaacttggaatcgcaaatatttgaaacctaacataaggctaaagatttttaaactgacttagatggatttttgtcctgtaattgtattgaagttacccacttttcaaatcagattacctctcatttatacaccctcatacatactgacttgatatctaatgagattttcaggtaggggctgcaggaagaaatgggcaaattaaaaaaaa

SEQ ID NO: 85304 - DNA, 1029 bp, Homo sapiens
gtttttcatctgaaaagtgggtatggctaccttgatctcatgagtgtttaaagtcccataaatcagttcggaggcattgtttatgtcaatgacacataatccatggcccatgcctaaactgtttgtttatttatttatatttacatttttattttttgagatggagtctcgctttgtcacccaggctgaagtgtggtggtgtgatcttggctcactgcaacctccacctcccgggttcaagcagttcttctgcctcagcctcccgagtagctggaactacaggcacataccaccacgcctggctaatttttgtatttttagtagagacagggtttcaccatgttgtccaggctggtcttgaactcctgacctcaggtgatccggctgccttggcctcccaaagtgttgggattacaggcatgagccaccacacccagcctgttcttttatttagtgttacatcattctgtgtatataacattcatatttaaggaaatcaattggattggattccagcacagcatctgcccagtttcaggctgcctttgcagactgccctgcataggacacccttgatcttcctcggtgtttcggcaacttgagatgacgtaggcctcagagattcagggttttgcctctacagcagcctgtcgcgcctcatgtgaactgtcttacccttcttctatgctccagagatgtggctgtagatggcctagttttcttgtgtgtgaattctctctggtctcagttcatttgcataatgagatagcaatttttttttctttttctgagtactagcttttagccatttatttttatagaagagatatttcttaattggctcataactcttcttttctttaactaacaggccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtatac

SEQ ID NO: 85305 - DNA, 2024 bp, Homo sapiens
tcctcaaaagacatcaaatgggacaaggtatttgtaacacatataaacaaggatttatatttagcatatatataaataatttctataaatcaatgttatatttcaataaaacaactgagatgagaacatactaaaatgtaattatgtgttttatcaattcagtctttatacttgtttccaaagcaatccatgatttttatttataataatttttgtgtctttataggaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtcttgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgtagaggcagggtttcaccgtgttgtccaggctggtcttgaattcctgagttcaagcgatctgtccaccttggcctcccaaagtgctgggattacaggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggactataactacattctaaatgagaaataaggtcaaaatctatatacattctttataaatggatgtccaaagtaatcctagggaggagagcttttttttttttcatttccattttcatttaaaaatggatacttgattattggaaaacttacaattgtgtttggaacaacttgggtatttgaatctaattttccaattgcaaattttatgatacctaaatacagataaagtatttccaatgaaaatttagtgtccaaatgagtggggctataaatgtaaaatacactggattttaaagacatggtagaaaaagaacagaaaatattttttgtattgattacatgttgaaacaatattttggctataatgggttaaatatactattaaagttgattttatctgtttctgtttacttttatttacgtggcttacattgcatttctgttggacagtcctgtatttaagtatctagatggcaacattttacatacacaagcatcaaactctgtggtcagatactgttttttctgatctaggaaagagatctgggaaatacttcactcaaaaagaacgagtagtgccttccacaggttaggagagtgtaaatgagtctggtagtttgtctatttttattgtctttattactatagtaaatattctataaatatttgttaaaggaggtatgtgtattttgtttt

SEQ ID NO: 85306 - DNA, 1037 bp, Homo sapiens
tccctgggactcatgatgctggtgtgcgggctggtgtgggtgcccatcatcaaaaagaaacagaagcacagacagaagtcgaatttcttacgcagcctcaagtccttcttcctgactcgctgatggtggtttccgcatctccctgccaccttgactgggagaagatctgatgaccaacatccgacatccctgtctcctctgtggggtgccataaaactgatccaggaaaatgctcttcctgaccctgtggggaagatagagcttggggctccaccctccatgcagccgggaatgttgccagatgtatccacttgatctctattctgactgatgcttccttggatcccggctgtggccttccctttggtcactctaaccccctgcccctgcatccaggcatcattcatccaactctctctgccaagtgcaatgcatgctgggaaattcttcgaaggtgggctatgcccaagggagaacctcatgtttacatatctgagtgccagagctggattcttcatttgcatacttctggaaccaaaactgacccacggaggtcctttacagaggagggagggatggctgagctctgacccattgggtttgacagccctagctcccttagcagactttcaagatcacaagtatcaaacattccaaagactgaacaatgaagggaggcctgggaaaaatactctccaagatggcacgtgcccctggacatgacaacatgactctaggggttagtcagctgaagaagtttagttcctaattatataatatttacatcagaggcagtggggtaggctaggggatgtcactgtttccgcttgaccttatctttctcattgaccactgtcttctctgaacttgatcattagccaaggacaaaatgcatgttgccctaatttctttcctacccctgcctctatctctgcatctagaacagctaaatggaaagatacagagggatcctgtaaggttgttttccctttcacgtccatcaagatcaaaattgagagaatcaagttccatatctg

SEQ ID NO: 85307 - DNA, 1143 bp, Homo sapiens
tgggaagaattaagcctacttattcacagttccagcaagtcactaaacttacttgcagaagctgcttgtgatggaaagacccaggtctttggcatcagagtgaccacaatttgaacacagtttgccacttacatgctgtgggacctcggtcaggttacttcagcccctgagccttacgagccccatataaaacagggataatggagtgtctacctcatagggttgcggtacagtcaaatttcaaataacactgctatattgtctgacacattctacgtgttcaggaaatggccttggttgccattgcaattattttctttctgggtctctgtttttccatttataaaatgaaggagttttcttagctatttcagataagtctataggtaatgaatcagcttgaaatctgaaaattgaggttttcagaaaatcaccaattcatgggctgtaggagttttataacattttattaaagccccaataagattccattttttctgtataccagggctttttaacaatggcactgttggcattgtggattggaaaatggattgctgtggcagactataggattgtaggatgtttgtattgtaggatagttagcaacattcctggtctctacccactagatgccaacagtacctcttcctccctgttgttatcatcacaataaaatatatctccagacattgcaaaggtcccctggggtaggcaagatcaatgtggtggatcaaaggctgctctggccagcctttcctcctgcctagcttgaaaattcaggatagaggctgggcttcctcatcttctaccccatggcacctggctcacagcctggcacttggcagttgctcagaggatgtggcccagatgctgcagctctgtcggggacaaggtaacactcagggggctggtccagtgagaaccacccttttccgcttcaattaagttactggtagtttggtttgtgtgattcaggagatccttcactcactgtagggagttgaattgtggcccccaaaagatatgtctacccagaacctcagaatgtgaccttatttggaataagggtcactgcagatacaatcaagataaggatcttgagattaaaacatcctgagtgagagtgggttctaaatccaa

SEQ ID NO: 85308 - DNA, 1052 bp, Homo sapiens
tggatggcaactctttgctatacttttttttttccccgcggagcctcgaggccattagaaagctatctgaacctctgagactcagctttgtaacccctgtgttgaaatctctgtgctgcagctcctatgggaggtgaggaggatgggggtgcagggcgggggtgctttccggggtagttgcgtgtctgggtctgtggaaaggaggcctgagtctaactttcacagctacgaggccatcccaaaagagaatcatagtaccatccttggcgtgtgtccttggaggaggtagggggaactgagaacaaaaagcgatggccaaggccaagattctgcctgcgtgaccagcgtgctttggttgaaggcagggaactgaaggcagggaacaggctgtcagagcgagggcggtagagaattttccctgagactttctgttcagtcccactcatgtgtgacctaaacaagggatccctatccaggaacagaagagttcctcttttgggaaccgtggaatggatatattagagctcgaactcagactccaagacacaagagggagatcctgatattgactagggggtggggtggggggcggtgcacagactatccccgcagctccccacttgctactgtctccattccctccctcttcctctgcacttcctcccgttcccttaacttctcagttgccaccttcttcttaaagattctgtccaacaaacatttgtttagtgcctactccctgccagcagaatgaataagagagtccctttcctcaaggagggggaccttgtagaccattagggagacagataaacaaatgatttccacatggcaaggttacgtctcatgataaaggcgggcagggtgctctgagagcagaagacaggcacccagcctaggcctgcaaggggacagatgggggtcaaatgtagctttctcaatgaggtagagcagaatcttgaagaatggattacgagttaatacagcaagcaagaggggaaggaggctcccagcagagggaacatccttagcagaaccagaaagacaggaag

SEQ ID NO: 85309 - DNA, 1035 bp, Homo sapiens
ttcgtagatggggagcaggagagacccagcatgtttgcctgacctcaccccctcctaaagagcctgtcctggggcctctggggagagtggggtgcccattcctggcagtagcaatgagatcatgtgctgaggttacagaatgttgatgtccaacttcactttatcaagagtgacatcatctggagacaataaatattcatgcccatctacataccactgtgagttgtataaaagaacagccagtcatcctgcctgttgtcaaagccatatccattaatggcagacaaagggagccaagggtcatgactctctaagcttcatggagacccagaatggaggctgcacaggtggcagaggagcactctgccacagtcctgcatgccctggttcccatccccccacgcctctctgacctcaacccctactaccttctgcttccctcctaggctgcagacacactagtcttctccagacacactgtttcttctcatgctgtttgtattcttgcattgagatatttccccctttctgtttctgtagccccaaattttctagcactaggtatttgttttgtggaatctgttgctcaagcagcactgttttggagaggcctttcctaaccttctctgttaccatctccggctttacttttctcagagcacttacatcatctaacatcatacatttgtcggttcatgtgtttattatctgtcaccatcagaatttaagccccaggtacacaagggttttatcttcctatcattgtggtatcctaggaccaagaacatcacttggaaaatcctagttgctcaagagctgtttgttcagggaatgatgaaagatgacatagtcctttacttggatgggcgtaggatccaagcacagatgctggttatgcagctgctgcatgctgaagaactcccttcaagactgcatcccatgtagtagccctctctgtaaagtaagtatggtgtccgtcacttgcataaaccataggctggtcaccagccagctggttgagccagaaggtcctgg

SEQ ID NO: 85310 - DNA, 1079 bp, Homo sapiens
gctggaaggaacctcctaagtttgtccagtataaagttcttattctgcacatgaggaatttgctcttaggtccagcagccagaaagtggctgacctgtgtccagaatccaggtcccaggacatccagatcttttctcagctcattttttacgtggtcacctatgcatctgcctgtattttattgcaataaggggatggtacatctggtacatgaacgtgccagaaacaggcaagcatttccttgccaggcctaagcttttgaaaagcaagagagagagggagagaagcagatgttgaggaaatagcctgagtgcattggtggcctctggaacatctggaccagtccaagccgtcttttgcttccaacattggaagtcctgcttaggtcctagcaggaagatgatttgtgatccaaccatttcacatatagggccaagagggcagacccgaagggttgcagctctcagcaacagccctacccagggaccgaggttgctatagaaacaatatgggggtgggggaaaaagcagagagtcatccaggtggagaggaggggggcgtttgaaatgagaggtttctagatgaaacagacttcctgcaggttctgctggagtttcattgaaggctgatggctttgtcatttcccatcaagctgggctgtagcatggggtgtggagggctcctgggaaagaaagacgtctgactgagtagtgtgatgacgcccccaacccagtgcagtgcagtgcagtgagcagcctatgtgcttgtatgattgtgtgatacatacacaattgtgattacctgtgtgtgtgtacgtatcagtgtgtgattttgtgtgtgattaccagtgtagttatgtttgagtgtgtgtgcttgtgtggttttgtgtgtgtgtgtgtgtaagattcagtgtgattgtgagtgtggttgtgtgattgtggttgtgagtatgtgtgtggttttatgtgcagttgtatggttgtgtgtatagttgtgaatgtatgtgattggttatgtgtggtcgtgagtatggttgtgtgtggtgttttgtgcatgattctgagtgtggttgtgtgtgt

SEQ ID NO: 85311 - DNA, 1208 bp, Homo sapiens
tttaattcctccctttcatcccttgtaacattggcatcattcatttcacttatggctaagcatatacaagcatatatatataatatatatacatacacatatataatttaatacattgttgctattattttaaacaaactattaccttttagctgaagtaaaaatatgagaaataagagtttttattttatcttcacttattttttcttcattattcttcctttctttatgtagatctgagtttctaacctatatcattttccttatctctaaagaatttcctttaacatttcttacaaggcaggtctactggcaacgaattccctcaatttttgtttgtccaagaaagtctttatttctccttcacttctgaaggataatttcacaggatacaggattctaggttggtggttttattcttttaataccttaggtatttcacttcacgctcttcttgcttgcatggtttctgagaagtcagatgtgattcttacctttgttcctctacaggtaagagtcccacagtcctagcttctttcaaaattttttctttatctttgacattctattgtttgataatgatgtgcctaggtgtattttttgcatttattctactttgtattatttgtgctttctggatctgtagtttgatacctgttattaatttggggaacctatcatatattcttaaatacttgttgagtgaatcaataaatactcattgagtgaatgagtgaatgaatgaataaaatggaaatctgaagaatgagtaggtattatccagttaatatgccaccacaccggacagctgccaggagaaggaaggtatggccaggctcaccccaaaatcacaggttcccccctttctggtaggttctcccctgactctatggagtactgttttcagtgatggggttttccatcactatgctccccacatgggttccaagaagagactagactcccccacattgatacctacaagacagaaaaagctaagccttgtcaggaaagaaatgacacagcaattatggtcccatgctgtgcttgtccacctgctcctgagctctgtgatgattaagctagttgtgtgtaaacttacaccaacttatgatctgaataggggacaccatccaggatagaagatagaaggtccccgaggagaacctaatggtactacttctggggctattttaaattgtgacagg

SEQ ID NO: 85312 - DNA, 1039 bp, Homo sapiens
tacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcac

SEQ ID NO: 85313 - DNA, 1120 bp, Homo sapiens
ctccaaactaacagcaattatttgcatcagaaagactttgatatttaatggaatcctttggaagtaaaaggaatttttaaattaatcactccctctaatctcttaaataagtgaggaacttcataaataatgccagaataatgatacggtattactatcagtacacagtagttatttcattagtggaaaccatgactcggttggaacctcacatagactccagcagtgcatttactcaccttcccctgttttcagacttaaaggaaaggaacagcgtgtaactaagtgtaagtcagttgtaatatcttataaacccacaagatggtgccagttccacacaaaaatagaattttcccatcaaatcccatgtgtctgtctttcaggatagaaagttaggtttttccgtctcttctaaatatgagaaagaggcaagctggctgccattggcgtcttgcctcttcagtaggaggttttattcgaagtacccagcttcttggcagtttcttgagtaaatttgtgtttttaagctggaggtaccctgttagtgctcctgaagcaacttttctggtttttgagtgagctgattttgacccttgggggttttggtggctgtatccttttctgccttgtactcttcttggtagttactgttctggtgttcatggaatagatcctgtgtcagcaagccaggcagccaggcagatattactgtgcttggcaagtgcatccttttctctgctagcactgaagccaaggtccatgtgttctgaccacaaagactgagaactcctgtgttcagcaatgtttgctcaagtgattattttcaggaggttgttaaaatagctgcattcacagaagattaacagaataagctgctagctgtttatactttaaaaattaaaaaatttaaattaaagttcacattaaaaatgtggttatagttaatagttgactgtgtaattcagtatattgaggtcgcttttcagcttcctatccttcccacccaaaaaagtccaaaccctctttcgtttgtgtgtttggcttagcacctgctaattgaacagtttttggtatctcttttctccttgagccatttccacttccctttgatgtgctaggg

SEQ ID NO: 85314 - DNA, 1044 bp, Homo sapiens
aacagaataagggttggggtacccttggtagtcagtgtgaccatggttactttttgattccattcctcttaaagggcttctagcatttagttaggttcaacagacatttattgaatagttcatgtttatagagcatgccataattcagaaagaagagacaggattttatttatctttacatccctgtcaccctccccatgaaataattttaatatacataaaaaccagtgatagatatatagacaggatgatgtcagagcttagaggacactttctgtgcaggccctcagataattcattcaaattgaattagttattggatgcccactgtgttgcacagcacattatactgatgaagtataagattgacttcctgactgtacagctttacaatttaggtggtggtggttggggcgaaatgaaatggcaaaatgacaatttaggattgtatttcttgttccagatgggtgacttacaaagcttataaaaacaaggtgatttgtttgtttgttttattggtggggaggctgacagtttgaaatagctggatacagtgtgtttttttggttcaaaaaatatttattgagcatctgcataaaacgctcatgctgagtttatagagaattgaacatctctaactgtcctcatggaggttatccccctgtgaagatgggggagggaaggctatttagctaaacatgaaaaattactagttggaaaagtaataaaggtaacaagctgggttttgtgatagaagataatagagggcagtccgcttgataagatggtcagagaaggcttgtctggaaagctaaccctcttttacctgaagacggttctaggcagaggaactgtgtgtatgaaggttccaaagcagggaagagcttggagtgttctaggaactcctaaggcagtggttaggactttttctgatgctgtccgttctcctcagcccttgtatgttgatacccagttaactaaactttctaataagcagaacccattttagaaggaaaaaggacctaagacctctctatgaattat

SEQ ID NO: 85315 - DNA, 1041 bp, Homo sapiens
aaaactaggactcaagtgaaatgacttcagtttcacagttggaactagaactctggtctcctaacacacttcattttgttttttactttatcgaacaccatttgctttttgtttttataaacacttacacatcctaaacagccgcttacctcactgtatttggtaagaacagtaaattgtaggtttcaagttatggccacataaaagatcttaaaattgaggtaagagggtgagaatgaggggcaaatgtgggaacgagggtaggagatacgtagagagaaaaaggaggaggaaaaaccctcatgtagctttatttcttttataggcttactagcattctgtcctatgcattttgatattgattcatcagtgtcaagaattaagaatttaaattcttaaataaatattattcttgatatttattctaagatttaattaaacttgcctggggccaggaaaaatgaaaaagactcaaatttacccctacttgtaatggggaaaatataaatggaggatcatgtcaaattaagccccagggtacagatagttcacccagatataaaaaagtgaggcacacacgacttaaaatgtaaccagttaactatcaacaggttcaacggattatctagtacctccagagataggacttaaagtaagtgaataggaagtcagaatttcggagacaagggagacttcaaaaattgaacatattggccaggtgagatggctcatgcctataatcccataactttgggaggctgaggcaggaggattgtttgagactagcctgggcaacatgttgggactccatctctacaaaaacaaaaaacaaaaaactccaaaagttagccagacatagtggcttgcacctgctgagatgagaggattgcttgagcccaggagtttgaggctgcagtgagctatgatcatgccactgcactccagcatgagcgacagcaagaccctgtctctaaaaaaaaaaaagaaaaaaagaaaaattgaacatatgtgagtgaatactagtgaatattatatcataac

SEQ ID NO: 85316 - DNA, 1005 bp, Homo sapiens
acctcctttgtagctacttatatagattctgtactggtgacagaatttcaggttttgagaattttttaacacttaaactggcgcttagcttttaatgtgttagagcaatcattggcgacattctgtcattctcagtcacatataccttaaaatttttaatatattatacacttattaagcaatgtaactttttttaacacaaccttacatatagatccaactgatttctttttcatataccttacaaatttgttttcttgctcctttcgccatccatattactattttgttcacctcttctctctccttttcacctctttctttttgctacctagtaacagtcaatcagggtattttgctttaaagttgtttgtttcccagcctcctctccagttgtagtagaaggtgagttttaccttcccttttccagtgggatgcggggaagacttgcctgctacttccagagaacccttttcttcctgaatgtagtcagctcattttgcgtggtaggaggccagtggcttttagttgcttaggcttgtaagacccatacatctctgtttttctttctgaattctgttcccactgcacatttggtggggtagcatattgaccttcagtggtagagagaccagggtcagaccttctaggtttgccctagtacttctttcccatgaagtctccattctcacttcttcctgcattgtcatttctatgataaggtagtcagcagtggattacttcggtggtgcaccaaagacacttttcatgtcaaagtagctacattagcatttttcagtttttgtactttatagatggcatcttcttagaatcctaagaattttgataactggataggaaagactacttaactatcctttcttcagtcctggctcttttttctgcgtgttttgattgaatttgtttaaacacaaagttattgtaagcttacttccttcattttgttccccaaaacacaagcgtagatagaccactaacaaaacc

SEQ ID NO: 85317 - DNA, 2121 bp, Homo sapiens
tgctggtttgctctggaatatagacattaactttatggtaaaagtggtcacacttttctttaaaattgggcttgggctgggcacggtggctcatgcctgtaatcccagcacttcgggaggccacggcgggcagatcacctgaggttgggagttcaagaccagccagaccaacatggagaaaccccgcctctactaaaaatacaaaattagctgggcgtggtggcacacgcctgtaatcctagctatttgggaggctgaggcaggagaatcgctgaacctgggaggcagaggttgcagtgagccgagattgtgccatggcactccagcctggtcaacaagaacaaaactccgtctcaaaataaataaataaataactccatatcaaaataaataaaataaaaataaaggcttgaaatcatcaaaggactgatttctccactgttggggcacacttatttctagaatctccacttttattctaaggatatttcagaattatcagataaacttatgtttaatttattaaaaagaattatgtatcatacagtagttgtaggagggtatggggcaaagagcatgaaattagatatcattcaagtctgataagtctgagtactggctgcttcaaatgctcaaatctatcacaaataaaaaagatttattgtaagatgattctgatgactaatggaagctctgaaggattaatttttttcattgactttcacatagtttttgctctttatattgctatgtcactctcttttaatcactttattacagttgcctgttacaagtcagtggagttttattggagatgtgtgtgtgtgtgtttacatgcacaaatagcgattacatatttaatttgggaaacatctctgtagaaattcaataaaaattcactctgctcctcacagtcttccttttatagattatagttcatgcatttatctattcttcagtttattttctaaatataagtttattttagataaaataaacttcaagttacatttatttaagaccatagtgtcatgtttcctttaatactgttggatcattgaatttttctgaagtctgaatgtaagaacactttagggaaaaaatatttttccatttgtaaatgtagagttataagtgtagaggtcctgccttagaaggttgattaatttatctgttatttgaagataatgtttttgtacatgtaaaggtatttatataatttatgaccgtatctcactgactttaatgagctaacctgtgaacatagttgtttagaatatgacttacttgctttataaaaccattttttcattttttatttttcgaggagggatgaggatttgcctgaaaacatttttttctcacaagctgcccaactaccaaaaaaatcattcttccaaaacctcctgatgttgattcctcatgaagagcagttgagttgcccaatgtgtgccactcatgacagaagcccccttttttagaaacacagtttttaagaaatgcttttatgaagttgaatttaccttagtgttgtcagcattctaatttttttttttttcagatgagaatcgtgactcatttaaagatctttgggcataggaattttcctcagaaaatgcctaaccgaattgtgtgctaatcagagtgatagtagctaggcgtttggcaaatactcttctgataatttatttttcacacaaaggtgcttttagctctttatcactatcctcccccccgccaccttttttttgtagctgtagtatattatcagttcatggccgaagagttctggagctctaaatattttgggtagtgttaagtttctgtagctttgtcttttacgtttttggtggcgttaaaaactttgtgcttttaaaaaatgatttaacttggaagtgtttacatagcaacaggatatttatttagaagattagatgctccagagctattattctggatgctacgaattgaaattagagtacaggtggcggtggtttttggtggcactgcacatcagtatatttggaggaaaaaaaggaggcatcctggagactgattttataagtatccctaattgttttttaaattggtaataataaaaaggaaaccataaagaggaag

SEQ ID NO: 85318 - DNA, 1540 bp, Homo sapiens
aaagcaaggagcaaagggaaggttaagttgttctgcatttaaaactaagaacttagaaaattcagctggttaaatttctgattcctcgttttatgtagcaaaagtctgcagccagtgacaaaaattatataatttggaaattattaaattcaactgagtttgtcagcaatcctaagaaacaaaatgtcatttactgctcttggaggtttatacagtttatataagtttatatatatagttaatgaagttagttgaaaaatgagacttgtaggattagccgtaagccagactaacatctaatatttattaccatttgtggggaccatgataaattgtcaatgggaagtccatctgcttggaaaaaagtttttatattagttaaagcccaggaattgtagaagtagaagtggtatattccagagtcaggattcacctattcctctcatactttatgcttataccttataccattacaaagggaatgttgcttagttgtctttgaccttggaaatggtgggaacatgaatttgtcctgaaaatgctttttgttgctaggagaaggaaggtttctaacagctattgcaccttaaaataatttggggatgcttaatgtgtgacatttttgataagaaaataattagtgactttcccacattgcagaaagttttcatttatatgccacttgaactttactactagcaacaaagggatgttgacagaactttcagagttgaacagatacagagtagaaatgatatggaacgtttccagagagtattcccaactgaatccagttaaagtggttttcaatttagctcatacatttagggtgatggttttcagataaggtgtagtaaatatttggattgtcactacatggttttatgagatccgaatctaggcaaaaatgtacagttaataagatgcactaagaaaaagttgtgacttccatcttggtgttcattttccctgggtagaaatgccaaatgaacgttaatcagaaaggaaaatcaagtgcgtacgaacatattcactcccctttagagaagctcttacaaggataaggaaagagaggtacaaatgttaacagttaacaaatgtgtatctatatataccttcgacagataaagatattaccaatgataagaagcactgggatccttaaagatgaattaaatctagagcctactctgaagaagtgtatgttctttgagagattgagcatatataggagctatgtggtagaaataataactcttaatgtgtgtcaaatcctgctctaagcactttatattaactcctttaattctcacagcagccttatgaagtaggtataatagttaatatagatgaggaaactgaagcacagagaggttaaataaaatttccaaagtcatatagctaataaggggcagaactgtgtgaccttggtctggtcacagtttacacgttgtaaaccttagtgttttactaattcttgaaagcagttggcgcttataggaatgattttctaaatcaaatggcttttgaggagtcctca

SEQ ID NO: 85319 - DNA, 2185 bp, Homo sapiens
ggactgctcaatgcctaggccagcctctgggccagctgcaattctaattttcccagcatgttgaacaaatattctcatcttttaaacaagccattgcatgaaaaaagtaggcagtattgctttgaggggtggaacagtgctttggaagtgtgatgaggacaggtactgttcctaagtcagggttcttggttgcaaacaacaaagatttactccagccaataaccatataggcttaagttgtctgaggctgtccatgtcaactttattcccaaatcaataaacatttggaagtgttttctgtatcaggcacagagctaaggttttaggtatacagagaatctctcgcaggaaaccgcttctgtataaatattttaggatgtttgatgcctcgtttctctcctgctatagttaaagggacaatgtttatctgtgttgactggttagaaattgatgatatgacagtcccaccaaaggggttattataatcacaaattcataatgtttttgatcagttattttaaaccctgttgtacaaatatttcaatctttgttagcatctaaaaatcttcacaggtcatttatagtatcacgtccctcctttctccctgtgaaagttgtttcaagtttttgaaaaaaattcatattaatgtcctatttgcttgtaattttttgtcattaaaaatatctgaatacatggtgacagattgcctttcggttttgatttttttgagggacccttgaaaaagaagtaaaggagagaaggacccagccccagtagaggctctagtacttagagaaagtgaatgggagaggagaagatgcctttttttaaaaaaaaaaaagctcatgcctccaggtagccagaaacagcttctcctgagtattgtaaaagctatttttctacttttcttgaatctcaccttcggttgacattttggggccttccttttcctcctcaaaactgcctttcaagttcatcttaaactgatcagcatttgaagagttggggtacacagatgagacccagcaaggtaacttgatcatgtgctaagctcgttggcacttgttttaggctttgagtgatctttgcttggaaaggcttcgaaacctacagaattacttagtgtgttttgttagtaaatgatcagaatataaatttggactttttcaagataattgcagatgtctctgaagtgtagactgtgtttaaatctaatttatgtaacttaaatcacattctcttcatcatggtgtacgtttatgaagttaatggcctttaaagctttcaatttagtttttatttaaatgtgaatgcaatgctgaaaaaaatctctctgtgtattcagtataaatacttatattcaagaaaacagtttaagttttaactgttgtaatatattttattgtttatctggtaaggttagctactattccgtcaaattgggctttctaagaaaggaccaatttttgtttttctttggatagttttcacaatagttctttgttctgtccttgtcttgcattttatcttagtcttatattaatttttcttcacacggaggtaatggatgatgtgccagatggtttcaaacacagactacatgacatatgctcagtttttgatttgaggagtttgtaaagattttcttcaaattgtgatagcaaagttccttaacttaattttttctgtaaacgatttgccatattaaggtaattaataggttcaagttccagagattaggagcttagtatctttggggaccaccattcagcccattacagtctgttttctgggccccaaatattcatatccttcccatgtgcaaaatacatttaccctaccccagcgtctccaaaattttgactcattacagtattaactcaaatgtaaatctcacctaaatattaccagctcaaaaatcccaaatcccattatgaaaatcatttaaatcaggcatgggtaaaactctgagtattatccagggcaaattccatttggtttcaagacccgggagtaatcctctatctttaaatattttctaaagaaaaattctcaagaagtaaaagagcatatttactaaaaaaacctttttttttgtatattgctgaacctctcacagaaagtttttctaccagcaatatatcttattagtgattcttctacctagccattctgatcatcatg

SEQ ID NO: 85320 - DNA, 1376 bp, Homo sapiens
ttacaaagcattttcatggtctgatttcaattgtagtgaaaaaatacatgtccctatctatgtatagaaaaaagtctgcagtagttagtaaactgattattttgagatacttggattgataagtttatgtaaaattttaaccctatgtattgtataggtgtatatgtaacatttttaatatatttgatctttttttgcattttctgcccttctaccatggtggttttacttgggtaataaaaaacattggtatctcttcccttcctaccctaaagaaacagcttcatggaaataattatttagaatacttgtattactaacttgaagtttactctaccgtaatgtttttagcaaatttttcagattcttcactctgttgtttatattcattaaaatgagggaaaacgatatttattaaactgagggcattaagtataacactgaacagatggtaatatttttagaatttttcagtatatctactgagataattgatttttataatagtattttcacttgcaaaagtattaacttccctgaataatggaaacttgaagtgatagcattctatctattgtatcatagcctagtgaatgatttgtagttagtaacaactttagattattttattttttcttagtttaagaaattcctcattgcctttcaaaatattgtcctatattaactgtttgttaaagcaagttctcttgccttttggtgtgactttcttatgccctcagaatagtacctgttttgtagtacttgaaacttttactttttatttgttatttctcaggtaaacgcaaagcactgaagttgaattttgcaaatccacctttcaaatctacagcaaggtttactctgaatcccaatcctacaggagttcaaaacccacacatgtgagtattcttggtaatcaaaggctcaactcaagcaaagattttaaagttactgtattttatgaatttttccaattatgagatgtcagtataatttctctgactaaactctctgggaatattgtttattcttttccttctggagttccagttaaattgcaagttgcatttaggaaatttgactgtcttctgtccaactgtacaaattttcaccacttagtgacaaaatagagtcccatcttaataagctagattcctgcaagatttctatgtcatagtaaattgaaagagttgtgtacatgtgagtgtacacatatcagtggttatttcatttactgaatttttaaacaatagaaatgatattgtagcatcttagtgaaaatattagagcatcttagttaacataaagcaataccttcagaacaatattttacattaaccttcaattgaatttaagtgatgtgaaatattaaaaaa

SEQ ID NO: 85321 - DNA, 1026 bp, Homo sapiens
gagctgcttttaaaagacataatcatagtaccattgctacatctagtagaataaatctttaatatcatcaaataagcagatgacctcattagtttttttatttttaatagtttgaagtgaggtctatacaaggtcctgcattctatgcagttagctgatcagtcttttaaactagagttccttctcttgaaatcgattagtttttctttgtgatacatttttatctactcaggcattcagaaatttaattcttttaatttattgcttatttccttaaaaaaaggatttttggggggatcttggaggatgaggagacaacctgaacaggaaaccttgatttttaattatcaatgattaaaattagaaatatttttgacagaaaatgcatattataatagagactcttgtacccactaacattttttcccttggcttttaaaatgaaagattaaactggatagccaaagagtacaaagaaaaagcaaaggaaaaatgtgtggctaccttttaaattttcatcaggtttggattctactaaacactataaatctttttgatactctagggatattcttataaatgtggccagcttgtgttaaaatcatgttgtgtatatgaatttgacaaacagaagtagatattctgttaaacattctgtgttttcatgatagtgagttatggttgagtgctctcagtgtactgagtcgtttagaatatattcagtacaattgttattctgaaagaacatcccttttatcttcataacatatcacaattgtcaagaaaaaacactagcttaaaagttaacactggaaataaatagtggtggatgcagataacattttggggcttaagagttttggaaccacacgttttaagtttaaagtgctctctttagaccagaggatctctaggatttcccttatctttgtttattacattggaacagacagagactcagttgtgctatagaacatctaggagtagtttaaagaggtttcaaagtccctagttaataactaatat

SEQ ID NO: 85322 - DNA, 1075 bp, Homo sapiens
gaagggctagaatttaaaagaccaggcaatatcttggcaaatatgtggtgtaagcagaattctcctatattgttgaggaagcagaaaatggtacaaccactttagaaaactctgctaggtttttaataaaatgaaacaagcacctgcccctgacccagcagtcctaccttttgttatttgcctaagatgaaaatactctcagaaagatttgtaagtgaatgttcatagaaagtttattcagaatagccgccaaattagaaagaacccagagtgttcaataatggaagaatgaagaaacaaattatggtatattatttaacaaaatactcttcctcaataaagtggagaaaatactgatacctgcagtcatattgatggatctctgaaaatgctgagcagaagaagcgagacacaaaagagaacatactgattctatctctatgaaatctagagtaggcagaacagatctgtggtgattgaaatcagatcagtgcttgcctctggaggagattgacaagaatggcaccagggaaccagggaattttctgaggtgatggaatgctctgtatcttgctgtattttgtgaaatagaaaggtgtctgcatttgtcaaaactcattgagccacatatgcttatgatttgtgcatctcactctatgtaaatgatgcctcaattttaaaagcaatcctgaacaataacaattatatatatacatatattattattattattattattattattattattggtgtttgttgtttttttttttttgagacagagtcttgctctgtcatccaggctggagtgcaatggtgcgatctcggctcactgcaacctccgcctactgggttgaagtgattctcctgcctcagcctcccaagtggctgggattacaggcctacaccaccatgcctggctagttttttgtatttttagtagagacaaggtttcaccatgttggccaggctggtcttgaactcttgacctcaggtgatctgcccgcctcagcctcccacagtgctgggattgcaggcatgagccactgcgcctggcctaatttttgtattttta

SEQ ID NO: 85323 - DNA, 2152 bp, Homo sapiens
gtatttttgtcatttctggtcagttgcaattgattgatgtttttctcttcactatgggtcatgtttttctgcttttttgtatactgtggtaattttagattgcatcccagagattattgtgtgatggctgtttttgtattttcatgaatgtttttgagttttgttctttggttaagttacttggagatagtttgatcctttcaggtcttgctttttagctttcgcagatgagactactctagagctaattttgccttactagtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccgctgatcaaggagggccctctgcatatcggtggggttctctttctgtgtagctgtctcttatcctgtactctgccatgtgaactttggctaccttggtctccctagattcccagatccttgtccgcaactcaagggtactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtggaactagggaataatatcttgaagactttgagaaagagcatctccaaacaagatatcttgcaggattcaaaatagtttcttacaatagtgactgacattgttaatacagtgaaagaagtcatggcgtttataaaaatggattggaaaaatctcgaggagagaacagactggatggatacgcaacaagattatagaaagggggcagatgaggaaaagacataactagggacctgaaaagcagtggtagagtgaaatcccttttgatgcaattgtgaatataaatgatactgcatgacagcaaaagaaaagaatttgagggcagtcattgatttgaaagcatacaaattactgaattttttaaaaatgtaaattcataaacacaagggaaggtaaacaacaaactgggaaaatatttgcaatgcaggacaagggttgatggtgttaataggtaaggaacttgttagtagaagcagcgataacaaaacaaacacctgggccaggaaggctcaggggcgctatctcaggcagttaataataatacaaaaaagacatatttgttcaccagatagcttaagaatgttcaactctagcagttgaaaagaatgatctaaccctaacacctttcaaattggcatgaggaaaaaggtgctgttgactaggtacagtgggcaccttttggctgatagtactcctaaatcagtgcagacttggtacacagccattccagtagtgataaccaattatttaatgactgtgttaaaatatattaagtgaaatctataagcagtaggtataatatgctgtttttgcaacctattcccatagtatacaaagatacaaaataatatgtactaaattgttaatagtggtttttttctggattatgattgatttttccattttcctttttatcttctacctttgtagctttaggagggattttagattcggtgtctggttggaaaaagaggttcaagtactggtactgctgctgaatttgcacagcaaacacactgcatctaatagagggtgggagtgaaggtggaggatgtggctagagctgttctaataaccctacttgactggccactgtgtttctttacaaaacaaggccacctgcctatatatgaagttccaggcagctttattagacattgtatagaaatacagcttttctcagtgtccagtctgattaatgttctgggacattatgtcacagttctgtgtgtgtgtgtgtgtgtgtgtgtgtgtgtgtgtgtgtgtgtgtgtttagtctgtaggatttcagaaatttcagactagta

SEQ ID NO: 85324 - DNA, 1131 bp, Homo sapiens
aagaaggaggttggaggaaaagaaaaagagtcttttttccaactgagttagctccttttaagtactgtgttcctattttccacctctaactgcaaggaatgttggtgacttagcttggcctgcaaaataccacatactaggtggcttaaacaacataatttatttctcacaattctcgagactggagagtccaagattaaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttggggttagggccttaacatgtggattttgagaggaaacacagttcagttcatagtagttgggaaatgtagccttttagctgggtgcattgctgccacacataaatgaggatcctgttagggaggatgaagaggagaatggatgttgggtgacagctgatagttactgccacagcggctgttgtctgagtttcccaggttggtaatgagaaccttggggttggaaccttatgtagtgttcattggaggcaggtaagggtgatctgtataaaataatgcacagaaaattatgaagggaaagatgagggatatttaggaattatttttattttggggggtacatggtgtatatatttatggagtatgtgagatgttttgatatgggcatgcaatgtgtaataatcacatcgtgggaaattgggtgtccatcttctcaagcacttttcctttgtgttacaaacaatccaattgtactaggaattatttttgataaaatatagtccccattctgaagaaagtgatatcccaaggaaaagtcagggaactttttttttctttaagagtataattgtaggcaaatatttatgaacaagtaagggcaactttacatctttattggtttgtatttttcaccaatcttctcattgggtgtgttttctactgtttatgttctttctttcctaggcctcttacgtagtttagga

SEQ ID NO: 85325 - DNA, 1771 bp, Homo sapiens
agatttttaaaatctcccccaggtgattgtaaggtacagcaaaccttgggaatagttgtactaactgaagattgaggcactggaataactaatgttgggtaagatagggtaagaactttttcgcaataaggtttgcagctcttgggattctcacttgataatgctgtttggataaaccatcatccaagtttgaataagatcttatatttagaaatgaaaactgatctgcagaattagtttaatcaataaatgggaatttttaaaaatcttcttggcaatttgtttttatgaatcccgttgaagctgtgtctattgactacctaaatctagatcattcttaatccagtgtgtaaaaaaccaggatgacacaaatgaaaaacttcaaaaacctggaggtcagactattttagtaatttagaaaacatttttcccacacattaatcagtactaaaagaaaaaagttaaaacctatttaaaatgtggaaaaattgcttcccaatattttaacagagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaagtaggtgatgccatgattatttttggtactttaatccattaggtgaaatttcatggtgcagtaataccactgttgttgtgttcctacttttgtggtaaatgtgggtgtttaaaaaattgtttctccaactcctttgagggtgttctgtgtagaggtttcttattggtggcacattttctatctctttggaaacatgagtgtatgaagtgtgcatgttgattgcatttttggcatgatgcattaacatgttttaaacttcaggcccttctactgccaaggtgagttcaggctgggcggctgcacccctgggagcagggcagtgctgcactgagccaggcgggagctggaagaagacgcagcacactgggttgggcaaggtgcggggctagggctaacagcagtcttactgaaggtttcctggaaaccacgcacatgctgttgccactaacctcaaccttactcggtcctgaccggctcggcttctgtttgtttatttcatctctactcagtactgccctgttccctggttttaaagttgtactgaaatgcataccttgtgataatgttgtcacattttgtccttattgtgtcgtgccacttaatatgttcattaaaaaaaaaaaatggccagaaacagagatttgatccatagacaatacctggcaagcttatgctggtacctgtaaagaactggtggtttccatctgactcctagtttcatgtaattgtaatttattcatttgtttgtttagatgtttaacaaatctttgctgtatgtaagatatttcaggaaaatcagcaacagggggaacaacttgcaaaaacaaaggaaaaaaagctagctgtggccataccctctctgagcttaaaattcctatgggaacaaaaatgtttcagtttacaagaattcagaatggatttgcatatagtccaagctaatcatcttcctattagtgtcctattttgagagtttgtcagagtggttgataagagtccttagttttttcttgacatttgagaatgaatttaaattaaaataaaatgctttctgtgtagaagtctgttgtgagccaaaccttactgtaa

SEQ ID NO: 85326 - DNA, 1001 bp, Homo sapiens
accttcagtaagactgctgttagccctagccccgcaccttgcccaacccagtgtgctgcgtcttcttccagctcccgcctggctcagtgcagcactgccctgctcccaggggtgcagccgcccagcctgaactcaccttggcagtagaagggcctgaagtttaaaacatgttaatgcatcatgccaaaaatgcaatcaacatgcacacttcatacactcatgtttccaaagagatagaaaatgtgccaccaataagaaacctctacacagaacaccctcaaaggagttggagaaacaattttttaaacacccacatttaccacaaaagtaggaacacaacaacagtggtattactgcaccatgaaatttcacctaatggattaaagtaccaaaaataatcatggcatcacctactttaactgccattatttgcccacttggtttgtggaccattttgttgacagaaccataagctcctcgtccaatttctccaaggtctttcaagtcctctgcagtgaaatcccagtgttgttcaggggagatcttcagttttcctgatgactcaatgctgtgtgttctcagtctctctctgttaaaatattgggaagcaatttttccacattttaaataggttttaacttttttcttttagtactgattaatgtgtgggaaaaatgttttctaaattactaaaatagtctgacctccaggtttttgaagtttttcatttgtgtcatcctggttttttacacactggattaagaatgatctagatttaggtagtcaatagacacagcttcaacgggattcataaaaacaaattgccaagaagatttttaaaaattcccatttattgattaaactaattctgcagatcagttttcatttctaaatataagatcttattcaaacttggatgatggtttatccaaacagcattatcaagtgagaatcccaagagctgcaaaccttattgcgaaaaagttcttaccctatcttac

SEQ ID NO: 85327 - DNA, 1062 bp, Homo sapiens
atgtgcgaaaaaccaaagaaacgtgaaaaagtaagaatgaaaatgagagggagtataaggactgaagtacctgtcactaaagatgatggcaggcagtggaatctgaattgttgtgtgaagggttaatactgtaataaagctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgacctggtatgcaagagtttcaagtattttctttctgttggagatctgcctaacttgtcttgttcttttgaacctcagctctaccctttcacctctactgtttcattgatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagcccacagctcagctgttccctgagtagaacggaactttaatctgctggttgagtaggcctccctggtgtagatagtatggtgagtatgggaagtcaggtatcagaaaagtatggcttggcttgttttcctgccactggagagaccatgccacttctgtcaaaagttccattaccaaattatttcagtggggattatgatgatgaataatgatttgaggaggttcattttagtgtttaaacattggtcttgcatgttctgaaagcactagaatgatactgggatggccttcaattggaaaagttcctttttgatggcatagagtgctttgttaggccattttattcacttccaaagggccgcagtgatcatatttgattatccaaatcacctatgggatgcagatgtcatggctcttttgtttagaattgagactgtagtctaatatcttaggc

SEQ ID NO: 85328 - DNA, 1516 bp, Homo sapiens
tgattgagctgtattcttttatgcttcctaatattgcttaaaagctgtggtggtcatatgaaaagtgtaagtagagcatttccaggaggagacatattcaaggggtgtggcagggctggcctctaggcagccttgattttgaactcaggttgcttatgtagatggggttggaattcccagtatacatgtgtgcttgttttgctgtcactccaagttaatgtttttcagactgtgagtttgttccattaacagaattggatgtgcaacccaagaaataaaacagccaaaatcagtactgttcggggttatgtgagggtgggaagcagactctacctgcagccatattggaagcccttggggcaccagctctgaggaattaataggggtacaattaagacagtttggaaatggttgctctaggtgaattttagtcaatcattatatgtttttgaacattctaaagatctggtttctgaaaccttctaccatcacttggttaaactgaatgaattttgacattggactaaatcccaacttacatagttatctggagaaaaacctgttttttgttttgttttgttttgttttgttttgttttgtttttgagacagtttcactgcgtcgcccaggctggagtgcagtggcacaatcttggctcactgcaacctctgcctcctgggttcaagtgattctcctgcctcagcctcccaagtagctgggactaaaggcacgcaccaccacacccggccaatttttgtattattagtagaggcggggtttcaccatgttggctaggctggtcttgaactactgacttcaggtgatctgcccgcctcagcctcccaaaagtgctgggattacaggtgagagctaccacgcccagccaaaaacctgtcttaccatacctcactctgcgtgggtgtcatttgaaccagtatgtgatatatttcctgcatattttctatcattctttgtcatcttatggctatgcctctgaaatttgttgtatatgtcagatttctattgttacctcactttattgtcgtaagtactgaaatgatgatctgtcatttatggtcttcagacccttaaaaatttcagtgctaagattgacattgtttctttaaatgtggatgatgtggttagtaaagaggaagaagatgataccactcttaccaaggcatgtcaaacttgttccattaacttggtcctcagggcagctcttcccataatgtaatataacacatgcttttggaactgaactcccaggtgctctgataatacgtagcagaaggtaaggtaaaaggaattaagtggatctcagtatccccagtgagaagaatggggtattactattaattaattaattaattaatggggctaagatacaactgagagtttattaaattgattttaaaagacttgaatgatttttgcaattaagaattagcattctttcttctgcccgtagtaaaatcatatatgctttcacaatttaaaataattgacttaacag

SEQ ID NO: 85329 - DNA, 1022 bp, Homo sapiens
aagggtatgtttatggcatagcagtattggtgtttgtagatcacagaaactggatgcgttttcaaaatattacaactgtgttgtaatattatatataaattatatataatatattacatataatatatattaaatattatacaatattaaatataatattaaatatacaatatttaatatattatctataatatgtatgtaatatataatatatattaaattatatctaatatataatatatattaaatatataatatataatatatattaaatatattatatataatatgtaaaagattaagataatctttgttcttttcttcttttgatttttaatgctgaacctttgctatatcactctttattttctgtggagaggaggtcccatgtgctgtgtttgctcatgtactagttctaggatttctgcatgggtaattaaatatttactaatatctacctggtacaaaaggtggacaactgtcatcatagggagcttttgatttgcttcttgtcttgggtgtggtggttttagccatcatataattggacaggacaattggcaattacttgaaatacagaatacagattcttttttttttttttttttgagacagagtctcgctctgtcacccaggctggagtgcagtggcatgatcttggctcactgcaagctccgcctcccgggttcacgccattctcctacctcagcctccccagcagctgggactacaggcgcacgccaccacgcctggctaatttttttgtatttttagtagagacggggtttcaccgtgttagccaggatggtttcgatctcctgacctcctgatccacctgcctcggcctcctaaagtgctgggattacaggtgggagccaccctgcctggctcagaatacagattcttttggtaaccttagatgatagtaggtgcttatgtaggggaacaagccccctgcactgaagtatgggttttagctaacctagttatagcagattccacatagattgctgaagagtaaa

SEQ ID NO: 85330 - DNA, 1017 bp, Homo sapiens
gtgagccgagatcgcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctcaaagatagagctgtgctaggaactctctacattctgattagtaacaattctgtcagagattgtctcagtgttaggtatcagtaagatgttggaacttcagttaggcctttagatcatgtagtccatatatcctttctgtagctacggtagggttttcggacacaggctcgctcccaaaagtcagttattgatgataactgttgaggttttgactgtaatatgcttcctagttgaaatataaatatttgtacaaatgtgtatttagcataccacacaaccagttttgtgaaacaaaagataaactagtaaagaggacaccttttaaaaatagtagtttatgtgtgttagtatatatccatttgccaatatattcatactagtaaaaatagaaaaaaatacatttgttaacaccttttaatagtgagaggtagaaatcttccccaaccaaagggttatttgatttttcttctctacttgtctctaatattaaacaactcttcgtctgttttaaatttagatatataggattattaagattcttttataaataattaccttcctaaattagcattttcacagctacacttttagagttattttttaaaaaacaggtataaaggtagaatatttacaaaaattattacatcatgctttgaacaaatacagatcacatctctgggctattttgacttttaaaaatatcc

SEQ ID NO: 85331 - DNA, 1094 bp, Homo sapiens
ggaggagcgctttagcaccttaggaatagacaaaaagagccctctgtttcctcagttttaggttttcttccacaggtttatgctgccctacatgctgactcatgggttggagagtcaggtagaactttttgtttttaatgtatagaaagtgcagttaaaggacagagtcccaatctaggattttggagacctggattcttgcctggtgcactgctcctatactagtattcactttatccggttctggactatttcccgtctttatgaatgaggacactgtggtatgagtgtcctcatgagtgaatgagtgaagagggatgttcttgcattgaatgcctagattgcatacaattttgaaacggtgattaaaagtatgtatacagctacctataattattcatatgaaactgttaaaactcattatcattttctttatatttgcatgtgggggttaatttttactgcctaagaactttgttgcataactcccaacattattagtaaatgctcatggttaaattgccctgtctcctttaaaggatttctaagtgctgtttgttaaactttctgtgattaaagtaattcttgtgaagtataaggaaagatgataattttcatatctggtatttgtgaagtttggtaatttttagtctcgtaacggtttttctctaccatgagactaaaaattattggtgtttttgacaaaattattgtgtttttttgacatcttttgtcattcttttccagagaattcggtcaacagtggatgaaaaagaacaaaaacaacttcttatggatttggatgtagtaatgcggagtagtgattgcccatacattgttcagttttatggtgcactcttcagagaggtaggaataaactgggttttagctgactaatgaatatctaattgggacaaatgaagatggcaggattcgattctattcttaaatgccatacattagtaataagttaatatctcagtatcttagtgtttaaccatggtaatttacatattaacttctgactctttttgcggtggtgggtaaggggtgaatcacacgtgtgtttgtgtgtgtgtgtgtgtgtgtgtgtg

SEQ ID NO: 85332 - DNA, 1027 bp, Homo sapiens
tctagaaagtggtccttttgtaagagtgcatggcaaacgttgatagaagaaacacattagggacagtggattctattcatgggtagtgtattgttctgggcaagtaattttacttttaacaggcattaatctcctatataatccaaggataggattgattatataattattatataatcgaaggataggagattaatgggtagaaaatctttgatgatacagctgtatttataaataagtaacaacatacagaactgtataattttttaaaaatcattttgatagtattttcatttttgtaaggtactttgtagttcttgttcatctgtgtatcctgtacttttacagttataatcatggtatctacttttattttttattttttcatgactcatgcatctctctcatgaactgtattcattttcaaaaaaattgattttagataatctctttaatgttgttgtattcccttttgtgagatagttcctcggtttctagttttgttttgttttttctttttgtaatttatggaacatttaagttacattcccagtcataggatgattctataaaatggtatcaacacatttatttctgttttattgtcaaattgctttcaaattggtttaaaacaatctataatgcaagaaatgtttgaatgattcagtttaattatagccagcatccagtcatttaacaagtatttattgagtctttgttctggcagaggttacattctagtagggaatatatgagacaaacataataaataagtaaattacactttatattagaggatgatgaaggctttacagaacagagcaggataagggagtgcctgatgggatgacttgcgctttgcatcagttaaagtaggcctcactgagaaggtggcatttgtacggggtcttgaggcatgggatttactttatgtatttttgtctttttcctttttttttttttttttttggctaatttaagaagtttatgtagtctcttaagattactgtcatctattttcattgtt

SEQ ID NO: 85333 - DNA, 1057 bp, Homo sapiens
aatatattaaacccgtgttatcttgaaacttactatttgtaataattataataatagaaaaatgataatagctaatggttattaaatgcttatttgcatcaaactatttgtgacattaaatcttcatagtaactctctgtggtaaatagtgttacctcatttttatgaatgataaatctgaagcatagacagattaaataattaatatgctttgaagtgtgtaagtggtaaataatctaaatccaggcagcctgatcccagaaccctgctcttaaccgctgtataacagggtgaccatgaaattagaaaacagaaaattattttatcatatattgcaatataaagaatatatactgtaaaaaatgatttattccatatttgcctaagtcaagacttggtgatcactttatatatattaagcacacatgtaaaatactttgtatttagtctcttcttgctaattaataaaccagcaaacaagcatagctattcacaacaaatttatgtgttctacatttcttgtacctagcagcttgacgtcagcaaagacgtcaccttacagcaaatagttggcctgttgtttagttctcttttagtttgaggttgtgtctcttttccttcccttcctgaagaaatgtgtaattttctgatcatgatcagtgaccaggcaacaggataaattcccacagtggtgaacagagtttacactagctcttcaaacatcaccttgaaggcttagcatccaatgagggtggatgatgatgaggaactgagagtttagaaaacttttttatttactactggacttagaaattgaaatcgattttgctgcaagttattactcttagttgaaatggaaccaactcagtgatcattgttgtcctgtttttatttttgaacattttagaggccaggcacaatggttcatgcctgtaatcccagcagtttgagaggccgaggcagaaggatcgcttgagcccaggaatttgagatcagcttgggcaacatagtgagaaccctgtccatactaaagatgtaaaaagttagccaggcatgc

SEQ ID NO: 85334 - DNA, 1095 bp, Homo sapiens
ctggactaagtaaatgaatttgtaagcctcttgaaaacaatttaatgcctaaatttcttgtgaaaattttttttgatattcagtttttaagcactggcattcagaaaattgttttcctttctcattttcaatagaagaaaaccattgttttttctgtgttttataaatatgaagatgttaagagaaaaatcaatccccatctatatcttacagattaatgtttgtgaaatgacttttgctgttacatttacacaattatagttattaaagctacatgtttaaaacatgaataattattgtatgtgataaatgaagatgttttacttcttatatatctgaatttaaggacttgaccacttatgttgtctaaggtttttcaatatttttgcttaaagtgaagccttatgtaacttaggaagaagctaattgtatactgaatgatatctatgtcttgcagatatcaaaccttccaatattcttctggacagaagtggaaatattaagctctgtgacttcggcatcagtggacagcttgtggactctattgccaagacaagagatgctggctgtaggccatacatggcagtaagtgttaagtccaggccttcttgcttgatagtcattgcacagagagcctgtgctcttttgtgctggccattagtcatacggttttaccatgaaactgctagaatatttcccttaccctaaggcccaagctcaggtcctagcctctccatgaaactttgctaaattatcccagtcagctcctgttttcattgtcttgctttatttctcttacttggtatttagcagttgtggtcttctctgattattgttttttcattatattgaactcaactcattaaacagatggtaacttctcagaaagttcccaccgtcccttagtgagacaaatgggaagccttgagttcattagcagaattcactatgtattacagagtctgaagctgcatattttgaatattgttagtccttttttttaggggtagatgaagcacaccaacaaatgcaaaggtagaggccttcagtattttgcaacctggagcctcttttcctgcaaagagacagatgtac

SEQ ID NO: 85335 - DNA, 1090 bp, Homo sapiens
agatatcaaactcatcttaccccagtatatttgcatacagtgttcctacagcctggattttgatctgtatttgaatgaaaatgtagtgtctgtatttcagacatttccctaggtgttaatgtctttcttcaatgttgccatggttctttggggaccagcacactactaaatgtgacacataaggttttgtggttgtttcttgaggcctccctgccagcagcatttctttccatctttgtagactgttttaaactaaagataagcttagaattgaataaaattgttctttcttggtttcctccttgatatatatgttttcaaacctagtgctataaataataaaaaagtaagagtcacaggctagatattataggtgttctagattatttatgaatggataggcttagtgctactacaaattcaacttactgcatttttcaatcctcttttggttttgttatatcttcccatatcactttttcttcagatgaacatgtaaaagcggtgtgtgtgtgtgtgtgtgtgtgtgtgtgtagacacctaacctgtgtggtaagaccttttaaacttttggttttgtggatgttgactggctgggcagatttcttgactcagtttggaagatcatttgtttatcgtgataactagggataaatggcacaatagtttcaaaggcaagaaataaaaaaaattagacatggagtatttgggaaatgtgatttacatatttattaaggataccccgagaatgaactgaaattgttatttacagttttagggcttgtctcgatactaacagtgactaaatgtttttgttgtgtgacactgactaagaattatatttgattgaagcaggctttgaaaatgcaattgcagcccagataaagtagaatattttgaattcagctttctaagaaagactcagactttctttaaaacagactttcgtcattcttgtgcagagatatgctttgcaggcccaggagatgtaagacttctgttttcttgctgaccttcatctgtggaacacaaaggctgataaactcttggcctctaatctttactggaccagatgaaattcttctgtcca

SEQ ID NO: 85336 - DNA, 1227 bp, Homo sapiens
aaacctattggaggtatatcattttatttgagatttatagttgtctttagtctacaggacttaggattactcattagattgtgcaacataaaaaagtaaataaaatgtagagtttacacataaattttcctgtaaaccgatttcttgtaaacattttcccaactccataccctcatgtaggtacacagtcttatgttgcttaaccgtgggaatatgttctgagaagtgtgttgttaggcaattttgttgtgcaaaatcataagtgtacttacacaaacctagatggtatagcctactacacacataggctatatggtacagcctgttgcttctagactacaagcctatacagcatgttactgtactaaatactgtaggtaattatatcacaacagcaactatttgtgtgtctaaatatagaaaaggtacggtcaaaatatggtataaaggaggtagaggtgacgggccggagaaagatggaagactaccaggctgcggaggagactgcttttgttgttgatgaagtgagcaaattgtaaaagaggctatagaaagcacaattggtggttaacgcttattaacacagcaaagtgaaccagtggaacacaaatgtagtagaacaaacttcaagccaactcaccaagctgggaaaaccacttaaatacattgtgacctgtgtaattatgcaaaagaatggagctggattacacatggcaagttcctgcttctgggacagctctgctgacaggagctgcactgtgcgatgggagaataaaaccatgtactgcatcgtcggcacctttggactgtgtattggacctcctagtccagcctgtgaccttcctccggtagttcatcttctaacaccagctatgaattgagtgaactcttttctcgttctttttaagtctgttttgtggcactctaaaaatgcagagaaaaaaaccaaatgaccgcactgttacatgaactgtgcactgaagtcagatgagtatccctgtaggtcgcctgcagcctgcattgccacttgtaactctgaatatttcttttcaaaggtgctaaaatctgaaatctgctggtgtgaaacttgctatactgtctgaaatgattcaaatacactaattttccatactttatacttttgttagaataaattattcaaatctaaaaaaatatggtataaaaaataaagaatggttcactggtataaggcactaatcatgaatg

SEQ ID NO: 85337 - DNA, 1085 bp, Homo sapiens
tttgtatcttttctttttctgtgggtcagtctagccaaaggtgtgtccattttattgatcttttcaaagtactgttggttttcttgacttttctctattgtttttctattcctgttttacttgtcttcacgttactttttcttacgttcttcctcctgcttgctttgtatttcatttgttcttttttttctaattctttaagctataaagtaggtttgatttgagatgtcttctcttctaatgtatgcattttacactatacattttcttctgagcactacttctatatcccacaaattttgggaagttgtaatttcattttcatttagttcaattttttaactatttcttgagacttttttgatccatttgtcatttagaggtgtgttgttaaatcttcagatatttgaggactttgcagatatcttcctgttactgatttctaatttatttattttgtgatctgagaacatgctttgcatgctttccatcttttaaaacaaggtgtgttttatgccccagaatgtggtcaggattaatcaatgttccatgctagtttggggaaaatgttgatcttgatgatgttggatggagtattttttctcttggttgaatatctgggattttaatgtgtaccttatcaggcaaatacttatatttacaacaaaaaaaaacaaagtaaatagcttacagtgaattttatgcagcacagtactcatgctcaaagcaatatacagatgtctttagttgatgctcacaggcagagaatgtaatacagtcaactattatgcttctctgggcatttctttcaacagcagttactctcagacttagcgaaggatccattgtcaactctgtgccaacaggaccctctctctctcttcccttttcctgacacatcatttagatggtccctaatttcaaggaaatgtaaagatgttctttcacagaaattactaaaaatgatttctgcggtacataggataatatattactgtcttggcagtgctttaatttggctacaaatgactaacagacaaatatctttacacatatgtgtagtgataaatttagcgttattgtga

SEQ ID NO: 85338 - DNA, 1093 bp, Homo sapiens
cattcccctgcctcagcctcctgaatagctgggactacaggcgcctgccaccacgcccggctaattttttgtatttttagtagagatggggtttcaccgtgttagacaggatggtgtccatctcctgacctcctgatccacccgcctcggcatcccaaagtggtgggattacaggcgtgagccactgtgcccggcctaattggtaggttttcattatttttcagaacagaaagggagatagatgagaatacgattcactggttattagagaatattttttttttggacccttgataggattgggacatacgtaagactcttcagatctcttctggtgtggcttagaggtactgtcctgagccctttattggggcttcaggatgcagggtttgaccctgacttgatttcttcactacttgtaaaatctggttgtggttgaaattgtagtatctgcagaatagctgtagagcaggatttgcacattgtttcctccaagctcagattaggcttttgtttgttggatgttcttttgccttaaaaaggagtctaaccacgattatggaccaaggccttcctctaagatggctacaaattgtgcgtattctatagtaaaatagttctaaaaccagtcttccagactttcttataaagaagtcagaaccacaggctgccctggagcatgcattgtagggacattgtctaggcttaagttttgtgttcccatgtattccaagtccttgaatttggttgattcagaattctctatattattttgatttctaaatataacttctacttagcctttatgattctgaagattcctccccaagctaacctgtgtttaattcaaggctttactagagttttgcttgtagtttagatttttttgtggcccttccagtggggagtagtaaatgatgcctggtgtattttgctctttcctctttgttctctttagtatgagttggccacaggccgatttccttatccaaagtggaatagtgtatttgatcaactaacacaagtcgtgaaaggagatcctccgcagctgagtaattctgaggaaagggaattctccccgagtttcatcaac

SEQ ID NO: 85339 - DNA, 1228 bp, Homo sapiens
aatttttaactaatcatcctacactgactatcctagagataaatcttcagattatagactcacaattttttgtatgtgcttttactgtgtttagcaggctgtctgcgttgttactttggatctgaaggaaagaactatttcattatttgtaatatttcatctgtgaaaagaaaaatacttaggcaaatgaatctacattttaataatgttatttttatgttattttagccttacgaaggatgaatccaaaaggccaaagtataaagagcttctggtgagtgtgggactgtggggattgtaggtacatcctaaccccggaactctcttaacatgctggttcactaagcaagcagtgggcctctctgtcataaacaaacatctcaaatttattgagtgttttttgttaatgtttttacacaaagatttggaaagagaaaatttgcagttataatttttctactaatactagctaaattctcatggaaaattttggtcttaacatgttataaaaattacccccaaagaattctgactttaagaagccattttccactgcatagtctatttatatgggatgcagccataagaaaaaaattagtgaaaatttgtgtttattctgcctttataaaattcatgcaaatttacgtcatatagcctattcccatttctttgaaagttctcattcatcccatggaacttgggtgttttaagcagtctactgggtatggcattggtggggcagggagaaagtgttgtgatctaataatgtgggaatattttaagaaaagatccatttgtttgtcacatttaactactagctcttcaaggatgttgtgacaaacttatatcacagtccaccaatgactgtaaaaatatctagtcaacatacttagtctgtaaaagaaaactgttgctagagatggagttttaaaaggtgggttagtgaagcagatactgggaccctggctctggagagtacagggaagaagctcctggggcaaatttctcttgggcctcttttggtcaaaagaattacagcctttttgttaaaaggtcaaaagaagaggtcaaaaggattgcgacctttttgtaaaaaggtcctcctgttgtatataggagaaatggaggttgagatttatattggtgtcccaagaggaatagtgactggcatttgcgtcattcttcttagctcttagatggtgtggtggaggctccagctatgttttgt

SEQ ID NO: 85340 - DNA, 1164 bp, Homo sapiens
cagacctcactgccaaggtggcaccttcagatcattaccacgtatcctctctctaggcatgcccatgcccattagcatatctgcatggaataaaggctgtactcgcctctctgaacttgtagtgttgcggtatttcatagctatgtgtggttgggagcctggagttctatgttctatagaaattggaaaatgttcagtttgggctgtcatacaaacttttgacttttttgttttcaattttcttgcagaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgc

SEQ ID NO: 85341 - DNA, 1049 bp, Homo sapiens
tgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagggaaaatgacctccttttggaagtgttttatggctgctttctttttcttcttccttcccatggctaccctttttgcttatccttcttgaaaccacagatgtatctgttaagcatagctttgcttgaacaggtgtcacagtctcttgagtttctttgtttgttgtcctgacctgccccagcattcttaatgctaa

SEQ ID NO: 85342 - DNA, 1041 bp, Homo sapiens
ggtggcttcttatgcttccagggactccagatggtttccaagtaacaatgtctaaaattgacttggattcatttttccttcccaaacacatgtgctttaacatgagggggaatttatgaatagcagagtcagattagcccagatttctggcatggtattgccacagatatagcctcacgtggactgccttttgatgtgttggatgccgagatagtgtttcctggtattcgttgtttagcagatgacagtcaagccgacccgtctttaatgtcttggcttcttcgtcaccctgcaggcgggcattggccatcacctcagaccagccaagtgaccaggaggcccctgacactagacttgggttgctggtttctcttggtcttggggtttcagtgccgtgctagaatctaaatgttcagaacatgtttatgcctcctccctggccttcctgaaacacaattcttctttttttcaggacctgtttttaaatgggggagatttttgcgccatggcatcatatcttatttttcagcctcatccatggggggaatgcaaaatggtgaggggaggttggatttcagaaaaagtggtcttaggtattgagagcacgttcttggaagtccaagcagctggttaccaagaggttctttcctcttctttgttggggctctggtggatgttggcctatggatgaattctgcctttctccgttggtagccattgtgttgtgcactgggccaggtgagggccagcctgtatcgcttttgatgaaatccagagcaagccttttaaagcaaaaaccagttcatgttaccttgctgctgaaaagcttccagcgacatctgattgtgcttagcatctcatatcttgccagggttctacaggaccatccttggttggccttttttcttaactctttttctccccattctcatctcttcacattcatggagctctagccgtgtggcctttcttgccccaaacacactgagctcatatccaccttgaggatttcgtttttactgttttcccattttttttgtt

SEQ ID NO: 85343 - DNA, 1045 bp, Homo sapiens
gaaagtttttgagtatatcattgtatttctattgtcattcctaatttacaattctgtttttccctttgacaagttttgccccagaggaagtctctccctaccccggtcagtaattagatttaagctattttcatttggatttctttctcattagcttttgatcagcacatatgttttctagtaaattctgcttttctcagatcctttcctcctgatttccctgagtttactttgttcttttcctggtctttagtcttccatgttgtgttaggataggttaagctctgctgtgataacacatgagctctggaatttcaggggcttaacatagcaaaagcttcctttaagctcatgtgaatgtgatgtgagtcaggaggactcccatggacagctctcctccgtgtgtgattctggaacctagtctatccatcttcccctccacctcaaaatctcagtatgtggttttcagtcagtgctaaaggtaaaagagaaaatagaagtggtatactggctcttagatgcctgggcctggaattcacaaacgtcacttatgttcacttttcatgggccagtactagttccctggatatgactggagacagggagcctccacccctgttgaatctccagcagtcttctttctctccgcttccactgctcatgactgtcttttgaatctacagtcttctctgccccgccctaccctccgacgttcaggtatgctcactgcaaactctgcctcccgggttcaagtgattcttctgcctcagcctcctgagtagctgagattacaggcagctgccaccacaccaggctaatttttgtatttttagtaaagacagagttcaccatgttggccaggctggtctggaactcctgacctcaggagatccatctgccttggcctcccaaagtgctaggattacaggtgtgagccaccatgcccggccagagaaaattaattttttgttttgagccctttctacaatagggagaggaataatgaagagaacagaaactatcctactgtactggaatggcacct

SEQ ID NO: 85344 - DNA, 1190 bp, Homo sapiens
acactgttgcctttgcagatgtgtgtgcacactggcttggttttcctagatgctgtttaagtgtgtcctctgacggacacttgtgcagtaacggcacagaccttcctgttttatcctcccaacaactcttaagagtaggttctggtgtctcccccattttctacacaagtctcagagcaggtgagtgccttgttgctgctggttgcatagctggtgagggaagtggtttgagatttgcttccagaaatgctggctctgacattgatatttttcatcactgtactttaatgactctgcagtagggaaagaagcataaacaatgaaatgtctaatattaatggaatgattaagtaaattctggtacatttgcacaattgtaactattagtgtttttatgacattcaaaaaatgtctaagggccgagagacatgtttatgatagggaacaggatatatgagtgcatacagggttaagattgtacagtattttaaaaaatgcatagaaaagtctggaaggaaatcaggaaagactagaagattaagcataaaatgttatctctgggcaggattatgagtgatttgatttctgctgcttatgcttttttttaacttccaaatttcttaaaataaacgtgtattttattgaagagagagagaaaaaaaaagcttccagggctcaaagtagacaactgtagtcagaatttcttagaatggtattttattttaactttggggccctaaaaagtctaagtacaaatatgtttccagttgccttgactcctggttttaaatgtgagaaatctcttatctttaatgttctggaagggacgtgatgtcagatctcattttctaggataaactagtctgccattggaaaatgatatgctaatagccttttaggccattgctactaattttaaagacataacattttgagacttggtctgtatgacacatagctgaaatttgctggttcccccataatcagttagggttctctggatgcagcagcagaaatagactctagctaattttagcaaaaaaggagttttgggaagggtggggatggttgaaaaatcaaagggaagagctggacagtgcggcctgggagtgaccacagagtgtccctgctgcagggcaaaggacagtgtcgtcagaggccactggcaaaggagttgcttcaaaattctt

SEQ ID NO: 85345 - DNA, 1037 bp, Homo sapiens
ttagtagagacaggatttcactgtgttggccaggctggtctcgaactcctgacctcaggtgatccacccgcctcggcctcccaaagtgctgggattacaagcgtgagctaccgcgcccagccaatttttgtatttttactagagatggggtttcactgtgttggccagactggtcttgaactcttgacctcaagcgatctgcctgcctctgcctccctaaatgctggaattgcaggcgtgagccaccatgcctagccccagagaagtccatttttatctcttacctatccagttggctcctatgaatccatccctgaattatattttatctgtttctcctttttaatttatttaaacttgatttaagagacagtgtcttactctgttgcccaggctggagtgcagtggcgtgggtcgtagctcactgtatgctcaacttcctgggctcaaatgatccacccatctaggcctcttgctttttaaatttctgtatcttaattatagtctgcttctctagcctcgacttttgcagggactcctttctttgtattcttgcccttagcctcttcttcctctgacttcccgcaacacagcccagaccatatttttgaatacatggactgaagaatgtaattttcctttttttcaagttttgttctgtggggaaaaaaatcctagcactgttggaaatactgcatactataaatttatcttagaaatttacaatctatatttgtatttacggctctaagaagttctgcagttaagaaaactcgtgatcatttgtatctcttggattgctttcggttataataacagatgtcataattcagagtggcttaaacaataagggaacttttattccaggatgatagggcatccaaaggtaggaggagtccaggtgtcttgtgattaagtcacttgctgtctttctctccatttttcttcgctttgccttcatctgtgtcttggcttgtttccctgtcaaaatacaggtgtttgcagcaattagggtgatttgcctccacgttcacaaa

SEQ ID NO: 85346 - DNA, 1177 bp, Homo sapiens
ggaaaatgatagatttttaaactattatgaaattagagcccccatgactccattttacaggagagtataccagtcaggagaagataagaaattggctccaaatcaaagcaagtaagtggcagactagaacctagtggaatccaggaactgcccaggtcccaaattggccgttgggtggtatgtacataggtcagataccaacaacatgacaagaattgaaaactctctttcctctccttttattgcttgagaagcttcatgggggaggtggaacttgaaagtgagccgttaagaatagttcagagttaaataaggagatgagcaggcagtctgtaggaagagaaccaagtacagagagttgggaatagatgttgtgtttcacagtcactggacagatggaactatttagaaggaagtgggtattgtggaggttggtggaaggtcaaatgctggggagactgggcttttagtggggctgtggaagctgagcacagtagttgagatatggtctgtgaggcagtgggagttactgaacgcagttgaaaggggaagtgagattataggcatggttgatttggaacagtaccttagttgcagtatgcagggtggattgaaaaaggggagcctgccatgaaggaagccaacaaagaaaatgtcaagtagaaggcagatctgtttgagcctcttggtttttaggcatatttgggtggtgagaaatggttttctctgctcctcagcactcttcttttattcatcttgaagctataaacttgagcaaagaaggtgaccttctccagttgagaaggtataaaactaaccatacacacccctgctaaaactgccacacaagcttttaggacaaaatcagtggacacttaaattaatttgagtggaatatgatgaggaattatattagggtagggaaagtcataaatcttaaatatgataaaaaggatgaaaattggaaaggagctttaagctgtcattattttcagatatgattgtttatgtaaactaaaaaattactgcaaatgaataattagaattattaagagtttagcaagcttgctcaattcaaaagaaaggtggggtgtatttattaatatatcagatacagtggacttcaaggaaaattacagagataaaggaagacattacatactgataaaagagtcag

SEQ ID NO: 85347 - DNA, 1512 bp, Homo sapiens
tgtatgcatctgagaatagaggctcaaaatacatgaagaaaaaagtgatagaaccaaaaggacaagtagacaaatccacagttataggtgaggactttgacactcctgtcttagttattgatagaattagttcacagaaaattagcaaggacatagaagaactgaacaacactgtaaaccaactggatctaattggcatttatagaatacttcactcaacaataagatatacagaggatacatattcttttctagtgctcgtgaaacattcaccaaggttgactatatcctcatccataaagtaaatttttaactgattttaaaatgtgaaaccatacagagtatgttctctgaccataatggagttcaactagaaatctgtaacagaaagataactaggaaaccccaaatgtctggtaatatagttaagtaaataatccataggtgaaaagaggaaatttcatgggaaattaaaaagtatttagaactgaatgaaaatgaaaacacaacatatcaaaatttgtggggtgcatctaatgattggagggaatgtaatagcattaaatgcttaattagaaaagaggaatggataccccatttaccctgtgattattatgcattgcacgcctgtgtcaataaacctcatgtagcacataagtatatatacctactatatacccacaaaaattaagaagtaaaagaagaatggtctcaaatcagtaatataaggttctaccttaagaaaatagaaaaggaggaacaaaataaaccccaaatcaggcagaatgaaagaagtaataaagagatgagtagaaatcactgaaatagaaaacagaaaaaaattagaataaatgaaaacaaaagctgatgttttgaaaagatcgataaagttgatctggccagaccgactaaggaaaaatgtaagtgaaaacacaaattactaatatcaggaataaacaacgggatatcactgcagacctggaaagttgtttaaaggattaaaaagtatcacacaccattttgcacataaattggacaatttgagtaaaatataccaactccttgaaaaccgcaaattactgaaattcaccaaagaagaaataatgtatcttgaaaagtggagataattggaatacttttattactataaatagagttctttttgaaaacaaaactctgggaccaggtattttcactgacagttgtaccaaacatttgagggaataacacagtctctttcagaaaacagaaggagagagaacacttcatatctattttgtgaggtctttattacactgatagtaaaatcaaagatattacagaaaaagagaattatagacgaacagtcctcatgaacacagatgtaaaaaatcttcacaaatcaaatgcagcaatatgtaaaaaatataaaacattatgaccaagtgaggtttatttaccccagtaatgtatggttgggccaacattcacaaatcactgtaatttctcattttaaatgactcaactggtaca

SEQ ID NO: 85348 - DNA, 1091 bp, Homo sapiens
agtctcggaagaacaacctttgtttctttcacttgttcgggcaggcagaggctttgaagaccatatctaaaaccctgaagaatggatagatgtctcctggctttttggaagagaaagaagttataaaggttttaactgtagttaactgccctaatctttatgcttttccaaatatgcccattagattttagtttggcatatgggaagatatttggcactgatgacaatctcactgatttggcgaatttatcatctatttgaacaaacagctaagtcagaagaggtgacattatagactagcagaaggcactggccaaatctgactgaaatcaaaacaggacagttgtgcaactcagcaaggattaaagacaaaaacaaaaacgtgggcatggggatgagtaagggatgtgttgtcttcaggtgtttccatttacctggttatcaattgatagaaaacaatgttatcagtaaaactgaagttttgagattagattattgtggtttttgtttataacctgggtcagaaggttattcacaaaataaaaaagttctaaatgtgccttgggccttggaatttgcatggcttcatatatgcagctctttcagctgtgatatccttaaggcaaacaagagtcattttattatacattgcacaatgttagaaaaccagtcttgttactgtatgagttacagaagttggacagacagcataggtggggcagatagctttccctggcctaccgtgagctagagagccattgcagtgcctgagcattaatctcaaactttgatcctaaaacaccaactagagaaaatagaaaagcaaaaaatcaaaacagagcattatgtttctttcttccaaaaggaagcagagcgttatgttcctttccttttggatgttttccaaacaatgtgaatcacggtttttaaaatctttactttcacaatgttgcttattaaaaaaacaacatctcagctttgtattatagatcaaccgacttcctatagggaaaggtaagtagtctagttattgctttgattttgattggcatctcctaggattattctgacactaccattagaagatttat

SEQ ID NO: 85349 - DNA, 1025 bp, Homo sapiens
ctgaagaacttggagtctgatgttcgagggcaggaagcctccagcacgggagaaggatggaggccagaagactcagcaaatatcactcaatattaaccatcacagtacttcacttaggaagtattttgaggcatcatctacatttatagcatattagacactgaaggaccgaaacgtgtcatgaaatgcccacgtcccagagcccctgatctacagaaggaggtggggacaaaacatgtactgctagagtagagtggagaaaacaaaaaatagaatgaatgaacatcgagaaggcagaggtgaatcgtttgcaagaaaggtttggcagtcacagaggacagaaaggtaaatgtgaggacagcaagaatgagggagctggaggcactggggcaggagcgaggcgtcctatcagaaactgtttttatcactgactgttcagtccttcatgtcagctagatgttctcaactacccaaatccactgtagataaaattcttcaagacatgacagagttaactcgcattttctctgttatcagggcggcttttgttacatggttgcaaacctgttctacacacctgctttgccaccttcacttcctgacaatttctgatttccacttcagcttctggagcattctgtctcctgcccttccttttcccttcttcctagtggactcttcatttacctctgcctggcttctaatctgcctcttgtcccaattccccatttccatgtgttctggccccagctcattctgttcccgcagacctgatttctcaccttatttcctgttgattccttctcagctgtagcaggcatgcctcagtctccccaaggcaggctgccttgtggcttggcagaacaaaaggcaggtggggaggaggctggatttagaaacaagtgccgtgtctcctggtggtgatgagtagccttgcaagagcccttcccagatgacctcagtccagatggagatggcacaggagggtgcaggaagaaaactgcagtttcaaacagcttctgtag

SEQ ID NO: 85350 - DNA, 1056 bp, Homo sapiens
cggaggttgcggtgagccgagatcatgccattgtactccagcctgggcaacaagagcaaaactctgtctcaaaaaaaaaaaaaaaaaaaaaaaagaagcagtgtctctatgtccacacatgtctgtatatgtatatagatatatatagaaaggacaggaaggggaggctttaggattactttaggtgttcagcagtagaagaccaccttgcacactgggtgggtaaaagaaatctgctcagcattgttctttcatatttcacctcgagctttataaaccctgccagaggaagatctctggggccaggagttcaagaccaacctgggcaacatagtgagacccccatctctaaagataataaataaataaacaaacaaacaaataaaccctacaatggacctttgcaaagagaaattagtcctttgttgtgtaagttgcaaatattttcttccagtctattgtttgtcatttattataataccatttatcttgtagcaatgtaagaaaattgtgtcaggaagtctttctttttttcattacaatttctaaatttggagtcctgcttgggaaggcctttctcaccataagattctacattatcttcattttcttcccctgatgtttttttcagcattttatttttttttacaactaatttaattcatttcctatttatttttctgggtgggtggtcagagtaatggaacatatccaaatggatatccaattgccccaaaactatttattgaataaccaatggacccagttatatttattcccaattcccatacttctttggactgtttattaaaatttgtctaaaattgagtgtctgtctacagaagtccaattaagtgagcgattaatgttgaagatttgagaaacacttgtgtgatgaagtgtctagcagagctctggcactaaatggaagatgttattgtaacacagaaacaaaaataacagagacagtgtggatataaggctttgaaatgcgttgggcagggtgtctggataaaaaagtcatgcttgtggtcgagctccaggtaaggccctgga

SEQ ID NO: 85351 - DNA, 1601 bp, Homo sapiens
gggaccttggctgggtcccttgggattcctgagcagatgggctttcaacctgaagctgctgtcagccaccttggatctgtgaggggagagtctgccaaagaatggagtcaaccttaagaaaaacagacctgagagacacggggagcaagaccatgtctcagtgttgtccttagggccactaaggccaactctacccttgcacgttttagtcattgagtcaatcaattgactgccaccatcattacatgtgtcctcctcctgagttggtaacgcaggcacaacataaatgaattcctccttcattgtcctttggagcatagggggcagccttttatcaaaaacatctgcattgatgacccacagacagagtgtcatggtggcacattgttccagtactggaaattctgcttctttctttcccagggatcataatctttcaggttcttaccaggtctttcatctgtgaaatgatggggttggatgtacagagtgttcttggtatctacatatgaatgttcattatacttgcacgggatggctgagctggtagaatcctttttaagatgattggggccaggtgcagtggctcaggcctataatcccagtactttgggaggctgaggtggcaggatcacttgaagccaggagttcgagaccagcctggacaacatagtgagatcctgtctctataaaaatacagtttaaaaaaatgagctgggagtggtggtatacacctgtagttccagctactcagaaggctgaggtgggagattgaggctgcagtgagccatgattgtgccactgcactccagcctgggccacagagtgagaccctgtctattaaaaaaataaaataaaaaaaaaggccgagcacaatgtctcatggctataatcccagcactttgggaggctgaggcaggagggtcgcttgggcccaggagtttgagaccagcctgggcaacaaagtgagacctcgtctctgtgaaaataaataaataaataaaattaaaataattttaaaaaattaaaaaaatttttttaaaggttattgcacctaatttccttacttaacagatgagggaactgagacctggagaagctaagcatcttcactggagaatagactgcttggaaacagcccaacgagaaataagaacttctgattgctaatcctattatataccacatttctaaaattccttgacctagtttagtgaattcatgtaagtttgtttttccctacaatgtgtaaaaaatctaatgtcattcactgagataactcaagatatttgagtctcaatctgagaactgacataatatttagcatgccatcttttgctaagtgtatttttataaaataaaattattgtgccaatttcctcccattttacctctcacaagtggatagttctagaatctttttaaacccatttctaagatcaaggagagacctggagacaatactaaattcttgagcaatatgaaaattctgcatccaagtattaatcctaaaggattctagggagaagctggtctgagtccatgtccctgatttcttctggggaatagcacaggggacaaataaaatggtggctattctt

SEQ ID NO: 85352 - DNA, 1050 bp, Homo sapiens
gaatataggatttggattagagatttaaaaataatgtctagatattttggaacgagcaagaaaattcccattttaggacgaaggaaaaggtaacatttggagagaatctaaaacatatactgtgttttcataactcctcttacaaatgtagtcatttggttaacattagcaatattaagataagctatctataacttggtttgttcataaatttataacatgtggtatacaaaatattccaatcttcactattttgtcatttttaaattttttttttatttttacaactggaaaaatacatacaacataataaaatttaccatcttaaccattttcaggtatacagttcagtggtgttaagtgtgtttacattgttgtgcagccattgccaccgcccatctccacaactctttccgtctttgaagctaaaactgtgtccatgaaacagtaactccccactccccttctctcatcccctggcaaccacttttgaaaatacattttacaatgtatgtaatgttcattgtagaagaattaaaaaatttaaaacaataagaacagagaactaataacactttgacttataccttaatgtattttttctctgcatatacatatatgtaactttttttttttactatgcatactgttttatagcctgccctttcacacttaatatatcttcaatagctttacatgtcaaataaatgccatcctttttaatattgaaagtcaatttatttaaataacccccattatatttttccagtctgtgaagggttggggacaaaagatgaagtacaaacatagacctttatagagcaatgctctgattacttttttttccatcctcaattatttcttgtcaacaaataccgtcttttttttttttttttttgagatagagtcttgctctgtcactcaggctggagtgcagtggcgtgatctcagctcactgcaacctccaactcccaggctccagagatcctcccacctcagcctcccaagtagctgagactacaagtgtgcacctccacacccagctaattt

SEQ ID NO: 85353 - DNA, 1012 bp, Homo sapiens
ccttaagtgcagccttgctgctttgttcagtgacttcttggatggcatcagagaagtcctccttgcttgactctagtccacataaatgtctttttggatgaggccagaactcccaggtagcatgttaaggaagatattgcaagagtcaagaggtgctgtagtgattatcagctccacatttcctaaagtgtattcacctggtgttcatccacacctcagttatgaattagccgttacatgaaatatgttttcatatttttagagattgggaaatgacaggtgaactaaaattaagccattttatgtattgcagaccttttcagagcctttaatatggtagtgggattctgttaatggaaattattgtattcagtgtttctctaactcgtttgttcacagaacctttttttttttcagagcgtcttatgaatctattttttcatggaacaaattttgggaaacgctgccatgacctaacaagctgatgtataacactggtggcaatcaagatttttgtgggtggtgttgattgttctcctgaaactcataagtggaacagtgcacaatttcaagatcagtttgcccaggctctgttttgcttttagtctctcgtatacagaaagtttaaaaagatatgacttgtacccagatgtcatctacacagcgcctgtcatcctgtggaatgactcatcccttgaaaatggtggatagtgctttttaccttgatgatgaataatgatccttgtttcatttacaaagatgagacctaaaataccagccttcctaaaaatactatcacctgttaggccgctgcgtttccttgaaggttagcttccataggtcaggccttcactaatgctctgctgaagtgcttcaggaatagtgaaggagggaagtctcagaggagtggagattgggctaagtgacctctgttgctccttccaactcaacagtcatgagtcttttccccagtcagtaaaacctgttctagaattttcttaaatccttttga

SEQ ID NO: 85354 - DNA, 1037 bp, Homo sapiens
tggcccttctggaagtaaagagggatgtggttgagccctggtttttttttggcagggcgggagttgggggcaaggtgagggcaggaaagtggccaggcctgcatgagcagagaagcacaggacctgtgagatggtctggcttgatggagagcctggctggtgtccagcaaagatggagcagagtttagctcaggaaagggcatcaataatttcatctgatgttggtcaaagggtacaaagtctcccttaagcaagatgagtaaattctggagacctgatgtgtagcactgtgtgacgatggttaatgatactgtattgtagacttgaaatttgctaagaggatagatcttcagcgtactcaccatcaaaaaaagaaaatagaaactatgggatgtgatggatatgttaattagcctgagtgtagtaatgatttcacaatgtgtgcatatgaaaccattaaaccgtacacctgaaatatatacaattcctattagttagacctcagtaacacaaaagggaaaaaaggatttcatctgaaaataaggattgcgagaccgctagtaaacttgttgggtgacttccaatagttctttaagaatagttcttcttttttttttttttttgagacggagtctcgctctgtcacacaggctggagtggagtggtgtgatctcggctcactgcaacctttgcctcctgggttcaagtgattcttctgcctcagactcccgagtaactggaattacaggcgcatgccaccacatctggttaatttttgtatttttagtagagtcggagtttcgccatattggccaggctggtctcgaactcctgacctcaggtgatccacctgccttggcctcccaaagtgctgggattagaggcatgagccaccgcgcctggccaggaatggttcctaaagaatttatcttgagcttcagtttaattgtatcttttatgttgtgtaaccacaggtggaaatcccaaatattcaaaagcagaggaaacacttagccaagttggtgctggacatggat

SEQ ID NO: 85355 - DNA, 1083 bp, Homo sapiens
ctcagatcaaagcacaacagggtaagtgcaggccttccctggagaagggagggccggggtgcctgcttgccttcccggatgagatgaattccttgtatgtcgttggccctaacactctgcccaacagcatcacctgtagatgagccttttggacttacttccaaactggtgccttgagtcgggggtgcgtaggggtgcccatagaacattaaccccagtggccctggacgcaattggctggccatcccccaccccctcctccagtcctcctgtcatccttaaaaccacagaatggaggctcaattgggcctccctctctttggtaatcttaggagaatctggacaacaaaggaaagcgagattccagcatgagtgaacttggcgaacagctgactgactctttctcactcctcccctcagaggcctgggtagagaagccttccttcgggaagccgctggaggagcacctcaccatcagcggccgggagatcgccttccccatcgaggcgtgtgtgaccatgctgcttgagtgtgggatgcaggaggaggtaggtctgagcacagccacacgccgccccgggcaggtctcctcttccacgagacagagcttacaggatcctctctcctgtaccatctccactccggcccccacgaatccaaatggcttaagacagtggctcagacccatcttctgcagaacacaaattgatcctgccttttaccgtgagccttcatttgacaagaagagagaattgtgatggccatgaggaacggatggccatattctagtcattctttcccctggtttaacatgtttggataatttgggcattctgctattttttttttttcttttgagacagagtcttgctgtggcacaaggctggagtgcagtggcgcgatcttggttcactgcaacctctgcctcctgggttcaagtgattctcctgcctcagcctcccaagtagctgggactacaggcgtgtgccaccacgcccagctaattttttttttttttttttagtagcaatggggtttcaccatgttggccaggatggtctcgatcccttgaccttgtgatcc

SEQ ID NO: 85356 - DNA, 1011 bp, Homo sapiens
cactgcaacctccgcctcctgggttcaagcgattctcctgcctcagcctcagagtagctgagtttacaggcatgtgccaccatgcctggctaatttttgtatttttagtagagacgaggtttcaatatgttggccaggctagtcttgaactcctgacctcaagtgatctgcccacctccgcctcccaaagtgctgggattacaggcatgagccactgcacctgacccaagaagttcttgataagtgttgttttattgctgtgtaaatcatttcctgggagatagagctcatctttggtttcttccatagactattttaatatctttactccgtcttcctttgatctgattagccaatcagtatttatttagggcatgcggtacgtgttttattgagcaaagtatgaaatagtgagataggagacttataaacttattgccggagatgaatctagcatctctcagttaagcctaattcatccagaacagtctgtaagtctctaagggagcactaagttatatgggacaaagtaagggctatggatgagaaggaagccagtgagcatgcgggtgtatgtggcatgcttcctgtaggccagcctgttctagatgctggaaattcgaaaaggaatgggaataaatgtgtatttttaacacattttatatgccaggcatttgcatgtttgttatcaaattttttagcttagcttagcttagcttatgagacagggtcttgctctgttgcccaggctggagtgcagtggtgcgatcttggctcactgcaacctctgccttccaggttcaagcgattctcctacttcagcctcccaagtaactgggattacaggctcccagagcctgtaatggaatttcagcatgctggccaggctggtcttgaactcctgacctcaggtaatccgtccacctcggcctcccaaagtgctgagattataggcgtgagccaccgcactgggcctcaatttaaaaccgaaaaggtctctaccatccctga

SEQ ID NO: 85357 - DNA, 2362 bp, Homo sapiens
agcttcctcacatatatgcccaaagagctttgcacatgtgtgtatctgatgtaccctatattgagaagggagttagtgatcctagcaaggcataagcttgatattccagagtaggaacactttttctaaaggaaattggaagtctatatggccataaaagattaaaggagtaaggactgttctgcctgcttgtttatcagcctgtgggttgcattacagaatgcaaggaactaagatgaaacagaaaccgataggtctttaacccgtgtgtcacttacctgtgacgtggaggtttctttccaactctgacctgcattcatcttctcttccacacagccctctcctcttctctttcgcttcatagctccctttcactctctaaggtgcagtggttcacttggaagaagtggcagtgatttgaaaataactcttgagaacggaatgcagaggaatggaaggaggctacctcacaaaccaccccacccagtctgcccttcccctgaaggcatagactttatttgattctaaaagtgtaggccgggtgctgtggctcacgcctgtaatcccagcactttgggaggctgaggcaggtggatcacttgaggtcaggagttcaagaccagcctggccaacatggcgaaaccccatctcttctaaaaatacaaaaaattagctggacatggtggcgggtgcctgtaatcccagctacttgggagactgaacacgagaattgcttgaacccgggaggcagaggttgcactgagtcaagatcgggccgctgcactccagcccaggcaaccgagccagactctgtctaaaaaacaaataaacaaaaataaaaagtatagccctggttcctcccaacacacatacacacacacacacacacacacacacaccccctgtagacctcctcacattcaacttaccagactgaccaggtcttagtcgaattcttctccaagatttatcttacacgtacaagaacaagatgtctaagtgcccaagattcatttatccagtaaatagttactgagccagtgtgatgagccacccctgcctgaggctgtggggacacaacagtgggtaaagccagttcctgctctgaagttgcttatgtgccaagagggagacattgagaaagcaggcaactgggggattgggagatggtgttgggcaaatgcatgtaagaggttttggagaaaagaagcaggcagttgcggggtctctgcgctttgatgttgtaccttggagttgctgtgcgctgaccctctgtcctgttggtagggactcttccgagtagccccctctgcctccaaactgaagaagctgaaagcggccctggactgctgcgtggtggatgtgcaggagtactcggcagacccccacgcaattgcaggtgggcacctctcagcgctcctgtgtgccatggaggctcacagggaaggggtagaggggaggctgtgtggctacaagtccaggacactcaagtcagtggctgcccaaagcacttcagatgtgtccactcagtgcccagtttcagggctgggtgctctggccccttgaaggaaggcctccccgcatgccaagggaagacgaggtaattgtgggaagaaagaggggccaggtcccctgtcagagcctcatacccatttccataggaagctaccatttgctgttgacatggtggtcaggaggcccatccccagatggaacccacataggcagtgctggctggtgggtcttgcctctgccacatcataacagttcacaaccaatatttcattcatgcctaggagctttgaaatcttacctccgagagttgccagaacctcttatgacctttgaactctatgatgagtggatccaggcttccaagtgagtaccccttgttttggaatgtcctgtgagttacagtttatttgggagtatgtgctgaaattatagaagcatgtaacctatgatctcgcaaccccgtttcttgatctctgccatgaaggagtgcttatacatttgcccaaggaggcaggtccagggatattgatggtagcattatctgagatagcagaagcctagaagtcactaaagattcattggagaagggggttgggaagtggctaagtaaactgtggagtgtctgtaccatcgcacactctggaacaattaaaaaataggtagagttattcatgctaacataaatagataatgaaaggaagttaacaaggactcctgtgacattctattgttataaaaacgaaaacaaacacccagcacacttaaaacaatagaattttaaaaggacctatatttgtgtgtaagtgtataaaagaaagttctggaagggctcacgtaggctgacagc

SEQ ID NO: 85358 - DNA, 1474 bp, Homo sapiens
catgcagaatacaggctcagaatagcccatgggctgagctccctgactggcatctgtgtcctcctgcagccccatagccctgccacaccagagcaggtctctggctctggcacatattcacttggggcctctgaggtgtgtggaggaagcactgttaaaatcgcacaggacaagacagaaggagaacatagaggggtaaataataacaaccaaatttttaaatactagcttgctgatatggtcagttacagtggttggtatcaaatattacaatgattggttaatatgatttccgatgagactttattgattcgtgctcaaccaatgacctttcctatcaatttctcagtgtccaggagcaagacaagaagcttcaggctctatggaatgcttgtgaaaagttgcccaaggccaatcacaacaacatccggtaagtggatacttaccaagtatagacacatggcttgggcttatgtaagcctcagagatacaactgcccgggtaaaagtcatggtaactaccatgcatagcattttatgatgtccaaggtattattaacatgcatggtctctttttttttttttttttttttttttttttgagacagagtctcactgtgtcgcccaggctggagtacagtgggatgatctcagctcactgcaagctccgcctcccaggttcacaccattctcctgcctcagcctcccgagtagctataggcacccaccaccacgcgtggtctctgtgtgtggtggcaccaccacaggtcccaagccaccctgtgagggaaggcaggaataattgttgccattttttagataaggaaatggactcaaagaagcgaaccattggctaattcagttaaaggagcaaagatgaatgcaagctatcttaagatattggggatttgtggtaaagacaggtaggtgttggtggacacctgggagaagctgacctacatgggagctgggggaggcagaagtgtccttgagcaagttcacaggaaggagagatgagggagcgtgttctccagtgctcccccattcccgagccctagctgtgttccacgtctgcctctcgcttttcttgctaccacccgagcttccacttccggcgcgctgcagatccttctccacgcctggctcctgctgcttcacactctgcttctttaccgctttgtcttgccagcacccatcccggccctgccgcctttcctcccagcttcttaggaggcagattttcagcatcagcacctactgccatctgcctggttatttctgttttcctgttaaaaatccccagaatgatgggatggcagttcctcaaacaattaaacacagaattactgtaggatccagcaattccacttctgggtatgtacctaaaagaatcgaaagcagggacttaatattttcacactcgtattcgtagcagcagtgttcatggtaggtaaaaggtgaaaagccaaatgtcc

SEQ ID NO: 85359 - DNA, 1027 bp, Homo sapiens
actcctgacctcaggtgatctgcctgcctcatcctcccaaagtgctgggattacaggcgtcagccactgtgcccggcctgtaatctctatttcaagggacactctggcctgaaggtgtccactgtctgtactaaccatgtccgtggattttactggtctaatatccataccatagtttcttcaaatctgcaaatcttagaatgcttgtgcaggaaggaaagatcctctgccccaaatccttcactttgtagatgcagagggggagacaggttcctgagatggatggggacttttattcaggacttgcagatcacctggatgccttacagacccaccttttgctaccctaggttgtgccctttgagttgtccctcagcatgtgaaggtggggctcaatctcaaaggcaatgagattcttttttttaatgcctgcttcaaaattaggctctgaagataacttcctaagagggagtttcagagatgttctgagccacagaagcctcactccataagtagatgactctcaatggtgacagctttgaagagatagcagttgttacactaaattcggcatctgcttaaaaacataataattggtactgtaccgtatgtttggtagacattaagggaatgctttttgctgtgctgcaacagctgttaaggcatgtgaggataggttagtaattctatgctctgcccattagaggtaatcaattaaatcaattaatgctgttctaacattgaagaagtttgattgtctttcttttgcttcatgtgttttaaggtcgaactgctgactccctaagagttgcgttgataacagagttgggtgggtgtgggaaatcaagataaagaaataaaggaggtaggagtcaagacagtaatcctataggttctgcggctgagctaattcattaccactgcacacagacagaattgtgcagagctaatttattctcattgactgggaaaggatgggatgagtacttctgtatatctctttgacagccaaaaaacaactttaatg

SEQ ID NO: 85360 - DNA, 1051 bp, Homo sapiens
tatatttctaatatcttgaatttattctctatggttttccagaaaggcagtgtcatcatctataaatattaatattgcctcttattttattttcttgactaattccattggctagtgtttctcaaatggtgttaagtaatggtagtggtagtgagcattgccatttctcctgattagtttaggacagctgtcggctttcagtcttaagcatgaggttttagaaagatgatttcatatatttcagaaagtatccgttcctgtttttacaaactttttttttttttcacaaattgacattgctttattaaatgcctatataggtgatcacatgtgtccccctttttggcctgttaatgtgatgcattatattaataaggtgaaccatgggatgaaattttctagggatgacatacgagggagtgggtgtctggactcattcctcccctgcccaggaagggtgtggcagaccaagagttcacatgtaccaattctttcttccccgcagagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatgggtatgaactggtgtctctttctcagcactggggattaggggaggtggtgggggtggatgggtgacgcataagaaaaatacaattacgggaaggctgcactgactctcagcagtttaggtgactcgtagcaattaaactgtatctgctgtgtctgggatgagtttctttggcttgccgccctttagaccagaggtcagtgtagccttcttagctgacacagttgtgatcagtattaattagttctcatcaaaagaaagaaaaagtagtcactgagtgcaattaaaaaaaatacatacgcactttatttggaatcaaaatgtatacaagtagatcaattccagaatttgtagtggctttactttgat

SEQ ID NO: 85361 - DNA, 1047 bp, Homo sapiens
gctgaggcaggaaaattgcttgaacctgggaggtggaggttgtggtgagtcaagatcacgccatgcatggcagcctgggcaacaagagcaaaactctgtctccaaaaaaaaaaagttaaattcaatgaaggtcttaccggtttagggtggctctccctgagttgtctgaggtagagcatctgtgcgtacgttttaaggaagtgtagtgaattgtagaagatcagttcttacctgaccttaaagagtgggtgtttttggagagaggagagaaatttgcatctcttgagtccctatgttatcttagtaacattaggccagttctctatattggccccatttctgatcttttgaaatctatgagatacattttaaagtcttcacactgctcattgaaaccctgacaaattaaagctcatgttattgaaggtttttggccaagttaaaaaaaaatatatatatatatgaattatatatcaataaagcagatacttatttaaaaagaagaaaattgaggggcagaaaaactgggtaaaattgcaaagaaatggtaagttaccgatttgtgtcagtgacactttcctaggctgatggctgttatgtcctagatgtcatacaaagcttcttacttccctcgcgactctgggctttggtcctgatgcctttctgatttgaaatgatgcaggaagctgggtttctttagcagggcttggtgaccagttcaggagcttacatatacatttttcatcattgtggtaggtaaaataatgcccatccaccaaagaaaaatagatctaaagacctggaaactatccatatttccttattttggaaaaaggtctttgaatatgtgattaaaataaggatctcgaaataaggagattgattattttggattatcaaggtgggctctacatgacatcatgtgcatccttattaagagggaggcagagagagattttactacacacacagaggaaatgtgaagatggaacagagagaaatttgaagagatggccacaagccagagattgccaacagccaccagaa

SEQ ID NO: 85362 - DNA, 1011 bp, Homo sapiens
ccctataaatagccctgcatgcagagtcttgagctttggaatcaggctccctctgagttcaaatcctggttactgaactctgaatgcctcagtttcttcatatgcaaaatggggaaatcatggtaagcaccgacttgaatcattctgagcattgaacgaaatattgcttacaaagtgtttagagcaaagctcagcacatggtaaatgttagctgttcttagtacaggaaccagatttttgagtgacatcctcatgtttttaagggggcaacgtggcggggcccactttcccactgatgaggcgtcccgatccagccctttccttgccacctcgggtgcttgaatgtttttatctgtctccaccttaccacgagcaattgagctaattctacaagcaagagatatacaaacaccaagggcttcgtgacaaagcacgaaatatcctaacagccaaggacagctgacggttgcaggaggctccccaggacgtggaaaaccctgtgtaagcaggaagtgctgtgaccattccaggctgagcctcctgcgccctagtgtattttgttttccaaagaacctttcagacaagatgacccttctgactcctgcctcctttactgccccaatgacctgggttgggcagtaagacttagaagggtttgcaggcatcccctctttatttgtttgttccttaagcttggaatcatctaagtagcattttagcaagcccctattctgaaacccaaattgggtcatccaactcagcagagccccgcgagactaagaaacctagggaaatgggactgataataaactccagtcctcatttttttccagtccccattttttgttccctgttctatttctttttctttttcttttatttcttttctttttttttttttttgatacagagtctcacactgtcgcccaggttggagtgcagtggcgccatctcagctcactgcaagctccgcctcccgggttcacgccattctcctgcctcagcctcctg

SEQ ID NO: 85363 - DNA, 1056 bp, Homo sapiens
ttgagacggagtctcactctgtcacccaggctggagtgcaccgtcgcagtctcggctcactgcaagctccacctcctgggttcatgccattctcctgcctcagcctcccgaatagctgggactacaggtgcctgccaccactcccggctaattttttgtatttttagtagagatggggtttcaccatgttagccaggatggtctcaatctcctgacctcatgatccaccagcctcggcctcccaaagtgctgggattacagatgtgagccatggcgcctggtcataaataagtaaaatgtttttttaaaaaaagaagtgagcagatgactacttttaccagtttctttcttccttctgcctctttcttccccatgccacaccaatatcaactcttcagctgctctctttacctgtgtgcatggtagggtatgacttacacttacacaaataggagagtcactttagagagaccaactaaattgtaataattttatagcacaataaaaatcccaccccaagaccctggaccatggagagagaccccttacagaaagacaacctttatgtccaaaggaaggcctagattttttgaaactaatatctgtatgtttctgtccctgcagccttaggaaaatccaaaggtatggtatcctctggtagctatgaggccatgctcagtctcttcaactgagccacctatgcatcgtagtgagttccaccagagggtgaatgcgccgcgtctggttgcttggccgacttatttgaagctgtgtgcccatcattaaaatagaatcagagcccagagggaccataggcacaagcagccccttccctgctgtgtagacaagtgggagtggcctgcagaggtgtgccttggccagggtcccagcagtggtggagctggggctagactccaagttacaaaaagaaggattcatatttagatgtctcctgctgtcagttccacgctccccccttcgctgcccctcccacctcgtcttgcacttgggaggagtgagtgtccctgcccccccagttaggccacacaccgctgt

SEQ ID NO: 85364 - DNA, 1122 bp, Homo sapiens
tcctcatttgagttctgagctgctttctaaacttcgagcagcttttcttgatgagacagttccagagccaagcacccaaatagtggctagcacagagaatgtccatagcaggtgtgtggctagctggcaggtggcaccatcctcaccccaaggggaaggagtcccctctgctggagccatccgtggcccgtgctgcctgagccggaggcagcattcacctgctgggtttctcccagtggcctagaggctttggtttggctctttatatttgactgctgtttcctcatcatagtgactatgatttaactcatgttttctcctaagaatgattttggggttctccagccaaagacttaaactttggttccagatgtccaagaaacgtttattatcattttaaatgttttgtctttttacagtatgattcctgccaaatgccttcaggaaggggctgagatctccagtcctgcagtggaaagattgatcagttcgctgttgcgaacatgtgatttggaagaggtaaggggcacagccgcaggcatcatgggggcgaggtggggagcagagctgcagagccctccagccccaccctttcagtttcagacctgtctggtgcggcactgcaagcatgcgtttggctgtgcgctggtgcacacctctggctggaaagtggtctattccggggacaccatgccctgcgaggctctggtccggatgggtgagtagaggaagaagcaagccaccctgaggttgctctggggtttgtgtagctggaggtgaatgcaggtgggcttgcagggaaacgtcagcagaggcaggagactcaggtccccaccctcagagtctctggttgtcatcctagtaggcagacccagggccaggggagctgagtgttgagaccaggaaacagcacgtgactgaggcctgtgtgccgctctcgcagagaactctgccctgatccttgtgctgcttctccagggaaagatgccaccctcctgatacatgaagccaccctggaagatggtttggaagaggaagcagtggaaaagacacacaggtagcaaaggccggtcagtccttgtcgcccacatcctctccctcccccactacgtgacactgagc

SEQ ID NO: 85365 - DNA, 1025 bp, Homo sapiens
gaaagtgggatctcaggcctcactgcagagctgccgaactggcttctgcgttttgccaaggttcctgggtgtgaacatgagtttcagagtcactcctctagggcccctgcttctcagctcggaccattgacccctcagaggacatttggcaacatctggaaacgttcttggttgtcacagcctaggaggtgggtagtggtgctgctagtgggtagaggtcaggggtactgcaccaggacagcagcactggccacagaaaaaaactgtcttgccctgagcatcagtagttccccgttgactggccctgaggcagagcgatgcagcatccaaaaggcggtggagcagacctgccccagatcctagtcacttaaccttcagtgttgatctgaaggaacttcctgcagattgtccccctgaatttattctggacatccccaatggggtctgctgaggccatataccctgtccgtcacctgagatgcttctctctcttcctgcagggatgccattattacttgcaatcctgaggaattcatagttgaggcgctgcagcttcccaacttccagcagagcgtgcaggagtacaggaggagtgcgcaggacggcccagccccagcaggtgagtgggagcccacagagcagcctttctttcctgggctctgcccctgctgctgttttcctagcattaagtggagtgctggtggggcgcattctaacctggcttttcagtctaatccagggcttctctactcagctctacattagaattatagtcattggaggagggggctttggggagtttaagaatcccaattcctggctgggcgcggtggctcacacctgtaatcccagcacttcgggaggccgaggcaggtggatcgcgaggtcgggagatcgagaccatcctggctaacatgatgaaaccccgtctctactaaaaatacaaaaattagctgggcgtggcggcgggcgcctgtagtcccagctactcgggagactgaggcaggagaatggcgagaacccgg

SEQ ID NO: 85366 - DNA, 1438 bp, Homo sapiens
gtttggttgaggattccataagtgaattccaaagaagagattgcagctataaaatgatagcttccatttactgaatgcccactttgtgggaggcagtgtgtgaaatacccttcatttcacttcatttcctctagggtcgtcgccagcagccctgggaggtagatgtttagtcactggaaggcatctttttcctcggggcatcgctggccagggccaggtggaggagtatgagttgagctcgggtgcggggtgaccttgggctgctttttggcccctgcccgtatctccccacatggcccgtttacctgcccctcactccatggcctgctctcctgctgtctctttcattcctcagggtttgggtcccctatttgtatgccctggacatcttctttttcttgtttttcctctcactcttcccagcacacctgaaaggcagctgagctagggaacaccgggctttgagacagcaggagtgggaccatgtttggccatgtagtaacactgcttggggcaagtcactgaactgtttgaacacctcatcctcattaccactcctgagctcagcaccactcctcagggggagctgcctcctaacagacgctgcaaatgccgggtctgtttcttcacaggtttgggcctgacacccagcacttggtcctgaatgagaactgtgcctcagttcacaaccttcgcagccacaagattcaaacccagctcaacctcatccacccggacatcttccccctgctcaccagtttccgctgtaaggtagtgtctcagaccggccccttgtcggcccagctctcgtcccctctctttctctccatgaatgtgttttgtctctttcagaaggagggccccaccctcagtgtgcccatggttcagggtgaatgcctcctcaagtaccagctccgtcccaggagggagtggcagaggtctgtgccatcttgaactaatggaatcgtctcagtcgagttgggaaacatttctgtaaatagccacatagtaaatgttccaggaggctctccagaccatatggtctctgttgtaactattcaactccgctttgagcacaaaagaaacacggacaataagctaatgaatgggcttggctgtgtgccagcgtgaatttatttagaaaagcagcctactccaggctgggttgaggtgggcggattggggccagtagttctccttttccaaaattgccttgcatgggaatagcagtgatagagctcgtgtgtttcacagtatagaaaataggaaatgtgtgatgaacaaagtcacccataatcctgttgcccagagataatgattgataacattttgtgtttcttgatttgtgtatgtgggtttatattgtcagtcttttcctgtatcactaaacagtcttaagtaacaagatttttattggtattccaaatagggatgttta

SEQ ID NO: 85367 - DNA, 1473 bp, Homo sapiens
ccttgttagtactaactaatgtgatgcttactaagtagtgctgatgggtgacagaccagagcacccagcaaaggccagagaagtccagaacctggcgaggagatgaggcttacactgactgaaggcagaaggcagcagggaggagaggaatgtgccggagcaatggcacaagtgctcctaggccagtgctgtgatgagctgatcagcactcccattgcctggcttgctcctcctgctcagatgccttctctcacctgacccctgctgtagccacccccagcctgagttgcatccacctgtttgttgtccatttccagcaccctgttcttcgctccatggcatgtgacagttaactttcatatgtgatttgcgtgatcgatgttaacatgctcagttttgccgatcactgttttttcagtgtccagcggccctcagtgagtgaacttacgttcattctcgttgcagctgtgctttagcttcttagagcagcgaatttttttcccttgatcttgagccttaactaaatgtaaaatgaggctccttcttgagataggtaccctttgggtctatgtgttttagcgggagtgatgataataaataagcatgtctacaacccacatgctgtttagataacacgttgttgagttggtactgtggccgaggctgtgagctaagcagaaacataaacattaataggacataggtgcagcccagaaaccaggtaggaagttaactaactagttatttcctactgtatagtaaaaggtgtgctgatttaattggcgttctggcattcccatgtatgaacgtctgggccttggctgtcagctcaccttgtgcagtgtgtaatttggtggtatctgtactgaccaggtgaacagaggaggggaaagcaccaaccatggcagagtccagaaaggcctctcagcaggctcagtccagagcgatcttcagactccgagtcgaatgaaaatgagccacaccttccacatggtaatagtataaacaaaacagagcagcagaaaggcttgcgttttcttaattctctgccttgtaatgcttgtagagagtcattattgtaagaaagccaggtgtgtaaacagatccttcttcctgggcttactataacttggcccgttgggggaatgagaagggttgttgtaaaggtggcagcctgcaactttaataatgaccagtccacagttttggccacccagggtctgggtaggcccaaaactgtgttctgttttcccagaggagaacagggcctgacaaacggattcattttgtatttttcattaatgtaacatttatgcaaattttccattaatgtggaaactataactgctaagccaatgagacagtcaaatcagtgagaggctctgcacgtcttccagaatgacagcccactgggaaacggagttaaaagtccaagatgagatgtagctcaggagtcaggccgcttcgggagtt

SEQ ID NO: 85368 - DNA, 1059 bp, Homo sapiens
tccagctgcgcaggggggcttacagcctcttgatgggaagaggcctcactgaggatgctagtagggctcttgtcctggcactggtgtgtatctgtggcttgttaatactcctcttttatagaaacactaatactttgtttcaaaatatacatcagctcttctggtttgcgatgataggttccctggcttcactattctgtttgttaacttgggtctctgaaagttgagtactagtttcttgtttttcaatttttaacggatagtcaccaaagattataatgtcttttcatctggctgtagtaaatataaatggctgaccaaaatacacttttatttatttcctaaaaatggtaatctccttagaaagtctggttttcgtgtcagattcccaccataattctgaggcaattcagttgctcgtggttggtgatcctgaagttactcttcccacacatcttcactaatgcaatcactttgctgttgtgtggttttcttgtagctgtgcggccccactctgccccagaatacgaggatgaaaccatgacagtttaccagatccccatacacagtgagtatgaaagccaggtttcccaggaggagggtgtacgtcctgagtaaagaaaacatggatgaaaatagaaactgaacacttgctgtgggcaccctgttttgtgttctgagcatgattagaaaatttagttgaggaatgaagatatggctcctgccctggcttataaacttacggatgtctgacttatgcctaatgatagtgattatgctttggaatattagataatcaagcactgttggtaaatagattgcattcaagtttgcacattcattgcttggaggttttttcccacaggcgtaataccctcttttgatcagacgatcatgaagaggtttgcacagatagatttttttaaataaataatgattacagcaacctaaaagaagtgttgttgggggttagaagctcctgcaaattccgaagtatcagggccagatgatgtggtcttagcttaggaaaagagttagtcttgtccttgaacttggcta

SEQ ID NO: 85369 - DNA, 1014 bp, Homo sapiens
ccctctaactccctggccacttcaggactttcgcccttccgcgggttccctctgcctcttctaattgctgcctatattgttactgaaccttcagggctcagctagagggtcatttactccagaactgcctcttcttctctagacaagttggatcccagccttctgtatttttcattttccttgcagagcacttagcataatgccactaagctgtttctgttatcgtgtttccttttgtctcctccactggcctgattagagcaaggcctccatctctttttcctgctatatccttggcatctgatataatggatactcagtaaatatttgtaataaatgatgttcaaaatatttactaagctttgttttatgttgatacctattggtaaccttttaaatacttgaatagttgctgtgttctacatttgttcaaccataactgctcatttctttgtttttcattaggaaaaatacctcgaagcaatcaaaatattttctggtccattgaaaggaatagaactgggtacgtctttgtctgtgactcatcctctgctatttctaacttatatatgccctgacctctcaaattagaatccattaaaaacatcaacatcaaacctcaaaatcaaatgcttcatcaccacgagatttttttttttttttttttttttggatagagtcttgctttcttaccaggctggagtgcagtggcatgatctcggctcactgcaacctccacctcctgggttcaagccattctcccacctcagcctcctgagtagctaggactacaggcgcatgccatcacgctcagctaattttttgtatttttagtagagacggggtttcaccatgttggccaggatagtctcgatctcttgaccttgtgatctgcccgcctcagcctcccaaaatgagctaccatgtggctggagatgggatttctaaatagtgacattttctgtgttcccacctcatgctgtaaaaataggggccaggtcggcaggagtgatt

SEQ ID NO: 85370 - DNA, 1050 bp, Homo sapiens
accctcttccgtgcaccccaaggccagtgtgtcgttgttagcgtgtggggtggacagatctggtgtgtagccggtggtggagaaaggactcattttgtcctagcacccacacacacaggcccccactcctctccacctctgctaaggagggctcaaaacccaccagcataaatgtggctcggtagtccaacgtggacttttaatttttttttcttttttttttttccagagtctacaataaaacatctaattggtgtcagagagtttacagaataaaaccttctgaatgtcttgtgtaatgtttgtcttgtaggtatctcttcaactgtggagaaggcgttcagagactcatgcaggagcacaagtgagtcagtctcttgctttcggagggggagttgattacggggcttgaaagccgaaatgagaggccagttgttttttatagcaaaagtggtccttgttctgttcatgttatcctgtttaaatgttttttcattcttaggttaaaggttgctcgcctggacaacatattcctgacacgaatgcactggtctaatgttgggggcttaagtggtgagtatattctttgcagtgtcagaggctggtgggaagtctctgggattttaaccggctttaccatttttccaagtctggggtgggcagctacttttttttttttttttttttttgtcagtggcgtgatcttggctcactgcaacctttgccttctgggctcaggtgatcccctcacctcagcctcccaaatagctgggaccacacgtgtgccccatcacacctggctaattttttttgtatgttttgtagcgacggggttttgctatgttgcccaggctggtctcaaacttctgcgatcctcctgtctcggcctcccagagtgctgggattacaggcatgagccaccgcacctggcctggaattctttttataccagcccagtcagcagcagcacagagcattaaaagctgtgactcaggagaacagattttaatatggataccacctcttaagtgttaccatccacttagtttc

SEQ ID NO: 85371 - DNA, 1022 bp, Homo sapiens
gtgggtttcataaccaatttgtcttttcttttgaggtgaatggttttcagatatgttcaggtgagagagcagtagattagatgcttcaaatgactaggattccttgggttaaaacatgtttttgagctgtcataactttctactcttagtggtatctttgtttatccatttcagatacatttccctgagcttgtcattgtgcactactctttcttggtttgatttctttgcattttaaaccactgctataaagaacagaatatattttaactatgcatattcagctatttttaaaaaatcataatttagtactcagttaacttggtatatggaatacggttataccccaaaattagcatattatttttaatacatccccccctattattttaaacatcaaaataattctcccaaataattttttttcccatctagtcactgtggtctgccttaacgttgtggctttttcataagatattatagtgaaaaattttggccaaaacttaaggaaaatcgttttcattaccagaacacccaagaggagttggctcagttttaaaacaggaattcaagttaccagcaggaaaacagcttggctgagtggacatataagttgctagtgtgcaaaatacgtgaatttaatgtgataatgcctatagtcattatggttctacaatatattgtcagctatttggagaaggatcaatctatttcaaataagtttttttgttgttgttgttattttggatgtcaaaacaatcttatagtgaggttcaaatagtgctaccactttaccaaaaagatcatccccttctataaagcaggacaccatctcttccaagtagtttcttccttttgctaccttcccatgttttctggtaaagagaataaacatgattccaccatgaacatatttttaatgaaaatgcgaatgaaaagcaatataagccaaattgatttatttgtccatttgggtctattttttatttttaaaagttactacctctatttggttatacatc

SEQ ID NO: 85372 - DNA, 1055 bp, Homo sapiens
gaaaaaaacctctcagttggatcaagaaagtatttggaggaataaaaattgaatgatttacatttagacagaaattgaacataagccaaggttttggaaattttaaaaggatgtgtttaggtggctgcttgatttttagtctgtagaagtatttttgctatagggagcgagttggattctgtaaattttaaaaatacgggggaaagccacagaatgcatgttgggattctttctggtcctgaaaaggtgcagtgtctgcctctttcctccttaggctggttttccagccctgctccgcatcccacttacacagcactcctgatcttccgctggaactccgtgtcatgttcctccatgtgtcactcatcccacacagccctctgcagtgtcctgagtgacgtgagttcctcatcagtgcttgtggtacaagtgaatttctccatctttttgtacccctcatattgcttccttccacttgtctcaggctgtgatttcgtttggaagcatcacaacactttaaaaatctcaacgattcccagtagagtagaatcctagtgttatcattatggtatcagtcagcttcccaaatcataatatttcccaataatgttagggatattttagttccagtgttaggcaatcttatacatttaaaataaaggaatgcaaaatcatttttattagtgtttttaaatagggtaagcagaacaaagagcactgggcaataagggttcaacagagtttttgggcagcatataaataaagaaatagtccttagcaaaaaggaagagtttactatactttttttagagggctagtgttcaaattaaaaatacatatatgcggttggtctgtataaaagttcttcacttctaataaaattctatgggaggaaaactttccttctgttcgtatttataaaaagattcaaattttatttatattttgtatttattaatattttcttttagcagttattcatttagttttcagtattctttgtactctatttctgtgatctctgtgaaagtagaaaaaataaagctttggaaagc

SEQ ID NO: 85373 - DNA, 1021 bp, Homo sapiens
aacttaaaataatggggattaaatacagcttctgaccttaagaacataccataagaccagattctcagttcttataaaaatgttcagggatttataaattagaatatcaattaaggacagaatttactgaggctgaattcctttcatgattttcacttactctgattgagcgcgtggctgaagagtgtatttgagtgagcatgcacaaagtgtaatgtattttttccacaagaggaaaaatagtttataagttttccagcagaacatattcagccatcctaagaacctacgtcttaagtaaagtcaggttacatcagaaatgaccctctttgtaaacactcagtgaacattcaggctttaagactttaataccttcaaaaagcagttcacacttccacagaattttgtttattctacttagttcaaatgcagattattgatgttggggaaggcagttgaaatcctcttgacattcacccacctattagaaagtaattctgatttggctggaccagaaaggagaatgccattacatagtagaaagtgctgatattctttgctgttattttcttgaaagctattttctggaaggatccatgtatatgtattgattacttttgctggagataaaaagattggttcctactctgaagtggcttacagtctggtagaggaagacagatgaataaataagtgcaataaaacaataacatttattggctctgtaacagaatataggcagtgccttaggcaagtaaaggaaggtgtagggagtggccgtttctacctgtgaaggtcacgaaagcttctcagaaaagtgaccagaacatcaaaaggttagatgggttttttactaagtatgtgcatgtgataggggaactttccagacagagggagcatcatgagtaaagacccagagatgtgaaattttataacatggaggaccatttggggaactacaaacattgcagtgtagcagaagcacaagtttgggaggatactgtgagacatttggctaaag

SEQ ID NO: 85374 - DNA, 1032 bp, Homo sapiens
tgtcatgcttattttcatccttatttttatcatcatttctatcaagttgaaatctcaatagtaattgaacatagaattcgtaattgcattctaaatgtcagtataggttagtataatagtaaaaaaattcagcattcatttttaataattcattgttcaaagaaatatttttgattatgccattgatgttttactacaaagcctcaagttgccagcgggtgacattaacaccgtaatcctctgtgaaagaagtctagcccttaggtgtttgatgaatactttagagttaaataatttggtgaaagacctatagtcatatccatatagaactcttagttgttagatagaaaacacctaaaatgaatattcttaagttatggtaattagggtttacatgtagttgcataaaaatgtccctatattagtttatttaaccttttccactaaggtcattttaatcaatagttgtttgctacttgatttccataaacttgcaagttagatagggcttaatttaatcttttctagaattttgacacattctcctctgagatctcctaactccttgtatatggctctgttatatcatttattaaattgcacttcagtatatttttatgcatctgaatgctccactagcttatgagtcccctcttgctataagggcatattttattcatcttaattcttggtacctgacaggcactcagtgaatggctgctgaataaatgaaggagagcatgggtcaacaaatgagaacataaactcaacaattaaaaggggctaaacacacagtgttactttgtttctttattactgcaaattcatcagatctgtcatttaaaaatgaaactacattttacgatgtacagaggaagatggtcctattgtttgtacacattttcttggaaatgtattagtcattgagcttataataaaacaagttgaattaaaatttgggtaataatcaccagtcagagtggctattattaaaaagacaagaaataacagatgttggagaggatgcagaga

SEQ ID NO: 85375 - DNA, 1033 bp, Homo sapiens
atagaaggctctactgctacagctgataggaagcgacagcatgcctgttttgcacaacattgccagcttattgataaaaatgtaagaaaattctacaactctctaaaatggaattttaggttgttatttgtaatgtttacagtgtcaaattcgttctttgttgaattagccttgtattaagggtattgccattaacagggaaacaatttggctattgaaaaataaatttttactttaatactgaaaagcacattgtaaaaatttaaaacatattcagagccagacgatgaaatgcagctcttttgggaggcaaatacatttgagagaggattacaaagggaaatgcctatgagtttaaagaactaaaccaggactcctaccagtgttagtagttgaggcatgtgtgtattcatctttattgtatgttctcagagaggacttcacggctaatgttctgggtagtagatggcatccaattcactttcggtttttaaaatacatgtcaatacttaagtagggtagacagcagcactaatcatattaagcacagtgtctgaactcacagtgaatgcataattaatgtattgttttagaggacctaatatattagtcaagggcaagagcttcatgcataacttgttctgtgggtgaggaggagaactattccacggtgctgtttgtaccaccgcagctaactctgctcactaaatctattttgttacacctctattaggagccaaagccatcagacaacctccattaaagtgtttgccacggagaactctctctgggatagtaaatgctaattcagtgtcaattagaaaaatgcttctaacaaaacactacgattaataaggggtacttgtgttgattcattgctgggtttttttttctttttctaattccttataaggatgcatctttcattactttctatttattattttaaatatgtttagcttgaaggcactttgccatttcatctttattttaaaatgtatccaaatgtttacttctccatcaatatccattt

SEQ ID NO: 85376 - DNA, 1016 bp, Homo sapiens
aaactactgatatctcaattgagacagcacgaaggtatgatccttgtattactaaatatttcttcccttgattttctgctttatatcactttgcatttataagccctttaccgaatggtggtggctgtgtgtgagcataataatttgtatttttaaattttttatccataatattttcctaatcttaaaaaattaaattttatatattttattcagtcttacaaatatattgttctaccttagaatatttttatgaagtgttaaattttccagaggatatattcatagtttaacctctaacctgttaaattatttgagaagaagaaaaaagacatgtttgtagcattatgaaatgtctgtttcaaagaatacccctgcttattttttacttttcctatgtttattctgatgcaaaattatagcttcaaatacttattttctgtttaaaaataattaaatattaaggaaaaattatgcaatatgactacagaaatttattaataatctaataatgttgaaagagctatgtaattagaactttaaccattcttattttcagttcattttagatttattttctaaaagaaacagtacaactcaatcaatttggaaattttgttgagatttttaacttaaaagcttgtaacatggtaacacttacagcttgtttagaaatgtgtggtgtttgtgaagttctttacaaaggaaccaggtaaatcttggcttaatgttgatttgataaaattccctaaaatttccctcaaatgtattaaaaataagccaagtttattaaaaataagtcaactgtgattgtattttctttaataatcaaaagtattgaagaagtacctatttacatctaaacatgaaaattgttataaaatgttttcatgagtcatacaataaaggaagctttgagagaacctggttatccattaatctttattacaccaatttggactaactggatttgtaaaaagttcaaattatgaaatagttttgaagaaatataatac

SEQ ID NO: 85377 - DNA, 1020 bp, Homo sapiens
accaatattttaattataaaatttctttggaactaatatagctattttgttatgaatgaaaatgtgtttattattagtttagcaagcatattactgattttagatattaggttggtagttctcaaattttaccgtgtataaagaatcacctggggagctgattgaaaatgcagatgcttgtctccactcccggatattctactttgggtcagaagtgagacccagggatctgcatttataattaaggactgcagaagattttgatgcagatgaaccctgaactgcactttgagaaacacttaatattgaggttttttagcattgtattgtagaagcaatagagtgttgattttgtactctaaatgtgtataaagaacatcgttttgttttccaaaaataaatttttattcaaatatggaattactgttttttcatagtcttcctacgtaacctattggaatttttagatttcaacattgcaattcagtaatacctgtgctctgcaattgaaatctttttcaaattcatggccagcaactcaggaaaagtaaaggcatttgagtagcaaagaaaagagcttggaatacaagttgagagccaccaaaaagtgctctgtcaatagttgtgtttcatcaaataagttgtttggattttgttttcttcaggcatttttaattttccttttaaataatgacaaaagaaattaaaaatagtaagttggggattagagacgaagatagagaggaagagaacattggcatcaaacaaaacaaagaaaatgtaaaggtgattgattttaagaagctaaggagtttgagcaatctaatgtgacagcaagtacactgagtcattcattgggaaagagatgaaataatattcagtaaattgttttgaaggctcagaaatacgagaaattttagaaatatttccatcaaaactggtttcaatttcattaatatttgggtatgcaaacaagaaaattacttcattaatctagaaaattcatttgtatgcaacatc

SEQ ID NO: 85378 - DNA, 1226 bp, Homo sapiens
taaatcagcttccctctcactatccagagacaaggattgtaaatattttgatgttttctccttccatcttttttcagaaagcattgcttgcaaactgagatctctctggaaggaaaaaggggtcagttccatacagtgattcttggagctagtaaaaaccagtttaagtttctgagtgttttacttgtaggatgtggtactttgcctctgataagtgctaggtgaccttttagatcctttattttctcctttaaggatgaagccttaaaatccagcctagtgagagagggcctgagtaatctgtttagaggagaacattgccccagtcaccacattgggtgaaaagccacttctgatgaatgccagagcacacacattcattatttcaaatgcctcatgggggaaaatcaatgggaaggagtcttacttagtttgtttattctaggtaaggcaacagagaattggtaaccagagagtaatggctgactgggtgtctttactgatttgtaagctgaaagtaatggcacatggaatcctgctggataaggtgcctctccctgtgctttattttttttgtttttaacatcccttttaacttggtctgagattgatcgagacattgtcttgaaccctggaagctgtgagccatattggaatgacaaacacttgttgacagcgttgagaagatggatggaaaaacaaactcccacgaggttcacatgtttgttttcctgttgactctctagaagaatgttgtgaccattatttaatgtaggggaagaaaaagttattgtcaaattcagtattttctgagcctaacttacagacatctctagaatacatctgccttttgcataggatgtaattaatcaaagtaggactaggaagtacatcagttgggctgtggtatttctatccatttttgttatctgtgtcattttggctcacagagttcaatagtatcataagtatatattgtctgttaggaagattaataagtgtattttgtatctgagcattaactatttggataatatataattagaattaatataatatattttaatatattactaggtaattatatatactatattaaaatataacgttatattttataatataaaatgtattgttagtctataacatatataacaatatatttataatatattaaaattaatattcactaacataaaaatatgtataataaggaagcacaaacg

SEQ ID NO: 85379 - DNA, 1092 bp, Homo sapiens
tgtcacttatttgtctttttagcactagtgtttatttttttctaatatttatagaacacatattgagtacaacacactctacaaagagctatgattcatacagacataagtaagaaatgatccctgccactcaaatctagtcagaccaggaatttctgaaatctgttacttacgtttctcttgaaaaaaggtttcatggtgaaataaatttgggaaacactgcctaaagtaaggttaatttggtttcttcactttgggatttctcagagattttattgtgctcatatgatttgaccatagagtcgttcttcctgggagcatctccggggatggtaagggaacatagctggggaagtactgacttcagccttccattgaattattgtttcgtctgttgatttggttctagcccatttagtcaaagatttcttaaataataacctaatcagcacattttttgagtactctgttttaccaaaaaaggagacaagtaagagacattaataacaaatttaagaacatacttgtacagtttgtcaaggctttggaaaattagttttgataataccttgggccttgtcttttaataggtaaacaattaaaactgtacttcattgttaggatgaccataccaatctattgtccaagctaggatgctttcagagtgagagaggttgctgttaatgatgctggcaccaagatgtaaattagaactatcctgggcagaataggatgattaccttcattgcagtataacctcagtttcatctgagatctctgagatcttaattacgtcagccctggttctttacatcagtagcccattccccagggtcagttgattcttggttgattctcaggctttgggttgtgtgaaagattctgaaattatttacaacgctaatgcttcaaacctgaaactatacagttgagccttgaatgacatgggtttgaactgtgtgggtccacttatacgtggatttatttcaaccaaacacagactgcaggatgtgaaacttgaacttaaagagggaccacattttctcataggcaggttctggagggcctactgcgggagttgagtatgtgtgg

SEQ ID NO: 85380 - DNA, 1048 bp, Homo sapiens
gtcctccagctgagttccctgtcccaattccaaatctttatgagagaaaatttgattgctccagcttgggcctgatagttccatttccctggggcaaaggaaagggttataaggacaattaagcattagggatgggaatgggaggacaaaagtacctaaggcaaagggaaggatccagggcagcttccacgggactttacgtggcacttggccagatgtgtatctaaagctatgattctgctttgtaactttctagctataatctacctccccaactttcaacaaacacattatgtcaaattctttctgtgtgttataattaaagccaaagagattcttaatatttaccaagtcttaatttcgcttcagagatgtgtttcctagttcagttaaaattggagtttctgttcatgttctccttgttttcagagaagacagagagatgtagacaccgttcatctaccatctcttatcaaacctgaggtccttcagacttatatttttaaggtatcttatatatattttttagtgatatcctttttgctggtctatcctaatttaatatttcttaaagatgtcaaggcctactgtttcttttaaatattttagaatcaaataattattttcttcaattcctcaagagtgtattgatcacctgtaatgtacaagcactgtcagttttgtttttataatgctcaaagttttataatctgggtgaaaaacctagccacatgtataaaatgcttaacagacagcataaggcagcccagaaatatgtgttgaatgaaatgaatagatcggtacaaacaagaatttctctggaaagtcagacaaagaagaaggacagagtggacagtgaaaacttcctgcaggcagagccaggactgggcctttcttcttgttatttcagagacatctgtattttgattatgtctcttttgaattatctattttccagcttggtaacgctgacagggaaataatacatgtcagcattagtttttccaacttaatggatcagatgagagtgatccataacatgtaagct

SEQ ID NO: 85381 - DNA, 1040 bp, Homo sapiens
agtgggtgacctaaccaggccggccgcagtcagcactggagtggagcggcttatgttggctcagcgtatgtagcttggccagatggggaccagcatcacattggtaatggtatagtagttatcaaatctcagagagcttccagaccacgtggattcctaacaagttcccaggtgatgctgatggtccaggagccacacttagaatcatggtgtggaggatctacccagaaattccaatgaggccctctttcctaaggtaactgagcccagagacacccaagaaggccagcttagcctttcttctcctcatcttgcttctagaaaccagatgtcagagtaacacttgaactggaagcaaactgctaaggaatttaaatgataaaaaggagtaaaaggactaataaaaaaaatatttcacaaaaaatttaaatattgaataaattatgaaaggagaaaactcaggtgtgtatgtgtgtgtgcctgtgtgcgtctccaggcttgggatgctttcaaaaatccatctaggaatgggaagagccgatggtttttgtttttttaatcaaaggctgaatggtatgattaagagaaagagtatatagactaattgacctaaaataacaagaaatcagtctttgacataatagtgtttgagatctctgagatttagctctgaccacattttatgagcactaaggcagaaaatcatagttgtgtttaactgagatgaaaaatgaacactcttttctaacctttttctatctaaaagatagatctcttgattaaaacagctaaatttcaacaacctgaatgtaaccatgatatttaaagatttcatggtaaatcaaacttaataacccacatattatttgatatattctctctttattccaaaaccattattattgcttgtcctctttctacttaacagttccaaagagagtcctttactttttttttactgatgtctcattgtatacaaatattctaaagaaaatcctctagttacccctttatttaacttttttcctctgccttatttc

SEQ ID NO: 85382 - DNA, 1020 bp, Homo sapiens
tggagtacagcctgacagtacgtgtcaaaatccctacaacatttgcatatcatctgacttagcagtttcacatctaggaatttatcttcggaatttcttctaaccagagctgtgaacaaaagtctacccataagatatttatcccaacatgctttttgatttttaaaaatggaaaaagactgaatgtctgaaaaaaagtatattggttgaattaattgtggtatatccaaagaataagccactgtgtgttataaatattaatgatgttgatgcaaaaaatatatttaatagcctggggaaattattaagatatattgaaataaatcagggaataaaaccacaatttagcatattctcaattttttttaagtagttatatcattggaaaaaggcagagaagatatcaactagtatgtttctccgaataactcatgaagaatttcttctttgtgattttctagaattgccagttttctgaattggatgtatattacttttgttataaatgttttaggaaaaaatgaaacataacaggaaaataaatttcacacagtttgcatttggagtacctttgcccataacacaagaaagctctgaattccactgattgagggctcctcgtgccagaaggggaaggattccttcaggtgcctggatgctgagagtgatcatggcatcctgggtaaatagcttcattttcgtttgcatggcttgtcagcctacccagttttcattcatgcccttgtgcacactgatttaaacaccaaaattgagccacatcattttctgtgacttcaacaaaggtcagaaactaaacttccacataaaatggcctatctcaataaattaaattcatgtgtgctcttctaaaagggcttttcgtaacactaatgtctctgaatccaactggcctccacagaacttgaagaaggagtaaacaaccttcttcttctttttttttttttttttttgacacaagggccaattcaggaaaaataaaatgtttatcagccacatttt

SEQ ID NO: 85383 - DNA, 1096 bp, Homo sapiens
cagaatggattattgagggtgcctgagtgagtattgtggaagtaactgaccacagggttcagaagagatggcccaggaacaggtgggtggaaatgccacctcaaggcagaatgtgcactcagaagtctctcagctgtaatttatggttcttctgtcacaagcaccttgacagcaacataccccttatattttctcattttccatcaaaattctcattctgttgggtcactctttgggcacagaggctgcaggccaggtaggaaagagtcagtgctggcccctatagcagagtggtagagtggtggccagaattctccatcaagtcacttctagctttcatattctgttgccctgacttcattccgtactgtagttccagctgctgggctctcctctggcaccctcccggctaaattctaactcgtcataattctacaagttagtctttttcctagaagggccctctcatagatacaggccctctctcctgccataggaacactgcaaccctgtgcatagaagggtatcatctcacatgtgtgcacatagggtaaagtctgcctctctagggagttggctgtttttaaaaccagagcactctagaagctgcacactggtgactcttgcttgctaagaaacgtgttgtggaatctgtaatccagcagggtcactgaacactacacaaacatatcttactcagaagtggaattatggcttctgctaggagaaggcaggcttgagtaacctccttaggtttctcaagaaagaataaataaacatgcatataagcaggaactagtagatccaatttatctagactctcaaaaagcctttcacaagattctatacaaagtctacttttagaagttggctcttttgagaaacaggcttataataatcattatcattgtagagttttagatgatgggtttcatttgcataaataacactgtgcgacctccccttgaaaatcccgtgtgcataagtcacgttacagcactggtactacacaacagccacccggtgtttactgttgtcaggaaccggtagcatgctgagcctgtaattcattacagacgttgtaatgatggcagtc

SEQ ID NO: 85384 - DNA, 1064 bp, Homo sapiens
cctacatttttttggtggtatgtcacaactaaatttgtggggtgaaaatagctcatttttaccatgtgtaagggaagtttcacagtctaattagtcaagtaattagtgtttttgaccgacacttaggaaggaagtggtgaggtttcctgcaatatatgtaagtacatatttttcacatgagagatcaaaaggcagttgaccataaaccgttaccctgtaagccacatttctgaaacttttcataaaagctcttacactccaatttggcaagcttacaaatgcgattacacctttaccatgattgtctcttagaatggttttaatatcctgtaaatgtcagattttaatgaatctacgaataccatattctaaaacgtatgtgcttgtgtgttctgtgataaacctaaaaccagagccccatccatgtgggaggcagtgtcagcaaagcggtggtgagcaaggaagccggcggcgctgcctggatggggagcccgaccccaccgctcatgagctgtgcatccttcgcagctgaactcagcctctttctgccactgtctcctcatctcccacatggggctaataatcttctcccctcctggagtcattgtgaggatgaaacaaattgttatttgtaaggtgctggaccatggtgagggctcaatttgggatctgtatgctgttgttatcattcaggagtcctccttcatacagtggagggactggcacagatcaggaaatggaagattttgtttggtttgtaagctgagcgatgcagccttgtcctctggctgttattttgaagactgaggcgcctgcagcctggtgggaaagagtgctggggtcctttggtgaggtttgcagtggatgagggaagggagggtttaaagcctgggcttggcatccctgggctagatgacatctgcgtgttcatcctggtttatagttgaccttcacagagcacacctgcacaccaccagccctcctgctcccggtcacgttcctcttccttagttccacctggagctcacctgacttgaccccaattccctctcccccttaacgca

SEQ ID NO: 85385 - DNA, 1056 bp, Homo sapiens
gcagatggatgttgtgaaagctaagcaaatgtgaattgttcttgatgtttgctattttataactgcacaatgaactgtaagcagctcagcttttctccccgtcacagtgccaacggctttcagtccagtgcttgctacagagagtgctgtgccgcaaagcatgggcccagcccagagagtgctctttgtggttgttctgtcagggtagtcaggactctgcggcccagctgcttctgtgcacaggaaataacttcattttacaaagccctctgtctataaaggtaatcattataatgggattttacttgtgtccattttcctctcagcctcagagttaggccttttcctctcacctgcctaattaccttatcttaatttttttttaattcagcctaactgctgttagcaaaaaccattaaaaatgcttcctagctaagattcaggaaaggcagaatgagagggttgctttctggcccctggtctagccagcttgttgtcacaggaactgccgcacttggtttgattctgcacacagggaatggcaatgacagaagtgacctgctggagccgcggtgaaggagtccactctgaggaggtaggggagggaggggactgcagataagtgcccagccgacattccagctgcaagcgggcctggagccacacgcattaggcctctcaacagtgtttatctccagagactattagtgtatctcagaggctttgggttaaatctgctccccctccttcttgccaaggccccctcttttcatcactccaatatcttagaaaggttcagattatttttcctcattttcctaaatttgaataagtcccatgtttcgggagtgtatggattgggccttcgtaatgaccatcttgtagagtggatttgcagttgcctttggcttgtgattcaaatgtgtgttaagcattaattatgtcacccaacatttagttacaaatgaggactcagaaatgggatcttatcaggaagtgacatttggcagatggatggttttagtaacaaaaagagaatgagatttttttaccctc

SEQ ID NO: 85386 - DNA, 1011 bp, Homo sapiens
tctagtaccttaaaaaaaaaaaaagagagagatctgttttaatgacaaaactatcaactagaaggcattttttcttggcagtgagtactgctagggaattaaaaaggacagaggaaaggttggaatgctcaggtgcaactgacggagtaaacagggtgatgcaagtagacttctttatattttgatggtaaataaagtgacctctggattttaaagtgactggtaagaggaagcgttgtcagagtcttggggcgtggggtcacgctgagactttgaacacgaggtacagagaagcccagccccagctcacgagctgtctcagattcaaagagtttgcagttatgacagccacaagcacgggggaagtgtctttcaagaaaaacaacatcagtgataacttagaaatgggggaaggaattggatcattcagagctcagtgtctgctttgctctagaaatggctcagaaagagcaacctcagctgggaaaatggctaaaataccagctccaaatgtgagattttccttgtctttctcaaaagccctccttttttgtgtgtgtcaaccgaagtattttgttttgctcaatacacttttttcagtaatgcttctgcttaaaataaacataattaaagaaatcattttcctgagagtagcatgctgttttctgtaagaggaaattgggtgtgggtttggctcatgtcacaaatgaaggaggtttggaaatcacagcctagccttaatggattgtaatcagaaaaccaccacccacacacggctttacttgatatgcttcaactgcctctcctcctataaaagatgaaaacaaattactttcttcatcaagataaggtgaactagaacaggaagacttgaattagtgccggggctgtggtggaacccaccttccttgtggagtaaacataaagcactcagttgactaattcaaagacctcaccttccttcaagataagtattctactcatctcctctgcctcaagctcctaaagcag

SEQ ID NO: 85387 - DNA, 1037 bp, Homo sapiens
tctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagact

SEQ ID NO: 85388 - DNA, 1050 bp, Homo sapiens
ggcacctactcccctcacccctacctccaccccataggggaattcaccatctgaaccggggtctcggagaacgtgacctctcaccttccagggaggtcgccgggaggtgcttggggtgggtggaagcgtgcagtggcctctgctcatattttctggaaacccctccgttccctgggtggttttagacgtgcgaaccgcttgttttgtttccaaaagcaaaagatgttccgttgcaggcgggcccggctgggcgctgggcactgggcgctggtcctgcaggcggctgctgccccctctcggcggcaggcggcgcgaaggctcctgacccgcgcgggcggtcgggctgcgggcgctgggccaggccgggccttccgctagtgcgcgggaccctccctctgcgcgcgcctccgtcgctcggcccagtgcgttcggcctcacgcccagcgctctcctcgcaggcagaaactccgctgagcagaacttgccgccagaatgctcctcctgttgctgagtatcatcgtcctccacgtcgcggtgctggtgctgctgttcgtctccacgatcgtcagcgtgagtgcctggcggggaggctccctgcgcggcccgcccttccccatctgggttcccagcccgtgctcctgctggttcaggactgtgttatttgcagacagttggaagtctcagacgtcccagggaagtttctggcaatctgcccccttccagttgctttgagaaaacgagagcagattcagtgataggaaccaagcgagcgctgggctgggttagctgcgcaggtctctatttaagccaagtaacttcagagccgatctagggtccccgaccttcatttgacaagattgtttaacttttttttttcttgatgcagcctcgttgaagaagaggagtatttatgatttttttttctccaaaccatagtcagatgggtgaattaatttataaaacacccttttaggacttgaaattggaaagttaaaatgggcttttctggaaaagagttcacaggtcccatgtcggctttatggcatgaac

SEQ ID NO: 85389 - DNA, 1034 bp, Homo sapiens
tttttagtagagatggggtttccccatgttggtcaggctggtcttgaactcctgacctcaggtgatctgcccgccttggcctctcaaagtgttggggtttacaggcatgagccaccgcacctggcaaaataatttttctatagatatcattgtttaaattaatttaattctcagcctattataacaacacaagcatgagcctaggatatcattaacatctgatgttgtggtagaaattgtctgtgttccgtgactgtggtccagaagcattacctcctaaggcaatttaacaaagaaaaagagtctaattcctttgaatggggaactctgcttaagcccgagctgggactcgcaggtctggctaacaccgagacttaaccagccatgactatatgaattccgccagagaagaagcagctggatccagtaatgaagccttggtcactgggggaggaggctgatcctgggggaggaggatgacctgccatgtctgatgctcagatttgtcccttggttcagctcttcctgagtgccatgtgcgtggcgatcaatgattcaaactctcaaacagctctttcactaaaaatcctggaaggccctggggtacacataaaaagtggggcgagatcttgacttcacaatgcatcaacaagaaggtcccaccgctctgggtatggacaagaaacagccaggtctggtagacccaatgggtggttggcaggaccagctttgctcatgaggaaccaagagacatccttggcactcccagaaatagacatggagcccttgctaaggcctgaagttcatcacgagcagccagggcatggagtggaatgcaggttattcctaatgtaacctcatcggtctgtccaagctggagaggcccggggtatctcaggttacactaaacatatttaacttacatctctcagagggacctggctttctctaatgttccacagcccgcagcctctttttatttatctcctctgcatatggaattgtctgcttggcaggagagctgtttcaattag

SEQ ID NO: 85390 - DNA, 1034 bp, Homo sapiens; identical to SEQ ID NO: 85389

SEQ ID NO: 85391 - DNA, 1594 bp, Homo sapiens
cactaaaactaatgaattcagtctaactgaaattgcgtcttcatcaatatctctcctttcccggcctctttcctctatccacccctgctgcccccaccacagcctctgatatcagctttctactctgtttcagtgagatcaacgtttttagattccacttataaatgagaccacacagcatttgtctttctgagtctggcttatttcacttagcataatgccttccaggttcattcatgttgttgaaaatgacgtaatttccttcttgttaaaggctagctagtattccgttgtgtatatgtaccacgttttctttatccattcatctgttgatggacacaggtagattccatatctcagctgctgtgaatagtgctgtaatgaacatcagaatgtggttatttcttcgatatatgaattttagttcctttggataaatacccagaagtggaattgctggatgatatggtggttctattttttcattttttcaggaacttttgtaccatttttcataatagctgtgctaacttacattcccaccaacagtgtaaaagggttcccttttctccatatcctcaccaacacagcaagtgtgaggtgataatctcactgtggttttaatttgcatttctctgatgattagagatgttaaatattatttcatacgcctgttggctgtttgtatctctttttttgagaaatgtcagttcaaatcctttgcccattttttaatgtttttttaccacaaaaatgtaagttggtgagctgaggatatgttaattagcttgactgaatctttctataatttatacatagataaaaacatcacattgtgccccataagtgtacacaattattatttatcaactaaaattaataaataaatcaatacacttaaaacatttaagaaaacactaaaaaacaaaaactaaccaaacaaacaaacaaaatacagcctcttagacttcactccagatctattaaacctacattccagggtgtggattatggaaataggtgtttgtaaatagctcccaagtaatttagaagtacctttcatggaatgacatttgggaacactgggctatcataatgaaaaagagagcaaggattgagaaacactggacaagagagtccaagatataagacccaggggaacctttaaaaatttgcacattttgggactgggtgacatgtggttggaaggaacgctggcttatggattttgcggagggaacggaaaatcttatgggtctatctagaaagctgtgtggatgtgattgtgaatctccacacacatttctatgtgcattacccaccgtatgcactcaaagcgtggaaaacatttcacagcctgctcgactcctcccgtctcagcaggctgtgtatctccagagttactttggggagtgtgaactcatactattagttgccaatgaaaaatggaattaactatgagactctcttgcaaaataaattacgtaatgtgttccaaagatgaaagaaattcctaagggattgcctgcccttctggataactatattgccacattctttctctcttgagttgagagttaagggttgactgggt

SEQ ID NO: 85392 - DNA, 1032 bp, Homo sapiens
ttgatgtatgcacaggggttgttggagatcaagggagccacaggccacttcagagttcctggaactgtgaaaagcagaaacaagaaaacaaagttccaagctcactgagatattcacaatgcttacattgaaaaataatgcttgtcagtctactaaaaatgcagtgtcatattatcatatgatcttaagttaattgcaggatttctaaaaattaataatttagtagtgtatggcaggaggcctgccagccctgtgtgccttggatgtggggcaactaaagcgcactccccacttttaagaagccattgacccagtggagtaaacaaacatgaacaaccaacaatatcacaatgaaataagtgtgagtggtatgtcaggagagccccaaagagggaagatcagaaaaggcctgacagaggtgaagctgggctgggaggaagggaagtgcctcttgattgaggctctgctctttctcctcttcccttcttcctgtgtctcctcactttccttccaccagatcctttccacttccccagccccgctattgtctggtcttagagggcaggaaaacgaggtctgctggtctgctttcagattttgtttaactatagaagtgctttggtttctttgtggtttctttgagcttttcagtgagaaagaagaaggcagtgggaatacattggaaataaacttatcagtgctttgtagcatcaccactgtggtgtgattgccccttgaggcgtgtgagaggaaaggtggaggaagatgaggctgacaaggttaagtggggcagagtgctctggcactactgggattgtagggaggggaaccgagggacatcatggcacaaatctggaacccgagcaaagcgagttttctgaaagataactccagcagtgatgtggagaattcttttaatggcaagagaccagatgctgtggttaccttgcagaagcaaggtggatccccaccctaaatttagtttggatgtcaagattgacgccatcacacataccaagagagcatgcacat

SEQ ID NO: 85393 - DNA, 1854 bp, Homo sapiens
ttttgtatttttagtagagacggggtttcactgtgttagccaggagggtctcgatctcctgacctcatgatccaccctcctcggcctcccaaagtgctgggattacaggtgtaagccacggcgcccagcctagcatgtctactttttaatgtgattgggccattgtatgtaaggtaatgctctgcttagaaatatagaatgttttcctaggcctaggccccaagtccatggtgtgtgaagtgaaataactttgatgttaaggagttctttttttgtcttttgcggaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagttaatgaaagtgttcatttacacagataatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgtacttcatggggaaatttcttagacgtatgcaagcaagtgaaaacaattagggccagtggtattaactactttataaaattttatttttgtttgtaagaagttatctacttaaggcccagttaatataagtggaatcatcatagtttaaggaatacccagagattgctgctattctatttattttacagaaaggatagctagattgaaagttcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcatttgacatgtgtaatctcatgtaaccctcatgataaatatgtaatactttagatgatataactgaacttcaggttaatgagtgactttcccaaggaaaacagattgcaggaatatctgtaggatataaaacatgatatattagtattttttagagaaaatatttgctctaaatgccctttcctttcttaaaaattaataatttgttaagagcttgtttattttacttagctgttctgtctggtgagaattgatactgcactaaagacattttaaaatacaatctgaaagatctaacctaaatctttagggttgagagtctaacaaaggatacattggtgtagttctttaggtaactgtgttatttgaactgcatcctaaaccaagtaacaatgaa

SEQ ID NO: 85394 - DNA, 1041 bp, Homo sapiens
acacttttcccttgcaggacttaactcagttggtaatggtacatttgtgcattggttgtctgcctctcttcacctctttccctgaggaaggagttggtatctgttagtcactgttgtattaccagcacatagtagatgctcagtaaatatttgttgagtaaataaagattaggaaagctatcaaactaatttgttaccttagtaagtaggaaaagagcttggtacacttgagagactgactgaaggccagtgtctataatcattttcagggatatgtagttgtaaaatatatgtagctatagtcaggatgtaaagtaggtcacagtaaccaaatagcaaggggtttagggaaaattagggaactggagaaagggcaaattgttcatgagggaaaagagaaggtgtaatgtttatgggtggacttgttgcttgctctgtcacctctacccctattagtcctgccattaccattttacttaatcgtttagccaggcctgatacatagtagtctttgctaactggatattatggaggtaaagctgaaggtttttgtttgtgaaatgttacactaagataggagcttgtgacagatctttaaataatgcttttaaaatgtgcctgtttatattaatcttcaccagaatgtcacaggtagactaatggttggcctacgttggtggaatcacattgatgaagatggaaagagccattgggtgtttgaatctagaaaggtaaagtgccttttttgttttaaataatgttatcagctaaattatttgtagactatatttaaatactggaagatgaagtattcagaattaaaaacactataccaaatcacttggcatgtcagcactaaaggagatggccttctagaatttaatgcatttttctgtctagttcagaccagaaacaagcaatatacgaacagaatcctttgagggaagacactgggtctgagttcatacagtgtgctaagctgcctgtcagggattgctgataaaagatctctgtgttgcctttgttagtgtctccataaat

SEQ ID NO: 85395 - DNA, 1053 bp, Homo sapiens
aaccctgaagccagtgtctgaggcaccccatcattttcaaggaacaggaataactggagaaacaagtctttcaaagtggttccaccttttgaggtaactgggagtgccttttcttggggtgactcagtcaggaaagtccccgattatgtacttaaggagtccttttctctccttttatggtagtctgcaaatagcagagagaagcccctcactctcgatgctccctgggtacctccctatggccccgctgctgccgactgcttcaacacattcttctgtccctgctgtttagatgccgtgttgtaggagcctgttgctagggtgtgttctgatgtgtcttccaccacctttaaacaagcagctcatgttccttttctctcccctggaatgggtcactgtgtaagcctttttcatagttcaagattccaggattgcccccaaataggccagatccacccccactccccactcccaggcatcacgtctcaggtatcaagggtgagaggtcactggggccccctcagctccactctcagtgacctggagcctgagcaaacatttcctgccttctgcagtgtcctggagaggcgagtcctctgcctgcagctgcttccctccccagggggcctggaattcccccagtcttcagtggagaatggagagacagtttatgctctctgagttctattagggcataatgactcgcagctttaaatgcagacagaagctattaagcagtgaaagcgattcttttttttttttctttttctttttgtatattgcccttgtggaagtaggaaagtgacagggtctttgaggtttgcaaaggcttaagtgcgccttggcacacctcttggcagaaggtgtttagtgcatcccaggaggcaagattgaagctggggccaaagcaggcaaacctgaggtttttgggcaggcacttgcctgggctgggagggctggctctgccttcgaatacagaacatgaatggaaagcagccatggtagcaggagtaataatgatgatgatgacgatgctggcacccactgacattt

SEQ ID NO: 85396 - DNA, 1356 bp, Homo sapiens
tcaagttagaacaaaaaacaaaggaaaagagaaatatttacaatataaaagcagaaattttaaaaagagaaaaataagacagctggaaaaatctgaataaggtcagtaggttatagtattatgccaatgtgaatgtcctgattttgaaaaaataataataaagcaaagtaaaatataaatttttgcaaaatctgggtgaagcatatacaagttctttgtgctatttgcaacacttcttatgtctaaaattatctcaaagtaaagctactatgcggaaaataatctaagatttaagaaataagagaattaagtgctgccgggcaccggggaggcaggttggtgtacgctgtgcgcggcggacgtcagaggcagcggggagcggagcggggccgccggggcctctccagggccgcagcggcagcagttgggcccccgccccggccggcggaccgaagaacgcaggaagggggccggggggacccgcccccggccggccgcagccatgaactccaacgtggagaaactgcccccgcacatcatccgcctggtgtacaaggaggtgacgacactgaccgcagacccacccgatggcatcaaggtctttcccaacgaggaggacctcaccgacctccaggtcaccatcgagggccctgaagggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaggtgcctgctgatccaccctaaccccgagtctgcactcaacgaggaggcgggccgcctgctcttggagaactccgaggagtatgcggctcgggcccgtctgctcacagagatccacgggggcgccggcgggcccagcggcagggccgaagccgggcgggccctggccagtggcactgcagcttcctccaccgaccctggggccccagggggcctgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaataataataataataagagaa

SEQ ID NO: 85397 - DNA, 1007 bp, Homo sapiens
aggctggagtgaagtggcaaggtctctgctcactgcaagctctgcctcccgggttcacaccattctcctgcctcagcctccagagtaactgggactacaggcgcccaccaccatgcctggctaatgtttttgtatttttagtagagacggggtttcacagtgttagccaggatggtctcgatttcctgacctcgtgatctgcctcggcctcggcctcccaaagtgctgggattacaggcgtgagcccctgcacctggcctaaaagtactcattttttattcatcaataattagtaatctgactcgtttcaaaaatttgtttattattgacaacctctttgaagatccatttcacaaactcaacagagtgccacgattaagagctagggatcccccaaactacctcaagcatctaaaaaattgccattttttaaaggcttaaattgtagtagtaaagggggaaaaaacccataaatcatctaaaaaattgccatttttaaaggcttaaattgtgtgtgtgtacacacacacacacacacacacacacacacacacacatcattgacctttcttaagacttcagagggtggaacttccggatgtgaccacagagaggaagagaccgggaaggcggagcgcggccgccagcacccccgagccgccgccggacccccgccgccccgggccgccccccgccccccgcggtcccaggtctgtccgtctggggacggctcgattccccgcagagccgggggagggacgggggcgcccaggggagggggcctcgggcgccccgcccgcgcctgctgccccgtcccggcggtaatgcgctcccggccgtgacccccgctgggggcgggggccgggatccatgcgcggagcccccacccggcccggcgcctgcggctgacggcggcgggggttggggggcgcgcgtctggcctcctgcccaccccctggcgtcgacatcacgggccgtcgggggctgcgccctaccccgcggccagg

SEQ ID NO: 85398 - DNA, 1051 bp, Homo sapiens
gcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtgaggcgctcggcgtcgcccgaactcggggccccgtcggagctccgaaatgggtcgtcttctccaggccggggttcctccctcgggggccccagacgggccaggctgggggcgcgcggggcgcttggagggctggttcccagcctggccaccccgcaacgctagaccagtgcgcccgggcacccaagacatcccagatgcgcgtcgctctaaggagatctgcgtagggacagctctagggggtccggggagtgcggtccccggcgcccggggaggcgccgtggaaaccccggggaaagcgtcacccccggggaaagcgtcacccccgtgggcgggtggagcccggggcgcgggagttttggtgatcacatctccactcctgccacgaaggccgttcctaacactcgcccgcagcggcggtgcagcgg

SEQ ID NO: 85399 - DNA, 1044 bp, Homo sapiens
gctgataacactgtgaggtactccgttaacacagccaaactggagaggacttttatctttctagtccaatctctcttatttcacaaataagaaaagaaaacaaagaaaagaagaacaaagctaatacacaaaccaaagaccagaagctaaatcagtactcacaggcctgtgttccttgcactatgttatgctgcctcttttttttaaagcgattttatatttgcagcaccctgtacatagaggctcattcataggggtggcttcctactagagttcagaacaacaactggagtccaccccatctgaacttctcatagctgctggatccgacacatgtgcaaaactgtcatgccttctcttggataaggaaaagcagctaattaaatcagtggggcagctggtcactgccttctctgtaaacctccatcaccaccactcttccctgttggttcattagttcattcgaagagtttttcatttgtaccacacattctgctaggcactggaaacacaatcactgcccttgtggaacataagctaatgggaaacacagaaaataagtaaacatataaatacgaagttatgaattgcgacgggttccgctataccaaaatgaactggatgcactgagaagagaaacatggaggccttggatacaggatgtcaggaggcctttcaggcagaagctaaaggttgaggagtgagaaatttgaaaagtagaacataccaggccgagagaacaacatgtgctgctttcatgcaggaaaatgagcccaagatgaggcaggggccagttcataggcaccgggacccatggaagacttttaagcaggggatggtactgatttctgttgtataaaggtcacctggccagagtacggagactgaattttaggggagccagaagaaaagcagagagatcagctaggaaactatttcggtagttgactcgagacaacgtcggcttgggccagggtgacagcaaaaatgatggaagtggatatgcgctgtggaggcagaaccaacaggtcttgcagatcaaca

SEQ ID NO: 85400 - DNA, 1427 bp, Homo sapiens
agtttagcctaaagctgcctccttacatattttaaatttggcctaaaggtttctctgtacatcgtggactacaacaagtggacgtgtaaacagactatagcctgcactcatgccaatcctcgacttttggccaatcaaatgtggccaactgttcgaaccctgttcaaaaagggcaaatgctgagctataaccaatccagctgtttctgttcctcacttccattttctgtacgtcacttttcctttttctgtccatcactttcttttttctgtccataaattatcttccaccacgtgactgcactggagtctctgagcctgctttggctcagcaggctgcacaatttgtgaatcattctttgctcaattaagctcttttaaattgaattcagccgaagtttttcttttaacagtatcaactgtggtaaaattggctttgttatacagtgcatcattttgcttcaagtcacagtttccaaaaaccgatcgacttcctatacttcctacctacctaggtaccgctctttgagtctaggtcttctgtaaggcattgttctaggtcagtggtccccaacctttctggcaccagggaccagcttcatggaagacaatgtttccacagaccaggggcggggggtgatgcattagattctcataaggagcgcacagcgtagatcccctgcgtgcacagttcacaatagggttagctcctatgagaatcgaatgctgctgatctgacaggatgcagagctcaggcagtaatgctcgcctgcctgctcaccttctgctgtgtggcccagttcctaacaggccacggaccagtactagtctgcagcccaggggttgaggaaccctgttctaagtgcttgagatacatcagtgaacagaacacacagagatccctactaaattttaacagactcagatctagcaggggtaaacataataataaacagtatggagatatatgtggtatgaaacatgaaaaagcagagtaagaaagatcaggatgggcaggactgtagttttaaagaggctgacatcatggataaggtgacacttgaacaaaggcctgaggcagtaagcactggagtcagcaccacctgtggctccaggcaaggatctttctggcttcccacaaacaccacaagacatttgcctaggactatgggcagaatcatttctgaatacctctgcagactgctggagaacaagagtctagcagtgcccctgtctactgagaaatactagcagcagagttgataaaaattgggaaatagcaaatattaaattttttggtcatcttcaagccattagatcacaagttggagaccagcctgggcaacatggtgaaactccatctctacaaaaaagtacaaaacttagccgggcacggtggtgtatatctgtggttccagctatttcggg

SEQ ID NO: 85401 - DNA, 1063 bp, Homo sapiens
atctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagttagtatcgagaacaagggaagaactggtttcactctgcacttctgatctttacaacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaacttggactcagcataacttactttttttccagcagccttcagggtaaagtttagaaggtagatgcaacaagccaatgcagcaccctaagcttgtctttttaagttttatttttatttaacctaatata

SEQ ID NO: 85402 - DNA, 1166 bp, Homo sapiens
gtttgagccctgaagttccaggctgcagtgagctatgattgtgccactacactccagcctgggtgatgtgagaccttgtctctaaaaaaataaaagttctgaagaatatataccaagctctaccagtgttttttctttggggcaaggaaggaggtagaattgagggaacggccttaacctttactgtatttcttaaatttttaataagaattaaatattactggaaaaaaatgtactactttaaaaacaaaagggcaaagaataaaagatgtaaatagccgaatcctttgggaggaaaaagacaaatcttactagtgaccacaaaaatacaaattaacataacataacttttcatctagaaaattagtgaccacagaaaagaagttgacacaaatatggggaaaggggtcatttataacaggaatgtaaattgcagggtaacaggcaataggaactttaaaacatacatattctttgacccagaaattccacataaaagaacatatacccaggaagtaattatagatgtttgtaaagattttacagtgaggatattctcagtgtgatgaatatccagtattgtttatggtagcaataaaacatagaaacaatctaacaattcatggagtttgaggagaataaaaatgattcatctttacagtagaattatttgtaaccattaaaagtgatatggaaaaatttttaatgcattcaagagatgttcacagtaggtattaaagtggacagagcaggttaaaaaaattcttttttttttcagacagtgtctcactctgtcactgaggctggagtacagtggcgcgatctcaactcactgcagcctctgcctcccaggttccagtgattctcctgcctcagcctcctgagtagctgggactacaggtggcacacaccgaggcaggtggatgatgaggtcaggagttccgcctgccttggcctcccaaggtgctgggattacaggcatgagccaccacacctggccttaaaaaaattcttaaaggtaactgttgagattgattggtaaggttcccgacaaattttatttcattgttttttgtattttgttattttatagactaaatcttcatatgtttaatataaaaattcaaagcactcttttctatttcccccaataatttgttgtatat

SEQ ID NO: 85403 - DNA, 1083 bp, Homo sapiens
gtggattttggagtgtaactcaggctggtgcttgactctccccattgctggcctaggattcagttttcttaggtcttataaatcattttccactcttctatcagcttccaatgtatcatggctgttgtttctccctgtctttctcatcctttggaattcatacttttaaaaacaaatctggccgggcacggtggctcatgtctataatcccagcactttgggaggccaaggccagtggatcacttgaggtgaggagttcaagaccagcatggccagcatggtgaaaccccatctctactaaacataccaaaaaaaattagctgggcatggtagtgcatgcctgtagtcccagctacctgggaggctgaggcaagagaatggtttaaacccgggaggcggaggttgcagtgagctgagattgcaccattgcactccagcctgggtgacaggacaagactccgtctcaaaaaaagaaaaaggaaatccttttattatggttttagtggggtttggggaaggagtaaaaccagatgcataggttcagttgaccatcacacacggaagtgtttttagttacagtgttttttaagatttttatgtcaatggtcactgcttaatatgattaactttttttttccattctcattttacagttcctgatgaatatctgttatcgtaagtacatatactgttgtatttgatttttttttaaccattaatgttaaaatcctttcaacatcaactcttgatttttaaaaatactcttgaccgggcgcagtggctcacgcctataatcccagcactttgggaggccaaggtgagtggatcatgaagtcaggagatcaagaccatcctggccaacatggtgaaaccccatctctactgaaaatacaaaaaattagctggacgtggtggtgggcacctgtagtcccagctactcaggaggctaaggcaggagaatcacttgaacctgggaggtggaggttgcagtgagccaagatcatgccactgcacttcagcctggggacagagtgagactctgtctcaaaaataaataaataaataaataaataaataaataaa

SEQ ID NO: 85404 - DNA, 1045 bp, Homo sapiens
tgcctgtaatcccagcactttgggaggccaaggtgggcagatcatctgaagtcgggagttcgagaccagcctgatcaacatggagaaaccccgtctctactaaaaaaattagctgggcgtggtggtgcatgcctgtaatcccagctactctgtaggctgaggcaggagaattgcttgaacccgggaagtggaggttgcggtaagccgagattgcgtcattgtactccagcctgggcaacaagagcgaaactccgtctcaaaaaaaaaaaaaagagagacggggtcttactgtgttgcccaggctggcctcagactcctggtttcaagcaatcttcctgcctcagcttcccaagtaactgaaactacagagacataccatgtatttttaatttataactttttttcagaagattccctttttcttcttattatgccttctgcctgtttttgtgcctgttttatgattgcattaacttttttctgatgataaaatattagtaatagatgtttaaaattttctcctttctgcagtttttcctctaactttcttctgtttgttttattctatttcctttttcctttgttgtctggtaacccttggctgtctagtcatatttcagagtggaagactaaaaagtatattggaagctctgggtggtagaggggcttacggaatatgaacgtcactatagttgttctcagtaggctatttagttggggaaaccatttcagtgtcattcccacttctcttggggtatacctagggaagacttccagtctcctggctgaagtgtgaaggcctgattgcttgtgttatgggagccatgttagggaagagagcaggagatcctgttttcagtgtgacaccctgactttcactgtacctagtatttttccctagtccaaatagcctgtgtttgaacctctccagaaaataaacctagtctcttgccagaatgagggaaaggcagtcacctaaagctgtggagggaactggggtcccactacttctcaaacgtactcgaaaagagtcttattttcatat

SEQ ID NO: 85405 - DNA, 1109 bp, Homo sapiens
gtctcaaactcctgaccttgtgatacggacacctcagcctcccaaaatgctgggattacaggcgtgagccaccgtgcccagccagttttgggttttttccctccaacaagaaggttcacaagacacattgacagtcctgaagggggcataatcattgcccctgacacccatggttcagacacaggaaccaatgctgttgattcatgtttattttcagaagccctgttttctgtctttttcaaaatcttttttctattaatatatagttatgcacccttcctaacccccattcttcagtggtaatttttttagatcaagattccaagttttatttgtatgatgatatataaactagtcacagtggaaccatgtaggaagctatgattactttttgttttctttgtaacttttggatttccctggagttacaactatcttggttttgtttatgtgcttatttagttttttacatatttattcctactttaacctcacatcctttactagtgttctcaatctcccctcaagatgttcagatgaacgaagtatgttatcagtttcaccttcctgaagacatctctagagccttcggacttgcttaatatggactggctgatctctcggctgtttgctgagatctctcttaaccattattatctgggaattctctgtatctttgttgggtcctatgtttagtatatcctacagttttctttttctcagtttactacctcttttttttttttttgagacagtctgtcacccaggctgatgtgcaatagcatgatcaaagctcactgtagctttgacctcctaggctcagatgatcctcccacctcagcctcccaagtgagtatctgggactgcaggcacacaataccacagctggctagttttttgtattttttgtagagacaaggtctcactatgttgcctaggctggactcgaagtctggagctcaagaggtccacctgccttggcttcccaaagtgccaggattacaggcatgagccaccgcacccggcccatgtaaaattttttttttttttttcgagacaaggtcttgctctgtcacccaggctggagtgcagtggcacaatcataggtc

SEQ ID NO: 85406 - DNA, 1081 bp, Homo sapiens
acgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgaggtcgtgtgtggctgcgccatgggcgcgggcggggcatccgggcaccgccgggccgggaggcaggaggcggggtgtccgggcctggccctgccttttttccatgtggttctctaaacctcttgttcgtaaaaagacaaaaaaacaaaacaacaaaaaagcgaaattggaacaagtaaaagtcaaatcgattcagcaaatatttacggtacagcgcagttgcaggagcccctccgtcggagcgagtaggccagtggggaccgaagtgctgagagctggccgggtcgctgggaggggtccccgcccgggggtggaagggacgggagcctacagtgagtgatagaaacgtggagttcttgattattttacacgaaattttgaattattaaacttctttttctcaaattctgatgttaacattaaagttaatgcttccatacactttaaaaagtaggcccagcgcagtggctcactcccgtaatcccagcactttgggaggccgaggcagttggattacctaaggtcaggagttcgagaccagcctggccaacatggtgaaacttcgtctctactaaaaatacaaaaaattagctgggcgtggtggcgggcgcctgtaattccagctactcaggaggctgaggcaggagaatcgcttgaacccgggaggcggaggttgccgtgagccgagatcgcgccattgcactccagcctgggcaacaagagcgaaattccatctcaaaaaaaaaaaaaaaagcattttaagagccacaaaacctaaatgcatatgcaatcgttggagtaaatctgggtattgtgaaagcaccattttttttctgaccagcagagggtactctttggctatgctcaccaaaatcacttg

SEQ ID NO: 85407 - DNA, 2693 bp, Homo sapiens
gttccaatttcgcttttttgttgttttgtttttttgtctttttacgaacaagaggtttagagaaccacatggaaaaaaggcagggccaggcccggacaccccgcctcctgcctcccggcccggcggtgcccggatgccccgcccgcgcccatggcgcagccacacacgacctcggtcccgtacttcgcgcgctctcctgcaccgccgccgccatctcgctcaggagctcctccacaaccgccggcaacactacggccatcgcgccgcaggacacgccctccacgaccggcggaccgccgcgacgctccagctgactgcgcctacctgtggaggatcctgaccccccgccggggcagggcgagacggagtgacgtcggggcgcgtcatcgcgcgtgcggacgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcaggtgaggggcgcgggccgggcggggccggccgggcggggacaggggcgcgggccgggcccgatgacctcagagccccttcccgcagcgctcgcctggttctcgaggcccgctgcggcagaggaggaggagcagcagggagccgacggggccgctgccgaggacggggcggacgaggccgaggcagagatcatccagctgctgaagcgagccaaggtgaggcggctccgggccctgcgcccggccgagcgcggtagcctttgtgagcggggtcttggcgttgctgcgcattactctctccgcctcgccgaagagtggatggaggctccgcgggtaaaattgccgagaatgaggtgggtcatccgagaggggattggaatccatccaggcttttccgactctaaggcctgcagtaaaacctctgcagtgtcaagtgcaaatggagatggcgccctaggcatcacgctttatgcaaacgaaatatcgggaacgttttgtagtggttttatcaattaaccagcctatctgaaatgacataatttcgcacgtatatagcggcctgaaaatggcaacttagtgttggttatgcggttcggttctcctcctgaattcttccttttctccacatccttttctatttttttttcctcctcttttcccaagttatctcatctcttccattgagctaaatacctactcgatgccaacaacgtccaaatttgtatttccattctgtagtgtgctactgacatgccatttgcactttaggaccatacctacctctcagatttaacatgcccaaaactaaacgatctttaatgcctcctcaacatacgctttcgccatctctttactaccatcagtttttcagcctaaaaacctcatagtcattcttaaaacttgtggtaccttaccattgccttccaatacacttacagtccagcaacaagtcctgttgccaacaaatgcaaaatatttctcaaatctttccccttttgtctatctcccttgctgtcaccctagtgcaaaccatcattgccaccaactatgctccagtagtctttcctggcctcctggcctcttgcaatctattctccatgcagaaaccaaagcgaccaaaaaaaaaaagagtaaattggattatgtcatctccttgtcagaaagctctgaatggctacccactgcatttatgataaaatacaaactccttgccttggcttgcaacaccccacatgatctaaaccagcatataccttgcccacccatttggcagtaatcctctggctcaccatcctcccttcacatctatttctttgcatttcttcctcaaaaccattctcttcagcttgtagggacttcactcattctctaccctctgtttgagtcattgttctccccaggtccttatttggttgactcattctcatccttactacctcagtttagctgtcacttccttggaaggcttccctaagtcctatttagaggagaccccttatcattcctttctgtcatctttatagctcttatcattagttgtaattaagcttacttgtcctatatggtcacctccagcctgcaagaaattagaaagaggatggaggacaagcagcttccttataaaatatgttgtaagatcacattccttctgcctgtgtctcttggccaaaacttcatcagatggccacacctagctgcaagggaggctgacctccctgtcatctctgtagacaatgctttgtacatagtaggaattcagtaaatgtctgatgaatgagttagcttccttctatcagttgggatgtacagttgcatacacttctgtctcttagcatatgcatctactatatgtttcattttctattattttgtcttcccttttcagttgagcattatgaaagatgagccagaagaggctgagttaattttgcatgacgctcttcgtctcgcctatcagactgataacaagaaggccatcacttacacttatgatttggta

SEQ ID NO: 85408 - DNA, 1011 bp, Homo sapiens
caacagcatgcttgccaaggaattcacagttggctcatcactctaaaagaataaagactgtggctttgaggccaccgtcagtctggaagttgatctgaaatatgccatgaaaaaatttacttgttatgagttcccttcattctctttctctcacaggaggacaatgcaataattgaaatttccctaaagctggccagtatctatgctgcgcagaacaggtaagtacagcagccagggagtaggactgtgggcaggaaactttgactctgggatgttacataatattcattgtctactggtcatctgggtctcccagaaattgggtgtcacactcaaagtgttccatccctcatctttgaaattgtcagtctttttccagtttgcccctactgtttccatcagcctgcctagtggggcacacaacatctctggctgccctgtgacaaaactaactaagttttctgttgctgcttgaagtgggaagggaagttagagttagaactttagtttaacttttcctagaagaggaaagagcagtgtgaaagctgctggggataatatattaatactctgaagaagccattttgctggtataaatagagttcaaagatgaagcatctaggttgtaagcagagaactcctctagagagttgtatttgggatgaatttagggagagacctaagactagcttcccttcaggttttagtggtgcagaagttggtgcgagaggtttggagtgacatggagcctgatgctgtagaaagggtgctcactgaggccaggccctggcactgttccctactgtcctactcaccagctcctttgttctcatcaggacctgcatagtctccttgcattttgattggacactagataggctagagcttcctggagcctttgacttcaagtcttttgaggagctttgagcttggcccatgccagggaacactgcagcttggtcaatctttcttggagttgtaacaaacatgcctagttcttgattgggtatg

SEQ ID NO: 85409 - DNA, 1050 bp, Homo sapiens
agaagaacagaagcatccccttccttccctacgctcaaaacttggcaagagggccctctctagccataacacagggcaagtggacactgcccagaagacgctcccagtcggagcaagaggtctacaaacaattcccctcataacctatatcagcctttcgaagcctcagatctggccatgtcttttctagtctcatgcttctcttaataaaacaaaatgaaaagtacagagtaccatgtaactcagaggctaattgttactagctttcacctctagaagactatgaatttgtcttactcaacaatgtttattaggctctgggcttcttcttaccctagggattcatacccaatcaagaactaggcatgtttgttacaactccaagaaagattgaccaagctgcagtgttccctggcatgggccaagctcaaagctcctcaaaagacttgaagtcaaaggctccaggaagctctagcctatctagtgtccaatcaaaatgcaaggagactatgcaggtcctgatgagaacaaaggagctggtgagtaggacagtagggaacagtgccagggcctggcctcagtgagcaccctttctacagcatcaggctccatgtcactccaaacctctcgcaccaacttctgcaccactaaaacctgaagggaagctagtcttaggtctctccctaaattcatcccaaatacaactctctagaggagttctctgcttacaacctagatgcttcatctttgaactctatttataccagcaaaatggcttcttcagagtattaatatattatccccagcagctttcacactgctctttcctcttctaggaaaagttaaactaaagttctaactctaacttcccttcccacttcaagcagcaacagaaaacttagttagttttgtcacagggcagccagagatgttgtgtgccccactaggcaggctgatggaaacagtaggggcaaactggaaaaagactgacaatttcaaagatgagggatggaacactttgagtgtgacacccaatttctgggagaccca

SEQ ID NO: 85410 - DNA, 1027 bp, Homo sapiens
gacttcatccattatactcagtgctaaatcctcggtgcctagaacagtgcctggcacataatagaggctcaataattactgaatgaaagaacaaaagacccaagaaagaccagcaaataaatccagtttcagtgcagtgtggaagtgctttgaggaaatccacaagaggtgtaaaaacaagtctagctgtcaagtaagtcacttctgaactatttacacctttgctgtctttcatttatagtgttgactatggtttcttaggagtgtaaagctatattttctgattcaaaaaataataccagtaaacactgaagaaagtttagaaaagcactaagtaaaaatcatctgtaatcatactattaagaaagagctactgttttatttattactacggcttttcgggttacattttaagaaataaatttgggatgatactgtatatcctactttgtaacctgagttttaacaatttagtaacatattatgaaaacactttttttttccaggcaaaggaattcttgttagatagagcaagctaatttctattataaatattatttttacattttactagttgcacagtatagaaaatgtgttacatgattcttcatcttattttttctagaaaaggaattcctacctattcagttttgcacaaagcaaatccattatcaaatttacgtgctttttattgacacaactatctctattctaggataacattacttaattacataaaattacattacttaattacataaaaccttgctctaggataattattttgttacctatgttgtagacatatatgtacttactgaggaaatgcccataaaaaattaagtgaaaactttggttacaaaacagtatagttagtatgtagactaaaaataggaatggaacaaaggctgaatgatagatatcaaaatacaggcagtgattctctttggttggtaggtttatagggaatttatattttatttgtgtttctctgagtattctataattttgtacaaatttatatttt

SEQ ID NO: 85411 - DNA, 1049 bp, Homo sapiens
gggagctcagctgtgcagggaaaggatgtgtgttatagtttatctaaggtttccaggtgtttgaagcagatgggtttcatctatagtgttacgttagattctgctttattccctccactaaaaccattaacactcatcagaaagtgctaatcagttgattaacaagagatttagtttagcagaaatttcaggatattcttggaatttgggcaacaaatatctctagtttcaaagacccttgtagactttcctatattgctattgatggtgagggggtaggggagtgttagaggcctatgctcaagttttcctaaattagagatgctcttttgctattgttacaaatgcatataattgctccagtactttatcaaattccctttagtctatatttatgtaaacctagtttgatatactgaaccattcttttattcctggaataaatgctgtttggtcatcttaatacatctgattattccatttggtaatattttgagtaaaaaattctatagtgaatcctgtttgcttcatggactgagtatagtagcgtatctttttctgtgactagaagttatttatgaaagagaatcatttatgtttgaagaagtaaatatgcctcagtttcaaatggtcctttaagggctctgtataaacgattccaatatatttctcagttgttattaaagtacttgatttttttcttgtctaacttttagcaatttttatattaatatttcaaagaaccatgtttaagtaaattactagcaaaggaactctttgggggaactttatgaaattttctcttggcagttgctaaaagttttcttacgttttctaaaagttcagtaatagtacatttatctttagaaaagtttgcttttcagaaagtgtttccatttttcttgtggtcagaatgtgctgtgaattttaaatgtatttttaagatattatagctaaattgtacctcactgttttctctaaaaagttttactgcttttgcttccactccactattcagtgataacaagggtaacaagtttccactagaa

SEQ ID NO: 85412 - DNA, 1020 bp, Homo sapiens
cctgttaccaatgagtgtgacatttcacacccttcaattttgaagcctttgttttatattcccccttctgtgttttcctcccttacctgtgggtgtctttctccttgtatttcttcagaaatctgcagagctttttcatacatcctttgtgcctgtgacggctgcttggagaacagaaggtagcgagcacaggcgtctaagcacatgcccaagaggaggtgggtattggctttctcttccactaaggagaaaagaggaatcagcaaatctacccaaatggttgttaccaggacccacaaatatgtcagcagaatgggacccacatgtcacttagggaacaatgtaggtgaattaacatccagttaaatgacctattccagactagctggaatcatggaacttcagcccacattttaagtagattaagagtccgcacatcaattaaaatgtggaatgttatttttagtttgaaacaaataatattcagcagaaacaaatgaaaataaacccaaagaagaatgagttaacaacaaaaagtcaaggccaatgaaaaacctgtatggtataagaaaaacaatgcaggaagaagacagagaacactcagaatcctgaagtgcaaagtcacaagctgaatttaaagaattcaacgtaaaggccgggcgcggtggctcacacctgtaatcacagcactttgggaggccgaggcgggtggatcacaaggtcaggagattgagaccatcctggctaacatggtgaaaccccgtctctactaaaaatacaaaaaaaaaaaaaaaattagccaggcgtggtggcgggtacctgtagtcccagctactcaggaggctgaggcaggggaatggcgtgaacccaggaggtggagcttgcagtgagccgagatcacaccactgcactccagcctgggcgacagagcaagactcagtctcaaaagaaaaaaaaagaaaaaaaagaatttaaggtaaaatttaaacaagctaatcattcagagaagaagaataaagc

SEQ ID NO: 85413 - DNA, 1888 bp, Homo sapiens
tgctggtgaagctttatgacaggaagtatcattttgtcagacatttcttagtgtcagcacactataccgatcattttcagaaacctgggatgacaggtgtattacacataccaccattcatgaaatcttgggctcatcaaagtcctcaggatatactggaaagggccgttaggaatcccacagcattcagtggagttccagcctgtcagatggggatgaaatgaggcagcaccagcttgtcgcttcataagcacacagtaaattagccctatatctgcattcatgctctctcttcagaatcaccttgaaaacatacactttcttcttactgtcccttctctctgggttattttagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaatattgtatgtatcccagtaatctttgcatttctcaaaaaaaaaaaaaaaaaaaaaaaaaaaactttctgaagaaaataaaaacaccagaaaccttgaggtccaaatcctcagggattagact

SEQ ID NO: 85414 - DNA, 4362 bp, Homo sapiens
acctcatttctcaatcttgtagactttaaaatctgcccagtgagattcagcagatgacttgcatcctgctgcccctcagtctgcagacgttcctgggtacttgtccattgtcgtctgagaactatactcttgcatttctcttgaagagttaagaaagctcttgctataacctgactctgtgattctccatggaaacatctgatatagacttaactaaaaatctagcctgggctttctcttctgggctcagcagccctcactcatatgctactcatgttactcttcttttttggacccgcactgactgctatatatcattggctaggatttaagtggtgagactttggccattccgtgttgtattcattttgctttcatggtgtcacatgaccattttacaataatcctattctactccatcctacaaaagttggattggatgaaataccagttatgttcatgacaatgaaaacctaatttttcttttgtcaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatccttacacgtgatttttttagcacccagaactaaattaaggtcttcctaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatcaccatacgttaatactggtttctactgaaacagtctgatttatattgtatcttatctctctgagctagacttggtaaacggcattagctgcatggtaaataatatgagattagacagaaaataggaagaaatttacatctgcaacatacaaaactctagttttagtctaatccctgaggatttggacctcaaggtttctggtgtttttattttcttcagaaagttttttttttttttttttttttttttttgagaaatgcaaagattactgggatacatacaatattgttgtgtagtctcatttattatgaagattcttccagtatgtacatacgaaccaaaagtatcagtttatcagtcccactcacatcccacccccacaggcataccaacagggtcaatcttccttcatggtacctagaaaaactgtctttttccttaggtaaatggctaaaa

SEQ ID NO: 85415 - DNA, 1002 bp, Homo sapiens
aagcctttaaaactttataaactgaactagaacatacccatgcagtaatattttttcagtgctactaatgaaaaaaaaaaattaaagcctgcactggaaatttacaatatggcagaatttgttacttttaccttttgaccctaatgtacagattttatgacagggtctgtgttaaaaatctaaacattttcacaagattttaaacatcactggaaagctgaatttagaggaaacaatatcagataaaagtacaatgcccgtgacagccaacattatgtaactgggctgtatgaggttgtttagaaggctagggttaaaaagatagatagacaaaaagatttttaaaaatcacccccaaagttgatgcgctgatttgaacataagtacaccagatactacagcaaggggatatacactgcaaaaaggtcatctatttacagaagagtgatttaaagacattatggttttctttacagatgtaagaacagcaactgttcactttttaaaaactctacatctcaaccctccactattattatagtccactgaattgcctgtatcaaaggcagttttttgtttgtttttttcccatttgactctccaaatgaacttccatcatttcttcatcatctgtgggctggctctcctgaaaagtctcagggaataagtcacaggagggcaggtttttgacctgctactaaaaattaaaccacaaaaactagagatccctctcctgcaccctgttcccctcactttgtgcagttcagtcatcactatccgacagggtctcgtactgtgctgagagcagtggggcaggctctcgctcccagatcctgttctgttggtgaggagctgcttggttcaccgcagagggagcacatgcaatcggtgttggtggagtactgctgagcatccgcatagtcagagggttataaggaaactgagttgagcctgacaaaagaaaaattaggttttcattgtcatgaacataactggtatttc

SEQ ID NO: 85416 - DNA, 1067 bp, Homo sapiens
agggttaattggccgaatttgaatattgttgtgtgtcagggaataagggagccagaggaggagagagacagggaacaaccagtcagtggaggagtcaggacacacaccacctttatgggttgtttgccatcttatacaggtgctcctcatggtgcccccaaacaattacaatagtaatatcaaaggtcactgatcaccatcacagagataataatcatgaacaagtttgaaatattgtgagaattaccaaaatatgacacagacacaaaggagagcccatgctattagaaaaataatgctgatagacttgcttgacacagggttgccataaaccttcagttaaaaaaaaaagcacaataaaacgaggtatgcttgcatttaaaagaaagccaggatttcacttgtaacaatcaaaacaaaaaacaaggttcgtcctcctgccattaaaatgtggtaattaaggaactgaaatttctgggacatcaagccttctttactggcctcagagtacagaaactactaaagaaagaaggcagggtgacaaaaatcatacttcactaatgaccaacccccctttcccaactggaattaatacaccacacaaagaaataatatgtaaaggaaaaactgcagaacaaagcttcttcatgctactacaggacttgagcagaggctcagcaagttttggtagcccttttgatttttccagactgtgtagctgatgaactcagcagaatttcacagaagtgagacacctctgactgtgctctaaaagaaaacatcaaaaagagctcagaagagatcagagcccaggtcatcagcaaattttttcctcagccccagcaaaacaatttcacactgccccaaattcctatacaaccagtacaattgtaattgactaagtcaccagtcttataaccttaaaacacacacacttaaagccaataaaaattggaaggtaagaacagaaaggggaaggtcttaaagttaacatgtatagttttttttttaagacctctaatctctttaatctttttcttaaccatagtgagatagatcttttgctt

SEQ ID NO: 85417 - DNA, 1109 bp, Homo sapiens
gatcacttgagctcaggagtttgagaccagcctgggcaacatgatgaaaaccccgtctctacaaaaattacaaaaattagctgggtgtggtggctcacgctgtagtcccagttacttgtgggggccgaggtgggaagatcacttgagcccaggaggcagaggttgcagtgagctgcaattgcaccactgcactccagcccaggtgacaaagtgagaccctgtctcaaaaaaggaaaaaaaaaaagagtaggaaaaagggaagaaaaagaaacagttcttcagatcacatcatccggaatgctaatgcttgtatctgataagcattgtttcagacatgtctctggatagccagataagagttgctagaatgagattttatacattctgttaaaaacaagcacacaaaaaaaccataataatcctaagctttaatcttacaacctttttcttaatattttgagaatatctcttgtgcttttcaaaattacctgaagttcagcagtatttctgttttagtttagatttattttcctgttatcttcaagcaaaagatctatctcactatggttaagaaaaagattaaagagattagaggtcttaaaaaaaaaactatacatgttaactttaagaccttcccctttctgttcttaccttccaatttttattggctttaagtgtgtgtgttttaaggttataagactggtgacttagtcaattacaattgtactggttgtataggaatttggggcagtgtgaaattgttttgctggggctgaggaaaaaatttgctgatgacctgggctctgatctcttctgagctctttttgatgttttcttttagagcacagtcagaggtgtctcacttctgtgaaattctgctgagttcatcagctacacagtctggaaaaatcaaaagggctaccaaaacttgctgagcctctgctcaagtcctgtagtagcatgaagaagctttgttctgcagtttttcctttacatattatttctttgtgtggtgtattaattccagttgggaaaggggggttggtcattagtgaagtatgatttttgtcaccctgccttctttctttagtagtttctgtactctgagg

SEQ ID NO: 85418 - DNA, 2785 bp, Homo sapiens
gaagtactaacagaattgctttagagtctgggattttttttttattgcaagaactatttttcatggtggaaaggagaatttatattaaagaaccagtgggctcctgggcccaccatggcacatttagccttcactgggaagtagaactaaatgaaagccatcagcagccaacacagcttcacttcagctcattgtatctgaatccagtgttcccaaggacatcagtgactttatttttttgaaaactgtaatgctttaaaacttactttattggatctctttgcagcttttgacacagtgaaccactttcctttcctgaaatgctttcctctcttggctttctgatgccatgttctcctgtttcttctctacttctctggccacttctgtctccttagaagctcagtcttgctttgcctggcccttgattgttagttttccccagggctcacttcttagcccctttctcctcatgtcttataatttgagtcatctcatctactctggggagttgaatggtcgcttgtatgctgaaaactcccaaatttgtatctgtagcccagcttttcctactaagctctacttacatatctttgcagacctcattacttcttgactaacttactggctccttaaatatctaaaattgaatccatgttctacctccccatacaaaaagttcctcctccttccctaccacagttaacagttaccattactctggccattactatcctggtctctctgcctcctgatgggagtcagctcctcctgtcaagttggcctccacagtggctttcacatgtctaccttccattctgctaatttctgagcagttaccacattcttgctcaacagtaggtaccagtcacctggattgcttattaaatagttgaattatggagccccaggaatgtagaaaatttactaagctacccaggtgattctaatttgtatggccttagcaagtaccacactgcactgtaagctccattagcaaaggaagggttatcctgcaagtgcagtatctaaggattatcattggttaacttataggaaattgtcttcatctgaccatttttgatcaataaggtaatcttaacaattcagtcaaataactgctcaattaaatatctatcaaatgaatgactcctgttccacacacttcatgataacagggctctgctgtttcaggctcaatttatttaccttgtcacctggcccataagtaagaagactgtcatccatggccattgttttctagttcttctgaggacttttctcctctgtcagtttaaagcctccctaatcaaccaagtttgtttctaggcacatgcactcttccctcctctcatgtgctcagcccttgggtaagagtccatccttctgtggtctcattagaaatttcacattctggccgggcacggtggctcacacctgtaatcccagcactttgggaggccgaggcgggcatatcgaggtcaggagatcaagaccatcctggctaacacggtgaaatcccatctctactaaaaatgtaaaaaattagccaggcatagtggcgggcgcctgtagtcccagccactcggggggctgaggcaggagagtggcgtgaacctgggaggcagagcttgcagtgagccaagatcgcaccgctgcactccagcctgggcggcagagtgagactccgtcttaaaaataaattaattaataaattaattaatttcacattctggctgagcacagtggcccatgcctgtaatcccagcactttaggaggctgaggtgggtagatcacctgaggtcaggagttcgagaccagcctggccaaaatggtgaaactccgtctctactaaaaatacaaaaattagctgggcatggtggcggggggcctataatcccagctgctcgggaggctgaggcaggagaactgcttgaacccaggaggcagaggttgcagtgagcctagatcacgccattgcactccagcctgggtgacaagaataaaacaccaccatctcaaaggaaaaaaaaaaaaaaaaaagaactttcacattctttgggacacatcatttggctgcccacttgctttctgcattctttttttctctttaaaattcttagcgtcaagttgggaatgacggaaacaccaatttatgtcccaaattcttcccctttctggcacactgctttattataggcggttcccaggtcttatgctgttatcattcaaactgcagattacaagttgcacagtcagcaggaatgaaaaggatcaacagagtcttttgttttttccagcaaatatcctgagtttccagttagccatgcagggaaacacagtcattttcatagtattcactgtggtggctttcctctggatcacatcccaggctgcctcaaacctgttggtatttgtggcggtcatcccagagtccaaggtttcttcttcgtcagaaagccttggttcctgttctgagaacagcattttcctatttgtttttctccagcagtgcaaagttcctttcccttttctgggttacactgcttctttttttatttatttatttatttttggtaaacagatgggagagtctcactgtgttgcccaggctggcctcaaattcctatgctcaagcagtcctaccgcctcagcctgctgagtagctgggggactaggagtgcaccactgcacacagcttattgctcttcttttgatgttcctaccttacctatttcctgatttccctttaaaaatagcctgggcaacagagtgagaccctgt

SEQ ID NO: 85419 - DNA, 1847 bp, Homo sapiens
tacaaattagaatcacctgggtagcttagtaaattttctacattcctggggctccataattcaactatttaataagcaatccaggtgactggtacctactgttgagcaagaatgtggtaactgctcagaaattagcagaatggaaggtagacatgtgaaagccactgtggaggccaacttgacaggaggagctgactcccatcaggaggcagagagaccaggatagtaatggccagagtaatggtaactgttaactgtggtagggaaggaggaggaactttttgtatggggaggtagaacatggattcaattttagatatttaaggagccagtaagttagtcaagaagtaatgaggtctgcaaagatatgtaagtagagcttagtaggaaaagctgggctacagatacaaatttgggagttttcagcatacaagcgaccattcaactccccagagtagatgagatgactcaaattataagacatgaggagaaaggggctaagaagtgagccctggggaaaactaacaatcaagggccaggcaaagcaagactgagcttctaaggagacagaagtggccagagaagtagagaagaaacaggagaacatggcatcagaaagccaagagaggaaagcatttcaggaaaggaaagtggttcactgtgtcaaaagctgcaaagagatccaataaagtaagttttaaagcattacagttttcaaaaaaataaagtcactgatgtccttgggaacactggattcagatacaatgagctgaagtgaagctgtgttggctgctgatggctttcatttagttctacttcccagtgaaggctaaatgtgccatggtgggcccaggagcccactggttctttaatataaattctcctttccaccatgaaaaatagttcttgcaataaaaaaaaaatcccagactctaaagcaattctgttagtacttcccttaagacattaattatctcctgttaaagttaggtacttgtttcatcatacagcttcagagaatagagaccatgtggcatactaaaacacccaacatagtacgctactgaaaacattaggcaagagagaaaaaactataaagtaggcttcttcagttcaaacatggcatttccctgtcaaagagtttcccactttaagggtaagacaaagactacagaatgagcagaccacacaaaggtgaaatgatttgcatctcagttcctggctgctctgagatctctagctctccgtgctcacacagattcatctctgagtgccaagagaaattgaaaacaagagtatatttttgttggtgacacttgaggagctgtaaataatagattaaactgttgaagactggagacagaaaatagtaataacaatattttttgaaaaggtggccggatacagtggttcacgcctgtaatcccaacactttgggatgctgaggtgggtggatcacctgaggtcaggagttcgagaccagcctggccaacatggataaaccccgtctgtactaaaaatacaaaattagccggatatggtggctggtgcctgtaatcccagctactcgggaggctggcccaggagaaacacttgaacccgggaggcggaggttgcggtgagccgagatcgtgccactgcactccagcctgggccacagagtaagactccatctcaaaaaaaaaaaaaaaaaaaagaaagaaagaaaggctatctgtaagcctgataacaattctggtcagcattctaaaatatttgtcttttattttgttgccacctaaacagaacctagtaattaagagcgaggacaagttcagaaacagtggtgacactggctcatccttttt

SEQ ID NO: 85420 - DNA, 1015 bp, Homo sapiens
attggccagggccattgcaaacaagctggaccaaaaaggttcaacatttacaccagctgctttaacgagggcattgatcttatcctccgtgatggtcacctcattgtcatgcagagtgagggctgagtagatgcaggcgagctcggagacagaggacatggtatgggcaagtgtggggctggcgctgccggacgtggtggtagttgccggatgaagtgagggcctcatcccaacgtggccttagcttccttggaaggaccaagcactgtggtggcagctgaggaaaggacgatctgctttatttctgtgatctaccatctactagtctcctgatcctgtcaaaagaaaggaaagtgggggccttgcactgtgaactgcctggtggatgtttgtttagatctgtgtcactcttgtgattaataaatgttgaacaccaaggaaaaaaggatgagccagtgtcaccactgtttctgaacttgtcctcgctcttaattactaggttctgtttaggtggcaacaaaataaaagacaaatattttagaatgctgaccagaattgttatcaggcttacagatagcctttctttctttcttttttttttttttttttttgagatggagtcttactctgtggcccaggctggagtgcagtggcacgatctcggctcaccgcaacctccgcctcccgggttcaagtgtttctcctgggccagcctcccgagtagctgggattacaggcaccagccaccatatccggctaattttgtatttttagtacagacggggtttatccatgttggccaggctggtctcgaactcctgacctcaggtgatccacccacctcagcatcccaaagtgttgggattacaggcgtgaaccactgtatccggccaccttttcaaaaaatattgttattactattttctgtctccagtcttcaacagtttaatctattatttacagctcctcaagtgtcaccaacaaaaatatactcttgttttcaatttctcttggc

SEQ ID NO: 85421 - DNA, 1042 bp, Homo sapiens
agtgagatgtctcaagaaaaaaaaaaaaattttttttaaattgtctgggtgtggtggctcacgcctgtaatcccagcactttgcaaggccaagacgggttgatcacctgagatcaagagtttgaggccagcctgggcaagatggtgaaaccctgtctctactaaaaatataaacagctggtcatggtggcgtgcacctgtaatcccagctactcaggaggctgaagcatgagaatcatttgaacctgggaggcagaggttgcagtgagccaagattgtgccactgcattccagcctgggcaacaaagtgagtctctgtctcaaaaaataataaattaataaaataaaaatataaaatcagtaataatggtagcaaaaggttatctagcgtactatgtggtaggctctattctaagcatgtgtagatatagtctcatttaatcctcacaacaaccctacatattacaattatctccattttgtagatgaggaaacagactcaggtttaagagttggcacaggttacatatctagtaagtaatgaggctgcagttcaaacccaggcattccaactccagagtccatgttgctaatgatggaccaactggcttctaacagttccatactcatagcatcttaaccagattgttggtaaatattctagctaatgttctgtggcagaacctttttcctctgggttgatatgcaagtattaatcagaacctcctcgtgttctctcagcactcacttgtactaactatccccccagtcttatcagtcttttcctcagtccccttgatagagagactttgggtagaccatagtctggtttattctttttttttttttcttaagttcagctttgtattgaacacgttataagaaatttagtcaaaacaaccaaaagcccatgtcatcatcagactcctcagattcttctttgtttgcttccactttcttctcagctggagcagcagcagtggagtgggcaggatcccactggtgcagcaccagctgctggagcaggtccaccagcccctaca

SEQ ID NO: 85422 - DNA, 1403 bp, Homo sapiens
agtagagacagggtttcaccatcttgcccaggctggcctcaaactcttgatctcaggtgatcaacccgtcttggccttgcaaagtgctgggattacaggcgtgagccaccacacccagacaatttaaaaaaaatttttttttttttcttgagacatctcactctggcttaggctgcagtgcagtgatgcgatcgtagctcactgtagcctcaacttcccaggctcaagcaatcctcccacctcagcttcccatgtaaataggactacagggatgtataccaccgcacccagctaattttttatattttgtagagatggggtctccctgtgttgtccaggctaatctcgaactcctgggcccaatcaatcctcccgccttggcctcccaaagtgttgagattccaggccaatgttttatttttacacggttagtttatcagagttgcatatgaatagtgaatgaatcaactcaagtccacaaagacactggtagggtagaaaaagtagctggactggagcaagcacagacggacttggacttgtcctatacttggagctagttactgtaaaagtagagcgagggcaaggcatgaattaaaagtagcccaagaccttgacatcaacgttcatactaagtacttaacagtgcacttcataacttaacagtgtataggctgccaacaaaacagctaatagtcttaggctactttaaaaatgatgaatttagcatagatcatattatactactctattttgtattactcgaaacctagtgaaaggctaggttaaatgtttttggtggagaataactgagatggtaggggtactaagaatgaggacatgtgacccacagctgatgaaactggggacactgattgagaggactcctgaaagacacgtcttcaaatatctgaggagatgttatgtggggataggcccaaatggacaaaatgaagactgatgggtaggggagaaagaaaagtaaactatggagagttaatccagtcctacataaagaaaagtaacctagacacagcatttcttcaaagagaaacggcacagcttcagaaaggagcgaactcctgcctcctaattagaactcttcatgggctggcagacacttgagaaggaactctaggatcagatgtgttggacagatgtcctgtaaagagccttcaaactcaagcattacaggagaggcaacactggagatatcattattaatgcatgttttatttggggttcatgaaagaaatcccacttacccatatcagagtcacctccaccagaggagttcaacttacgaaaaatctcctgcttctttgatttaaccatgggtgatgtattttcaagcttggtgaagaatgaaggcaagtagcttatactccctggtgagcgggcat

SEQ ID NO: 85423 - DNA, 1007 bp, Homo sapiens
aatcctggggacattcctatcaatgataacaacagtcagagagtacttagaaaactactgcctcctcatcctgtgtttgtggttacagccctaagaaacagtatgtaatcataaaccacttagtacatcatttgaggaaaaatgatttagctctcaaaatgaaatcataaaattagaattagaatggagataatctagagcagaaattcttaggaaggaatgaagaagcagtaaatgaatattaataggaaaactcagaaacagcttatgatgctctctccttaacagcacaaacactgatatattaatggttaccacctaaactgggaacaattttactagaattagttttaagtacactaaaattaaaactaatagcacgcttgactacaaaatagcaagaactcatatctaagcaatcaacagctggactggaacacaacagtataggaataaaactgcctatttgttacaatcatttcaagcaacctaacaaatgagctgagtttaatataaagagtttcatattttactggcagcttcctatactaacacatttaaaaaaaaacaaggtttccctaaaaactccaggccaccaaggatctagctagagccagagatgagaacagagactataggttattgaaaacctaatccaatcatgtggattcagtcatcattcaaacacaagaacacgtactctatgccaggaaagacaattaaggtgataggaacaggaataagacatggtccctgtcctcaaaacactcataaacgtaggggaaagatgtaaatgtataattaaattgaacatcactccctctccaaaaatggattttcttcatttcattgaaaagtagcaatatctgtttagctccctaagaataaatgcaataaattaatagcaacactttgtaagaaaggcactagcaatttggagttagaaaggccttcgtttaaaactggcccttccccattagtatcagtacgaccatgagcaagtgaca

SEQ ID NO: 85424 - DNA, 1058 bp, Homo sapiens
gaagtcatgagttaacaagtttctgtttaggtaagtcccaggttagcctttgaaacacaatctaatatttcacatattacaatagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggtaagtgtgcttcctagtgacagcaaccattcatggcgtgggtgctcatgctttaacatttccttcagttgttgccgtttttctcagaactttgggcttttatgtctggatggcattcttagaggatcatttgtctcttttcctactcatctaatgctagtgtattttagcaaaaagaaaatatttataatatcatatttaaataggttagaaaatatttgttcattattcttgaaattaaatctttctagattttttttttaatgtttttgtctaggggaaagggtcatccattgattcagccaacatttgaatgcttactgtataccaagcactgtggactctgaatagatttaatcttacctatttctaaccgtgaccccaaccctattaattattaaattatccccatttgactagatgcctttgagttggctcctttccagtcagtctccatacctccacctgagtgatttgtctaaaactcatgcagaatccagcacccagtcttttgcatggcatctgagttcctggcatgaccaggtgtatgctgcgcattcagcttcacttccctctgcatcatccctacactggaatctctgtccaaatcatgttgcttattgttccctgaattcctttctgtccatagtcgtgcagtttgcctagtgctgaaccctccactgatgcgctgaaagccagacatgtcacttgctcatggtcgtactgatactaatggggaagggccagttttaaacgaaggcctttctaactccaaattgctagtgcctttcttacaaagtgttgctattaatttattgcatttattctt

SEQ ID NO: 85425 - DNA, 1366 bp, Homo sapiens
gttttcatatttgcatttatcatttgcttctaattatctgtctagaccatagtaagaattaacttgttttgtttgttttagggtaatcttacatgagccttctttagaaacagcaatcgattcttttttattttttaatgatacagaaaattgtttatattaattttgtttgcttacttctgcatttatattttgttccactagtcctcagacttcttcagtgaataattttttttttctccaaaattaagataagttctttgtttggagctatgtaccacatcctttcaggtgttcttctgaattatatttaatctttgataatgagtgaaaagcacagacattcctggagtaagacatctatgtgttctctcctagatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtgtaagtttttcattattcttattagttaatttttcttttttgatcatggggaaagcagatttcatatagaaaaagaaatttataataaagatatctagatttcttaatactattttttttttgcaagtactcaatgaattttaccacttccttcatttctcattcacagcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaaggtatgatctttattccaaattatatataaattgcccaacagtaaaacaaatggaatatatctacaggataaggaatttgtttctcacaactaaagttcatttgcctttattcccaggaaagtgtaaatgagctttcttccccctgcatattattcttagaatgtccactgtcttggcatttggtactatgactttttaatgtatattcaaaagatgattatattctatttgttggtttgtaaagacagttaagaagaatgtgtagtttggtagtggtttggggacacttcagtggtgcttccgaataatacctctcatatttatctgtctcaatggtttctactgggtcagcatcagtagaagtttaagaaggtgatattggccagacatagtggcttatacctgtaatgctagcactttgggaggctgaggtagga

SEQ ID NO: 85426 - DNA, 4114 bp, Homo sapiens
gggcaaactgtggttgaatgaaacagtctcaaaccctagtgtagcagtggtatattattttcattatgatgcttagaaagttgtgcctgattagattttggaaatcatatacacactagagtttgaggaaaaatcagaaagatgaacttatatgatttgtagtagtacttcttgttggtgctgttttatttatggaatcaagattgaaatttatcagagaaatggaaatgacagtaaatgatggctgatgttttgtttcaagttactgctgcggttttattgcatctttatttggacacttttagaacatatttctggaaaggccagaaagtagactatcaagtttcttatcttgtttttcttttttctatttaggtatgttaggaaataaacaatccataagcattgcttccttttgtctctggcttcctccttatgtctttgtttctttctctttttcacctctgcaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgtcagtctcttgtacatattttgacaaaaaatgtctcttgcatatacattttaaaatttgtgactgcaatagtctaagtatagtcatgcttttctgcccatgccatgaaggctttttttgttgttgttgcagtttgtccttccatctccccaccacattcccagcaaatggtcttcccttcacagagctgtgatttggttttatttacaggccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagctgtatgtatctcaatccgagtttcacaatgtgatgtctgagtaaagaattactttattctttaggtcaagtagaactatatggtatttaaaaatcctaacggttgatagtaaatgtaatgcaaaaatgtatcttctgctgtttttatgattatttaaatatcccagtttcctacatataagcctatcaatgtatcttccacaagaaaactgtatcattcatgtaattaaatttggaaagtagaaggcagaccttattaacatatttaggcatctgaaaggtaatggatatatcgccaggctctgggctactgaggtgtaatttctcaggaagcatttgctaggacatggttctatatttatgccaataccccaaagcctctaatatcctttttctaagacacaggtttttaaaagtgagactacctattattggtgattggtatttatattgcatcgtttttgcaagttggattttgttcaagtctggttagtcattaggatggctacactgcaaatgtgttagaattcacaggtctacattaaaatgctagaaaagttactttttaaattttcttttaaactattgccttaattctatgtggaattgcagaaagaacaagcaagtatttaaataagcatctgctaatactggaagtaatttaatcatatataatcatctttctgttatctccattgaataaattcagtagagttagacatcatgaaaaaaaaaatgatttctcatgctccagaatgcaatgtgcagttcttttgatctctgagtatccactagcttaattataatttgtttacgtcatatctaccgcattgctgaggcttttagagagagagttagtgttgtgtagacaaaagacttcttttaacctgagattaggaaaatctgcaatatagattttctgcatgcagaaaattgctagctgagaaagagatattctatagttgtatgaataggtcttttgaagggaagtcaccggcacactgggagatcccacctgggcttattgaatggtatagcacatgggttccttaatcattggattaaacatttcttttcagtttgcatcacaaaccaaaccttgctttaggaatttgattttcagaaggtgtgaaaatagaaagctcatcttttctgagtgtccatgtctctgtgtgtggttatcttttttatcactggtcagtgaattccatgatgtccaaaggctatgtacagttcttcagtgtggttttcagtttgactcttgagaaccttcctcatcctgaaggggaggtccattgccatagtcttgccccttaaggcttcaagaacaatgtgaacacggtttggattccgactttctactgagtgaatattggaagttgtaaccagatttaggatgttgaatacataaacagtgatgagtaacagtggatacaaaagtcacaaattactgtaaacttcttagaatatagtgatttattttagtttctcaatgatcatttctgttccatttatcaagtttccaatctcctaagtgtactagaacccaggtagctgcagtttccatgacctggtggggataggaaggactgttgagtaccagaggagcaggtggtggctagggagcagagttcattcccacctgctgcatctgtgtccagcccagggccatgcaccctttggagctctgacagtgctctcagattctgtagtgcagtttgtggatgtgaagagccctctgaattcagaggttcctgagcaggcggttacatctgctcccaactgtcagctctgaggctatggcaggactgtgaaaagctgcctgttagccccactgcatagccctctgtttacttgggaactgtgtcttagaggaggtccttttctgatgtgggtatcctccagagttggttgacatcctccctttctgggaatatacttcccttcagacattctctaccatttctggttattttcacaatgtaacacagtgctaaaaaattattaatgtttggagtaagttttgttagcaatactccatttatttgagaaaatcattatatagtgttatataatccatagctttaaaatcatcatggtggtgaatgaagcagctttatagcctcagcgtttttctaagaacagagtgtcccacagaattggaatcattggaatcagttattgagatctactccctcatttgtttattaacctcttccataaatgtttccctggtgatttcttttccagctcccaggaaaatatcataaatctgttctctgttctgcctcattccagtgtttattattgggctttaaaacatgtctttttttttttttttttttttttttttgagacggagtttcgctcttgttgcccagaatggagtgcaatgacacaatctcagctcaccacaacctccgcctcccgggttcaagcgattctccggcctcagcctcccgagtagctgggattacaggcatgagctaccacgccctactaattttgtattttttttagtagagacagggtttctccacgttggtcaggctggtctcaaacccctgacctcaggtgatccacctgcctcggccttccaaagtgctgggattacagccatgagccactgcacccagcctaaaacatgtcttaaagcccataaaacttcagaaaaccctcattaacctggaatacctttgaacatggtggatcagaattgaaaaaatgctacaggtgtgaagaacttagacttcagaaacttttcctgggattagtt

SEQ ID NO: 85427 - DNA, 1047 bp, Homo sapiens
tcttgacctcatcttgttctgtgtcctcactccaaccttctaacgtgctcactggcttcataacagctagctgttttatgttttagcacacacccctcttctcacagacaccaccacctcagccaggcttctcagcagttttctcccttctaaccattcatcagcttatatgaatatttatttttttaattaaattaaaaaatttttaagagacagcatcacactctgtcacccaggatggagtgcagtgacactccatagctcactgcagcctcaaactcctggcttcaagggatcatcctacttcatcctcctgagtagctaggactacaggtgcacaccacggctgctggctaattttttatatatatattttagagacagggtctcaccatgttgctgaggctggtcttgaattcctggcctcaagcaatcctcctgccttggcctcctgagtagctgggattataggcatgagccaccatgcccagcttatctgagtatttctatgggatatattcctagacgtggaattactagacaaaagagtatttaaaatttttatctccacagaggctacatccgggaccagccatacccactcttcagggttttaatccatctattccactcgtgtaaatgtccctctgatcatgtcacctgcctcctggacacaacatttcactgtaattcaagatgctacacaagctgctaactgtattttccattcctcctctaaactcaagctcaacaacacctttatatctaggagtttttgctagggctgttctttcagccttgaaagctctgtgaccaatatcttcaggcccaactgcagtccactgtttgcaccaaataaaaatgataccttcatcatgaaaacatttttccgtgtaaaattcacgtttccaccatctcagctgctacagcactttcacctgtttttcacttggggcctgtaataacgttgtcttagaatttttgtttccatcaaaactttttgtgcgcagcattaagcacagtgtacaagattactaagatgtgtcc

SEQ ID NO: 85428 - DNA, 1152 bp, Homo sapiens
cagttgatatttttatctttaagctgcaggtttatgttttacaggacacccaacacaccttgcagctgctgcaagtgctgagagggaacgggaacgggagcgggagaaggagcgggagcgggaacggattgctgcagcttcctccgacctctacctgcggccaggtcagtgaaaggcactgctcttccattctctggacacatcttagtaatcttgtacactgtgcttaatgctgcgcacaaaaagttttgatggaaacaaaaattctaagacaacgttattacaggccccaagtgaaaaacaggtgaaagtgctgtagcagctgagatggtggaaacgtgaattttacacggaaaaatgttttcatgatgaaggtatcatttttatttggtgcaaacagtggactgcagttgggcctgaagatattggtcacagagctttcaaggctgaaagaacagccctagcaaaaactcctagatataaaggtgttgttgagcttgagtttagaggaggaatggaaaatacagttagcagcttgtgtagcatcttgaattacagtgaaatgttgtgtccaggaggcaggtgacatgatcagagggacatttacacgagtggaatagatggattaaaaccctgaagagtgggtatggctggtcccggatgtagcctctgtggagataaaaattttaaatactcttttgtctagtaattccacgtctaggaatatatcccatagaaatactcagataagctgggcatggtggctcatgcctataatcccagctactcaggaggccaaggcaggaggattgcttgaggccaggaattcaagaccagcctcagcaacatggtgagaccctgtctctaaaatatatatataaaaaattagccagcagccgtggtgtgcacctgtagtcctagctactcaggaggatgaagtaggatgatcccttgaagccaggagtttgaggctgcagtgagctatggagtgtcactgcactccatcctgggtgacagagtgtgatgctgtctcttaaaaattttttaatttaattaaaaaaataaatattcatataagctgatgaatggttagaagggagaaaactgctgagaagcctggctgaggtggtggtgtctgtgagaagaggggtg

SEQ ID NO: 85429 - DNA, 1022 bp, Homo sapiens
aagaatttttcattatcagtatgctaaattttaaaagtaagaattctaagggttatttacatttcataataataggaaagtaactgtgggaaatattttatctaaaagctgtgtaaatgccatcaaattatttgtcatttgacaacactgtttcagaggagcccaatacctattacttagggcactgtctcccagattgtgtcagctgacagacttacctagcttctagatgaaggggaagcaaatattccagaaaacatgttacttgtttttctagggagaacatatacatataaaataggtcactcaagttctcagacaaaatggaatttttctggtttctatttagtgtttatcattgtcttcattttgtagtggtttcttttgcttgtttttgagcctgagttggattataatgttttgaggagagagacattatctactttttaccacgcctaccccttcctcgtatcttgtgtcttgtgtcattctctcacctaggggttgctaaaaactacagctttttggccaaatcctgttgccacttgtgtttgtaaataaagttttattaggatacagccacaccatttattctttttttccgtagctctttttgtgctacagtgacagagttgagtagctgtgacaaatgcgaaatggcccacaaagcctaaaatatatttaccatttggccctttatgtcaaaagtttgccaatctctgctccaaacacatggactaattaaatgcttatagtctataatcattttcaccccctggagagtaaagttactgattgccacaaagtattttcgtatacatttctgttggttgtactggatgatcagtactataaagacaattttattttcaaacacaactcttgcagatgccaggtaaaaatatgataaagttacatgtcaaagattgaaagtaaaactacttgagaagtttttagctactgttatccttccccttttccattacatcttagacattagaattgctattgctaatacatca

SEQ ID NO: 85430 - DNA, 1489 bp, Homo sapiens
ttgagggtggctgggtgcagcagctcatacccataatcccagcactttgggaggccaaggcgggcggatcatgaggtcaggagattgagcccatcctggccaacatggtgaaatcctgtctctactaaaaatacaaaaacaattagccgtgcatggtggcgcgctcctgtagtcccagctacttgggaggctgagacaggagaatcgcttgaacccaggaggtagagactgcagtgagccaagatcacgccactgcactccagcctgggtgacagcgagactctatctcaaaaaaaaaaaaaaaaaattgaggatgatggctaataagtgtttgaatatatatttattggtgggacaatctgaccatcctgaataacatcatttaagagaagagaggctggagtagggaggtgatagatattggtgaagtaatgagaaagtcattgtggaagaacagagcaaggaaaaaattagtgaaactagtgattaatgggtaggaaggaggttgcataacacaggcaatgagagaaaactgaagtttactacatgtggggacaaaagaatttagaatgttaaagtcatacaaaaaacaaaatgattcataatgagatttaaagaagagtattgaattttatttttaatgttacataaggtggtaaaatactggtgctatgatccaaaaggtgacagtactctccaaatctcagtttctactagttgtttacattttcatatgttgtttacattttcatattttgcaatattgaatgttaaatgttgagtggaaagagaagatccaaatacatgaatatagtctttatttgaatggttgagaaatggacaaatattatcatacttgcaagtttcttaagaacttgtggcattggctctttttttccagttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctggtaaacacaaaatatagtgataatttatggcaaataaatatgccaccagtatgacttttcagctttctgttgttgtacaatatagtacaattgcaaatatcattaatgtacagctcagtgaattttcacaaactaaattctcccatgttaccagcacccagatcaagaaataaaatcttatcagcacccggtaaagaactaaaaagaatagtatatgaaaagctctcttatctgatggcacttggtgaaactagttgaaaaagtggattaatgtgaataattattttaaaatgacagaggcatacctaaacatgttaacttacagcataaatagacgttcatttaccagaactctgatct

SEQ ID NO: 85431 - DNA, 1235 bp, Homo sapiens
agattacaggtacctgccaccacgcctggctaattttgtatttttaggagagacagggtttctccatgttggtcaggctggtttcgaactcctgacctcaggtgatctgcccacctcagcctcccaaagcgctgggattacaggtgtgaaccaccatgcctggccttgtgtacttcttatcatcaggttttcttatgtctatagcatagagtgtggaatgtgggaaagtatgcagcttgggatcagtggggttgtgattgagatttgtaaacagaccaaaaaagatcaccacagtgaactgtaactgccatgggccagacatagacctgagatagaaaagtagccagatgactttgctacctgtaatgtttgtttctttccctttagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatggtatgttacttttgttgcttggtctgatactttttattgcatttaaaaaaaaaaaaaaaaacctttgtcaagtagtaaatatcaaattgtcagctttagagtatcccaagatctacaggtcttgcttgagtctaggagtatggaaggctactaatttaaaagtaggcataatttaagtaaaatacctgatatttaaatcaagtgcagattatgatgcagtccagaaatgctatagagtaagtatatttttagagtggattttcagccaattgcataaggttttctggaagtcagttttgacattgttccttcagcggcagtgtggtgtgaaagctgtaagtagcctctggaacaagactgcataagcttgaattaacattcttactgcatcaactcagatgagttacttagtttttttgtagcttagtttcctgatctgtaaaatcataatgtaacattaagacctacctctctggattgttatgaa

SEQ ID NO: 85432 - DNA, 3029 bp, Homo sapiens
tatttgcacctgactctgtgaccttggagtagtcatgagctatgctttctcttccaatacaaagaaataaagtatgtgcgtacatagtgccagatgctgcaaaatgcttgatagcattcttatttcactctcctttacacgtctggcatattatgattcacattttgtttttggggttaagaaattaataatgtacgttgtccatatcagaagtctacacacctctgtttctttccacatccaccaaatcactaagccatttctgtttattttcctaaagtgtctagaatccatccattactctgtattcaccactgtcaccatcatctttaacccagcagccacctaactcatctccctaccttcagtctcacccatattcaaagtgtgtaccacgtcactccttgactgatttttccatcaccctggatataactgcaaacccctaccttagctttataacccctccaggagctgctttcagcttagctcttcacatttttcccttctcacttttccctttagtcccctatatttacctcccccacactcttcctcccaactccactctacacattagccggttaccacgcttacgttcttttattgtacctttctctgtctcaccttggggtcttcgtgttcactgttcacactgcctgtactttttcctcctattacctttgacttgaacaactcttattcatccttcattctcagcttacacattgcttcctctgagcaggcttatctgaacctggaggtgttaggtttctctcctagcattttcatagcacattatacttctcctttcatagcttattttactacataatctgtacctacattattgtgtaagtttcatgcagaaagggacttaatttgttaatcttacctgcaagcctagcttatgcctagcacacagtaggcatcaataaacacatttgaatgagtgaaaatattttcatgaatcatctacacatattttattgtaggttaagacaagttttaatattattatttttataagatagactatgaaactaacctatttactgtacattgtataccatgtgctccgtctgagcaagtcttgtttgtgtattctgtagatattaagaatgcccgagaagggactaggagtccaagaacagctcatgaaatcagtttaaagagaagctatgaatcagtggaaggaaatataaagcaagggatgtcaatgagggagtctcctgtatcagcaccgttagagggtaaagcattgttttcagaatgttattttgatacatgttattttatatagtaattttgcattgttgaattaagttgtatgcaatttctgtcatttccacctgaaatgtatatttatattaagttgtatgcaatttctgtcatttccacctgaaatatatatttatattaagtttatatctgtatataaagtggcacataacaatggaaggaagtcaaatttaagcgtaattggtcatatcataggttactattagaatgttcatatttgaatgctcatacaatttgcagattattcctgtttcagctaagtgagttaaaaaaggtaaagtttattatgagaacttctttttgaattgtgagacagataaagtggtgtaatggataaagacatgaatttaaatttcagcttcacccttccctggtaaaattcctttgagcctgtttcttcctctgtaaattaagggatcgtacctaacactgtgtgagggttagaggcaggtgtctgaactggtgctgctcatgtgatatggcttcagtacatgatcagtatgattttgttttgttaatggcccactttgtttaaatcttaacctgcctcaaccaattttaagctagatgaaatactaaaagcagggtaagtcctgtgtaattttctaagagctgtatttttctctatgttaaaaacacacacttttactgtaaatatgtgtggttatttctaacccttgatttatatttatcagcaacaataatgtgaagcttcttaggaggttatttacaactctttcgtttcaatttgcatgtttcatttaatacattttccctatttttatggtatccatatttcccgttttccctttatcacaagtatatttcaaagctaagcaatggtttccaatcctgtatcttctttcctcttgataaagaagtgttgggattttagatttaactttgaaggtatctttccttttcaacctttcattagatgcctttggtggccattttttatttaggaaaatatttacaaaggactgtgtgatgtcatattaggtacttctggatagttcacaaacttaaattgacattccttccttcatagagcatttatcaaaaacatagactttaagaacagcattcagtatatgtgagttgacatatacattatgttgaataattgaattgctttcttgttttggaagggctgatatgccgagcattacccagggggagtcctcattctgacctcaaagaaaggactgtattgtctggctccataatgcagggtaaactttctgcttgttttgcatttttatttataactgcctccctggcaaaatagtttgacattaatttacagtgtatttctgcttttcaagttattttcccttttgaaatattaaagtcttggttattacttttctgcctctgagctacataatttattggaagatgatagttgcttaatcttttaatatagagatatctttattatgcaagaaccattctgtgactattatgaatgatgcattaatatcatatctcaagcaaccctaaagaaataatgattgataaatactgatttgaggatctactgtaaacagaaagttaattagaaactacaagatgtcaaggcattattttaaattatgttaaaatatatgtaacaaaatttaccattttaaccatttttaagtgcacagttccgtggcattgttgtgcaaccatcagcattattttaatgtttcctgaattctttttcaagggacaccaagagc

SEQ ID NO: 85433 - DNA, 1012 bp, Homo sapiens
gtgtttctgttttaacagcaagctaatactttaatatggacagaggaaagtaaatgggcctgtatgtattattctttctcttcactctggcatccaaactgtgggaagaaagagtatgaactgggccaaaggagactaaattttatctgtttaaaatctgtttgtgcacttgacatgagtacttctgaagtgggcgttaaggatttctagacacttactaatgagttcacttaatgactggacaagtaagtgtatgtctcttatcgcttttcttaagcatatggtatcagattgtgctctctagggttttagcagtcctcagagtatagtggtgaccctaaatgtgagtaaactcagtctaggcctctaactcctattttacaccaagctgctctctcttgcaaaatgctctacgtattagattctatgaacaattttccttgaaggaagggctcgctgcttaaaggaagggtaaaaagaatcatggtcattggcaactccagaggaggattgatgatggtgaaaatatagataacctgacctaaactgaatcagtgtcaaaacacagaggcatccaaaggcctaacaacctagtagtcagtttgatatttgaaagttatttttccctcatatcacaatttgagaaaaagttgtagtactctaaatttaaaactactttatcatcttatttttattagaaaatttatattaggttggtgcaaagatgtgatttcggactgtgaattttaaatcattataactaggctcaaacgcatctttatcaaaataggaaccattacaatcaacacatttttgccagtgagaaataatcttgttcattcctgtagcataaaaatacatgcttcgagattcaacaaactcttagaaagcattttctttctcttttcttttctcttttcttttcccttcctcccttcctcccttccttttcttttccctcccttctcccctccccctcccctcccccctctcctcccctcccctatcctct

SEQ ID NO: 85434 - DNA, 2130 bp, Homo sapiens
aaagaaaagaaaagaaaaaaaaaggttgattcttaaaatttttccaggttttcttgttgcttttatggaagagagtttttggaagtccttattactttgctgtatttgctgataccactctccatagcatttttagtcggaatgaatattaataatagtagcttacattttgattgcaacatataagtgctttatttatgtaatttattaatagtaaatactatttacatgtaatgtatggtaattttagaagacatatcctactccctttaaaattttttttatatttaagcaatctacgatgaagattttcttgctttacaaaaactattcttggttttgggtagaaggggtataattttttttttttttaaacagaaatgggaatgctgactttgtgaaattgaccttgtgaaaaaaacaatgtttgcttaatctttaaatttttttttgtttttttcttagggaacaccaggcacttatttgacttctcataatcaggcttcctacactcaagaaacacccaagccgtcagtgggatctatctctcttggactgccacggcaacaggaatctgccaaatcaggtcagtgagttaatacagtcataatgcatctacgtttgtagcatcacagccagtaatttagtactggattgtttcatgtttctctgcctttccacagctactttgccctacatcaagcaggaagaattttctccccgaagccaaaactcacaacctgagggtctgttggtcagggcccaacatgaaggtgtagtcagaggtaaaatatgctggttggcagaaatgttaaacttttgtccccaataaatttattaaagtaagttattaatatattttaatgatgggcttttttaactatagtctttaaattctaaatttgttttctttccatgtaaaagtcattttaaaaccttgaagttccatgtttcagcagttctttagtattattttggaagtacattttaataaaacaaacatgatgggttttgtgctgcttttttcttttcttcttagttgagtactctcccaagtaggggctgtttttttatgttttggggcaggggctgggggtgtaatttgctaatagctttgtttgtattcaggtaccgcaggagccatacaagaaggaagtataactcggggaactccaaccagcaaaatttcagtggagagcattccatccctacggggctctatcactcaggttagtcacgatcatctctgatatactcaacagaagctcaggaaaaaatgataaataattcttagcactttggctattttgtggcttaagttcatttttctgcattatgggactgggtctcataacctagatctgcaaactgtctccacagagacgttaatgtgatcattttgactacaagctatattatgaatactttggttcatttgaaaaggtcacttatttgcaaactggaaaaagaaatatgttctaattgatgcagctcttattgtcttcctggaaaagcttttaccatgtgtttagcctaaatagaaattgagaagaaaatcattacgaattatttgcttacttttgccctggtggagatgtagttgtagaatctcagtatgtgggctgccttgttagaatctaatgctaaaccaggaaatgtggatggtattaacaaaagcaccagaagccttccaattttgggctaaatacatcaccaattttgattaataaaatttctctcagttagttgttaattttaacttgatacttaagaagttcttagcctctttatgtatatgcataagagggaaaattctgttttgggaaatcattgtaaacagaaacctgtgccttgcattttctaaagtgttcactcattgtcacaagttttttatttgtctagttactatcctctaagacagttgttctcaaagtatgatccccacaccaggagcatcagaatcacctagaaaattgctacacatataaattttcagatcttaccccagatttactgaaacccaacccttgttggtggggactggcagtctgtgttttcccaagcccttagctgattcagctagggctttgctggccaagtgtggtttgtgcaccagagcattggcatcac

SEQ ID NO: 85435 - DNA, 1634 bp, Homo sapiens
ttttgagaggaagtactcaatgattttaaatttagatttacttggaaagataaatggatacaactaggtaatgaaaataataaataaaatgagtgggaatttattctgacagacattaaaatgctacaaatctaagtggtcagggttacaaatgagttttactttgtgcttttttgattttcaaaaattacagatgtttcattttaaaaagaaactatatattttaaagtcttaaatatgactgcatttctggcgtgccctttaaaatatttaaagtttctttatgctttatgtggagataacttacatgagaagtaattttcattagtattattgtagttatattcatggtttttataagcttatgtaggatttttgaattagtttgatctgcatcttttgaaaggcttcttccatttcttaattaaatatatttctgtgaatattagcaaggagtgagcttcaacaggctaattataagacttgtgaaatcctcgcaaagctaataacctccagtcaggccagatttgaattaacagaattgcttgataatctgatgtttgcctgttgtgattttattgcatgtgaaaacacttgattctccttaagaggaaagagaagttctttttcctttaaagggaaaactcgtaaatgaatttttgaggatacacaggagatttagatttacaggatttcttaacttctctgtgggtgaattttgcccccaggagttttagactttaatgttatagtcggatcagcccctggatggtgtgggcttggtcctttcacacttactattttaatttggggttcttcccttattttgataactttaactttcataggaaaatcagtcgcctatatgccttatgctgaggtcaaacgtgctctagaacaggaagcacagatgcacaatactgcagcaaggtcagcctcaccgtgtaggctttctccaagagaagtcagtaaagccgctccacagcctgatatgagtgcagcccgctatagtgtcccgccaggtaaatatcactcctctgtgcagtggctgctggccatccacccacagatgttccacgtgggtggtttaatctcgtgaatgaactgctcttccaggacgtgtccttgctgtttcagaatgactttgtttctctgcgttccatcatcagttgtatttagttgagttcactgggccactgggaaatttgtgttcacacatttatactgtgacattgactggctcttcctttaagaagagtacatgaatttgtaaaagtcttgagatctccccatccccaaaattcaagtgttctgtgagagccagaatcagtaagtgtttctcaatatgcaagatgcaaaaaggatgtataactggttgtcagtcatgtctgcgcattctctgaagtagtgttatcagctgtttttaagaagtaccctaagagtgattggcgagagagaaaaaatttttgaagactgatgtttgctatgctaagcagaagtttgaaataagcatcagcttgaaagctgtggtttgaaagggagttgaatatttcaaccccacaaatagtatttgtgacaaatatgtatacaggcttacgtgaatgagaaatttaaaatagaaatgttcattgttg

SEQ ID NO: 85436 - DNA, 1304 bp, Homo sapiens
atgacattcagatggtatcatttgttgaacttatgacaaggcataacatcattgttagtaatatctgggtcatttaaatatggatatcataattttaaagcctcaatatcttttattggtctgctttataaaatgagttgtatttgggaactgaagaaactgaaccaggctggagccccaaattctgagactccaaactgtgaattgtatttctctgtgttagtcacattactacacgtggtttagatctcagtggtatcctaatttttaatcataattcagtcatcttaaaatcaaattgtaattatacttttgattagtatgacattaagaattttacagtttggtcgaaggtgatgctctacaaagtagggcaagtttatccaaaggttgttttgttttagctaatctccctagtgtattcatcctgtaatttgtttaacaagtaccagaagtttttccttgagtctatcctgtagttcagtgtataggataacctttcaaataacatttaaatgtttgcagttaagatgcttgtgtctagaatgtttgacaaaaatggtttaaatttaacctcatagaacagtttatagaatgtgaagaatagtgatagtatggatttatgtataaagtatcaccaaatattggtacagtccacctgaattagggccatggtttttacttttcccttcatggtctcttttagcaagtaacaggcagcacttgttgtccaactatttggttgtatttatttctcttaatgtgaatggtataaataattactgtaggtatgcctgttttaagttgcttaaagcttttcccatctgtagaaaaggttgaaaaaaaaccttagagaattgttttcacttaccagtaacatttatacgagttgacctctgctttactgataacttttaagcctcttttctacagtgaaggaactcaaacttaagcatatggaggtagagttagaattgaacttctaatgcaaatttaacaaaattatccaattaaaataagagttaatgcttctatgtaactgaccctagtttgttgcatgtttattttgttgctgttgctgtttttcttttcctgctctgggtacatggtgatgtagatagctgtgtttagaaccatccaatttccatcatttaaaaaaaaaaaaaaaccactactatgaccagtggatttttttttttaaacatagttataaacttactggaaatggtaaaataatcagacattggatttttaatacattatcatattaaattatctaggaaagtgattttcttttggagttg

SEQ ID NO: 85437 - DNA, 1029 bp, Homo sapiens
ctaaaggatgccagtaacatttttaatagcattctagttaatgtgaattttctgatattcatctttgtgctggaagacattataaataaagttatgctttatgttccgttcatctgaattttcagagtgagaattgttgtcctgtccttgaagcaaatcaccttcaagtattacagtgtaatattcacattctctggtagatgagagacacaactttgtgtagtggatatttccaatcagacgctggctaagccttcaccttggcatttgccagctgtgtggccacaggcaagtcacttaacctttcatagctttagttttctcatctgtaaaatgaaaataatagtacacgtctaccttgctgtggttgtaaagttaaggaaggagcattcggtattgttatataacaggtggctctgcattattttatgtataatgtagcacgttattacatattaattagtgtattagtactgtatatacacagtagatactatggaggtacctgttttcattgttacatcactgtttttatttcaagtgatggatttgagttggtccgttgctgttttagttggtgtgtgatacacttttactttctttaaaaaaagaagaaaggggtggtttttatgttttaatacattcttctgacatggttagaagaattggcacatgtttctggttaagaatgagtttatagtctacttatatgctacgatatgcttagaatatcagaatactgaaatagtctgaatgattcagaagattctttacagtactttatttagctaaataagagctattagctttacaatgccatgcattccaagggttatttaatataaaataggaactgtggtacttaactgatcctgctgactctgcccagatcacaccaatattgagttattagttgcctaatacactgaacctcttatgttagagttttaaatttaaacttgttaatttttaaacataaatcttgtgctaggaaaaatgtgaaccagaatgataatatccaccaaggaa

SEQ ID NO: 85438 - DNA, 1620 bp, Homo sapiens
aattaaaaaaaaagtttaaattatttgaccaatttcttcttacttttttaatgtgaccatcagaaaaattaaaattacagatgtgattacattatatgtctattggatggagccgttctagagtgtcagttcagctgggtaaaaggaaattcacaggaagaggcttctagaaatacaccagaatgtcatcatttataggaatgttttttgtttagttttattgttcgttctttttcaatttcatataaattattttcagacattaaaatcctttatgcttttagtttcagaaggtcaagataatttgatctttcacttttatactctgtaggaaactttagccttctcaatggctgtaaatacttcaatgaggtcatcaaaggagtagaattcatcctaaacaactactttcaaacatggtttctatcaccacctgaaacatgttcattatcagatttttatgctgtatcattatctttaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagaggtgaggctcgttccataagtcctccccgtgcttactctgctggttggtgactgaatcacagggtggtgctggctgcagacatgtctcctatgtaaatattggcacgttataggtagtctgtacaattttaatattgggctgatactgttctgtttaaataaccacaaactattgtatgatcattttaatgaaacagattatacatttctcctatatctgtcttgttacgtgtattctgtatgatagcataacagggaatttcaactaataaagttgtgaataaaccacagataactgttgtgcctgaggagggcagcagtgggatgtggtagaagaaggtggaggctagaggcattgaggcactcccgcttctctaaggcagtgcaacctcaaaacaaggcctaccagcccctacttattaggtagaagaaaatgctgaaaagagagacatgttcagtgttctgaaaatttttagaaagcataatttaaatgcaaagtaatgataattatgaccacttttttgtatcagttaacattttagattgttcatatttgtaatttaaaatatcaggtataatgcag

SEQ ID NO: 85439 - DNA, 2169 bp, Homo sapiens
ctctgaaagattgaaaggaaatgtaccggtatatttaggatctcttactgttggaataatgagcagtgatttttgtagtgttatgtcttccacatttcaaggtatatattatctttagaaaaaatatatatatattgtttttattagataacattatctggagtgagtaaaaagcatggaggtatgtgatttttggctttttatacatgtatagtggtgagtaattccaaaagtggatcagatgtaacttttgcttagtttgataaaggcgagccatctacacaaaatttggccagttagtgattatggagaggtatttatctgcactttaaccagaactattgtcaaacatgtgacctccttgtctggtgtgtgtgtgtgcttatcaatgttctacattatttcagaaatgaatttttttttctttttagttatttaaatcaaataatactctttcctcctttagacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtatctcaaaattttaaatttagttgtgacatctgctatccagaataaataatttttagtcatttgactgtgtaggagttgcttcattgaggaaacagtgtgccagtgttttcatggtgtggagacttcaaacttgaacataatgtttttattcatttaatcaacaaatatttatgtagcacctaggatggtccagaagatcttggaaatggcagtcctgcttcagacatcaagtgccaacatcaataaaatacctgtgtgtctgtgtcattgccacatttatttgttcagttagtatagttggttacatttctctttattttattggcttaagtttgatttattttcatatttttacagagatttatatgtactgtagtaatgtttttacgtaaaaagaattagtgaccttagaagcaccgatagaaaaaaaaaacacgaaacttaaggaaatttaagaaataatgtatctttgtcatttaaactaatgacaagttcatggaaaggtaaatgttttcttgatttttttggtaagaaaaaagatacctaatttatttcagtttacactctgattaaagtttctgtggattttttttttttttttttggaaattgcttctgatgtggggatttttataatgcttttagtagctcttcatatattataaattaaacatgttcatgttttgtatatgcagataattttttccatcattttctttttgttttccttttcaattacttttgtttaaagtttgtgtaattagagttgtatctcttttctgtgtagggtctttattttgtataagctttaaaagttgtacatcctccaggtttagtaatattagattccatgttttttttttcctatagattattcttgttgtcttttaaacttaaacttgtattgaaatgggttttggctttgaacaacccctaaccttaaacttgtttttgggagggtttgtgaaaaatgaggtcatctttacaagagtagagagagtattagagaagtcccacccgagggtagggtaagagtgctgcaaacagggaaggtagtttggtgtgttaatggcacttctagagaggttgtcagagtctcttggttttaatgggtttgtttctggtggctagtattccctggggttataaatgttaatgaaggctggaggttaataaatctccttgggctgccataacaaaataccacagattgggtggctgcagcaactgaaattaattttctcacggttctggaggctgtacgtgcaaggtcaaggtgctggcacagttgctttctgatgagggctgtctttgtggcttgcagatggctaaccgccttgttactttgtccttacatggcctttcctttgggtgtgcgcactcctggtgtctcttcctcatatgaagacaactcctactggattagagcccactgttataatctcatttaaccttagtcatctccttaaaggcctcgtcttcaaatacagttacattggggggtagggctccaacagaagaattttggtggggaggggcacaatgcagtccataacaaagcccaagtctggtat

SEQ ID NO: 85440 - DNA, 2345 bp, Homo sapiens
aggagaggagaggtggagatcactaagtgggaagctactgggtgaggtaggacttctccagaaaaaaacaaaatgtttaaaaatgtagacatgaagagaacttttaacaacactgaaaaagatcataatattgaagtgttgacttgtttcttctagtttggtggaggagaggttactatcctatttctgcagtttctttcaccaaatgcttttacatagtcttttatgtcagataaagagatataattatatgattggtttgaataaaggatttaactttgtttttctctgcctgattgggttctctctttattttagtttctacagagcctgtggagacctctcgatggacagaagaagaaatggaagttgctaaaaaaggtaaattgtagtagttctggtttctcaggtttttgttttgttttttagggttattagtaatgagtgagatggaactaattgttttaattggaaaaaaaattctttcaaaaaggcaaagaggactcagaagtgactttaagagttcttttctggtagtatggtacccaataaagtacccccagtgtgccttgtttaagatgcccagttttaagggatttaagattctctctgcagttttattttgaatgtcatttaattaaagaacaagtaggtcgttttcacttttttagaataattatgactctatgctattgaaattgttctggaatgaatgttgatataaagtctatatttctattacctaaaagttgtatttaataggataggatggtaaatacttttgtcagtttgcatttggtaagtcatgtaattataaaccactagcagattgctctgtgattcagaggaaagagcatgaagtttgtaaccaggccagcgaaggtttgagtcctgtctctgccactttcatagctttgtggccttcctcttactctggcactttatggactttgtgcttttctgtcgttgcttgttaatgtactataatttgaaattgaactaaaatttctaataggataaataattggtaatattgagaaagattagctaatttttggtggttaaatatttaccttgcagttgtaaagataaattattgtaaatagcttgacatttgagtgacacatttcatatttttttgtatcaccccttatatatgtatacaaatgcatagatacatattctttgcacgtatgtgtgtgtttatgtgtgtgcatatatatattgattagagaagtgttaaattgcataggtttctgtaatgcattgtattaccataggatttttttaaattggctagtatttttctgatggcattgcttgattgtgaattgactgaggacaaatatggattataagtggagtcatatatatgtctttaaattgtgtttatcatttatatatgattatcttattggcttgatatattgtgtccagagatctagatgtacctaatcatttagtttgcaagtatttgagctattactaatgtgtctaatgttgtcctagccctgtgagagatacataggaaggacaaggtttagcccttctgttaatgagcatgttttaaatttgagggggaaaaatatagaactgtaaatgagttttgtttcaataagtatttttataagtatcaaagtatatatgataagtaattgaaagcacacttctagtgtcaatggttgtgaatacagtgattaagttaatttattatttctcttgtttgcttgatcaggtgactgttcaattaacatttggtctgtttttaaaatgcaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaagtgagtatattggggtggtgactctttacttactgttttttacttagagtgttgttgttgttgtttgagatggagtctcactctatcacccaggctagagtgcagcagtgcaatcttggctcactgcaaactcttcctcccggattcaagcaatttcctgcctcagcctcccgagtagctgggactacaggcgcccgccaccatgcctggctaatttttgtagttttagtagagacagtgtttcaccatgttggccaggctggtctcgaactccagacctcaggtgatccacctgtctcagcctcccaaagtgctgggattacaggtgtgagccactgcatctagccttgatgttttttttttttttttttttctgagctccagagattggttttaagagaaacctttttgtatcttatatttttattt

SEQ ID NO: 85441 - DNA, 1030 bp, Homo sapiens
tttataaaacaatattgtagattattactgtaaaacaatattgtggattattactatagaaaaggcatctatcatgaagatcatctattttagcttcttcatttcatacatgaggcaacctagactaaaggcaaataaaaccccagaattcctgccttttggtgtaggctgttgtctctggattgcaggtctagggcttttctgctgtcatttgttactttctcatggagtagttctggtttctaaatcagttggtttgaaatgtgtttaaattttaagtccattagtatgtaaaataggtcttataaaatatcttaattttagctggtcaaaacttttaaaaactatggtatggcagaattgttgataattttttttttttgagtgagagattaggtagttttattcaatttctatttagataatattcaaaactaaaaccttcttcgatgtatgtatactttggaatcacacaagttttcatttgcttttgtgtccagagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccagtgagtggaaacaattggcataaacaggccataattttgttcgggattctgtttcactgctaggatagggtagaaaggacttttaatattgacaacctagaaataatcctgaagtgtggtctttaaattttttaaactttaatgtcaaagttttttgaaaaagaacatcacccagtcttgccaccccaatatagctgttttttatttagttgttatgctagtgtgccataaatattttctaatttctaataattaccatttttattttttaatggctgtgtaatattgaggcatgacttctttaaccattct

SEQ ID NO: 85442 - DNA, 1096 bp, Homo sapiens
catattccattaagtagactttcgctcaaaagtataaatgcatgaagatgtttcttatagcattatagatagtgatgaaaaaattggaaacatattaagtatctaaaacatgataaattatgtatgggttatcaaattttaaggtagaattggaatgcttgagtgacagattaaatgtggaggttgccaaaaaagggaaccaaccccagatttccgagtagaatcttaacattttcactttctcgtgggtccaaatgctatgagcatttgtgtctgcgtgtaggacccttcaagcagtacatatagaatacattaaaaacctctagactggtttttaacacacgatcaccagttacattgtaaatgactaacaatcatttaaaatttttttagatagacataatttatcacactataaggagctatttctgtttgcctttgaattttacaaatgatggttcattctagcagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaagtgagttaaataattagttatataataagttaaatgtttatttttattttatttttatttttgtagatatagggagtacagttgtcacatggatatattgcatagtagtgaagtctgtgcttttagtgtaccatcgcccaaatagtgtacattatacccattatacctcacccaccccctcgcaccctctcacctgtttgaatctctagtgtctcttattccactctctatatccatgtgtccacattatttagctcccacttataagtgagaacatgtgatagttgaccttctgtttctgagttatttcacttaagatgatagccgttagtttgatccatgttgctgcaaaagtatagtttttttttttttttttttttgtgatggcgtctcgctctgttgcccaggctggagtgcagtggcatgatctcggctcactgcaagctccacttcccaggttcacgccattctcctgcctcagcctcccgagtagctgggcc

SEQ ID NO: 85443 - DNA, 1017 bp, Homo sapiens
tgcactccagcctgggcgacagaaggagatccagtcttaaaaaaaaaaaaaaaaaattccaggtgcggtggcttatgcctaaagtcccagcactttgggaggctgaggtgggcaaatcacttgagcctaggaatttgagaccagcctgggcaacatggtgaaacctcatctctacaaaaaatacaaaaaaaaaattagccaggtgtggtgatgtgtgctggtagtccaagctactcaggaggctgaggtgggaggatcgcttgagcctgggaggcataggttgcagtgagccaagattgcgccgctgtactccagcctgggtgacatagtaagaccctgtctcacaatgaaaataaaaataaaaataaaaagaaatacacttaacttttacttttttctttgaattttcattttgttttatatgtgttctagaatattcattcatagtgaatagcttgttatttgacagaaatgtttcatgttatattaactccctgacagaattaaacttgttttattggctctcaagtattgagtttaaagaaggggagaaaaggaaaaacctggacaacgagccattgcgaatatttgtgtctgtgtagggaacttttagaagggtttcttttgaaggggtggacctcttttgctccagccaccctgtggagttgagggatgtaacttgtaaccttcatcctagaccatgtggattgactggcacttctctttacagatttgcctgaaacaaaagtagttccaagcatctcttgtttaaattagaggtaattccttactctcttgaatgtcagtggcagttgttatgataggtctttatgcatattgcacaaaggtgaggtcctccagttgctgctgactgcacttcctctccgctcaccactgcctggtcagtatacagaggggtgagaggttctgctggacaggtaccaaacacttctctagactctaatgcagcaactctgtccatttctttggatcatttccacactatgcagagccagg

SEQ ID NO: 85444 - DNA, 1978 bp, Homo sapiens
gcgtttaatagtaaagtgagtttaatttaaaatcgctgacttaaattttgatgcctgtttgcttatttttctatttattgttctgtaatatgacggtaaaagttgttctataaaatgatgttgagactttaaaaaatgagactaatatgataattaaatgctccataaggtcaccacttcagtgaacttgacattactttttatcttccaggtctaaaattttattatgttaagtatcagcttagtttaagaaaagaattcttctcaaaggagtagattatttaaaaaacgatatggatattctctgcctctgtaattcatacagtgaatatttattagatatatgagtaattattgtatgttagatgctgtggtatacactgctattgttattaaactgcatacatggttttttagtgcacattaagagcattggtccatggccctccttaaatttctagtttatgttttattctaagtaaattgtattttttttccagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtaatttatattttaaattattctctaatagacatctacataagttagtaaaaagtatttggcatttacttgtaaattgaactgttttcacaaaaacttggtcccattttggtgtttgaatcaatactgtgaaaagtagagaatattgatcttcctgtaagtttataggtgggaaaagaggtaacagataagaactggggttatggagtcatgttaagagtggttcccaaacttgggtgctggctgaacttttggggagcttttataaagtacagatttctatgtattaccgtagactaatcatttcctggtgtatggtgcccagaaatctgtgccctttaaaagtctccagtgattctacaattgttcctcagattggcagttagaaagccctatacatagtatttctcttctgttttttttgagacggagtctcgctctgtcgcttaagctggagtccagtgttgtgatctcggctcactgcaacctctgcctcctgggttcaagcgattctcctgcctcagcttcctgagtaggtgggactgcaggcatgtgccaccatccccagctaatttttgtatttttagtagagatggggttctgccatattggtcaggctggtcttgaactcctgacctcaagtgatccaccttcttcggcctcccaaagtgctgggattacaggcatgagccaccacgcccagcctatacatagtctttcttttcccaagtttttttttttttagttgttgaaatatttgtacgcaagtgtgtttttgttttcgttttcactcaggtttatccagcatccaaaaaactttggactaattgcatcatacttggagaggaaggtaagacatggtttgcattgggagtgtttgtaggtttgtgatggttgttactttgaaattcttgtgctctgacacatataagtagttaactagaaccgattttaaaaagactgcgaagagtctcatgtgattaatgtaatgataattacaattattagagaaatcgtaacacagaacacagaactaaatggttaatgaaagatgacctgatgtttatttccctaaaacacatagattacaatgcttttggagcctcattaaatttctaattaaaatatcagtctcgtgctcgcttcagcagcacataatactaaaattggaacgatgcagagattagcatggcctctgcgcaaggatgacaagcaaatttgtgaatcattccatatttaatataaagttgattttaatgtttttgaacaaaatatttaaagacattttaaaaatttgca

SEQ ID NO: 85445 - DNA, 1052 bp, Homo sapiens
agatactgtgttgtagcaagtggcattactttgtttttcaggcatttcctgcctgtataaagagcagaattaataaaattatgaaacaggtagtagagaccaaggtatatgtttgacaaatatatcttcagacccaaaagcagtatttcctcccttgtgaagcttcctcactcactttcccaaaacagaactcaatgtctagtctcagtttacatttatttctattgtgcttctctttctgtttaataaatatttatgatcagctaaagtgtcatcttcatgagtgcggttattttaaacctttgggtcaggctatctttgagttcctgttgcctagtgtttaattggatattaataaataaatgcagaataagaataaatttccatttctaacattgaatctttttagccctgttcaaactctcaagattgttccaaaagccatctagtattgactgagttttgctagttttgattttattatatgccttttcttaaacctcatctcaaaattctgagagtcttgtttatttgaaatagtggccttaagtaatgatcaaagatattttttaccatgctgtatacttcaaaataaatgttaagtagacttaaatatacagttaatactcgatttgcaaaattaggtgaagtggatttaatctaaaatgttcaatgatttagaaataatttagataagtaaaattcctgttttcatactacttagcacatttagaagtaaaaagcagtgttatgacttcctctgctctaccctttactactagttaacctagccagtactttttctcctttttctatgggtattgttggtttaggttatggtggactaactacatctttggtttttgaggagggggagtttgaggggtagttactacttaaaattgccaattgtgataagcacctcatatgtattatttaaactgtgaaaattctgtgaaatggaggctataattaatggctgttttgcaagttaagaaactaaagcccagctgcaggttaaataattcacccaaggttacaaattaataaat

SEQ ID NO: 85446 - DNA, 1033 bp, Homo sapiens
aattttcttttttattgtctcatgtaagagtcatgtaagccccttaactcacaattaaatttttgtaagggatgttggttgagttttttctctccttttaaaaatgtttcatgtatttttctaagtctactacagggcatacaaagaatgccatttgaaatggaattggcatcaataattatgactttctagaagttttccctaactagttccaccatttgaacatgaacatgtaaccttcaaatctcaatcgtaacatttaaattgttattaataggtgacacagcatattacttaaaagtatatactcaatagtattttatgtttcttctcttaacttggttaaaaagttccattcagaaaagtaatctatagttaatttaattgatatgtctttatataaggtctttaaatatatttttaatttctccctcatgtttagagttgggcagaggggagctggtctttcagccaccattgctaggagtgagcatgagatttctgaaattattgatgggctctctgagcaggaggtaagaaaataaatttaattcaagttaattcgttaattattaaagcattttaactctgtaggagctaagggtttttttgtatgtaaatgtgggaacttaattgagtgctagagtttagactgtcaaagatttgagtgtctgttaaagggtttttaaacgaggcagtcacacgatcatactggaattttacaaagatggctttggcagcaaggagacctggagagaggtgaggaggctgttaggataaaaataaggttctgaatcagggcaacagtggtagggatgtataggcgagtgtaatagaaaggtagaatggacaggccaagatggatgggatgtgggagatgagaaagaggaagaatagaatgtgactcccttgtttctaggttagaggagtaagctggtggtgccgtttcctaaagtagcaaaggagcatgtattttacaaatggcagtatgttcttcaaagggtgttgtctagcaagtgaacctgggagagag

SEQ ID NO: 85447 - DNA, 1144 bp, Homo sapiens
atcggttaaagcgtgtgtgttttgtttcgcagattggaaggataacaacaaaatgttcatatggttgcctttgggtaattggtcagattatgaactatttacatgtttgtatttttaattttccatttttttgggacaacaatgacataatgttttaagcaaaataaaagtaactggtcagctactactagtagtaggtgtcaagtagtttataaatatgcatagtcttaatgttaactaaaaaatccagccaacctgtgctctatgtgttgatcttagtaggaaacagagctacctttcctctctcctctttgtgcttttcgttcacagttgagtcataagccaaatgtacttctgacttaaccttaagaagtagcatttattttaaagtattaggtttgtcagaatcagagtttagtttaattattattaatttgctacggatatttaataggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcggtgagtagtttgatgtttaatgactgtgatatttttcttcaaatatttattgtttcttttttttaaaaatttttttagtatgtattgatcattcttgggtgtttctcggagagggggatttggcagggtcataggacaatagtggagggaaggtcagcagataaacatgtgaacaaaggtctctggttttcctaggcagaggaccctgcggccttctgcagtgtttgtgtccctgggtacttgagattagggagtggtgatgactcttaacgagcatgctgccttcaagcatctgtttaagaaagcacatcttgcactgcccttaatccatttaacccttaatggacccagcacatgtttcagagagcacggggttgggggtaaggttatagattaacagcatcccaaggcagaagaatttttcttagtacagaacaaaatggagtctcccatgtccacctccctccacacggacacagtaacaatctgatctccctctactctcgccacatttccc

SEQ ID NO: 85448 - DNA, 4146 bp, Homo sapiens
atgtcctttgtagggacatggatgaagctggaaaccatcattctgagcaaactgtcgcaaggacagaaaaccaaacactgcatgttcccactcatagatgggaattgaacaatgagaacacttggacacagggcggggaacatcacacaccggggcctgtcagggggtggggcatgggggagggatagcattaggagaaatacgtaatgtaagtgatgagttaattggtgcagcaaaccaacacagcacatgtatacatatgtaacaaacctgcacgttgtgcacgtgtaccctagaacttaaagtataatttaaaaaaataagtaaataaaaaaataaaagtttggaggttttggtagggcatgttattgtgtagatccattagtactttacctgtgcttacattaaaattatgtttctttgtctcttcatagacatatgtacaacattttatacataaatatttgatttcttttatagccactgtataaccagccatcagataccaaggtgtaccatgagaacatcaagacgtaagtattgatcatctttggagttcttcaattaaagaccgtatattctataaagagatcatttttgttatctgctgacattattataatatattgtaggtatgttttagatttgtgtaatttgctgtcgttttattatatgttatcttcctctggcttcttgggggttggggtaacagctttgagtttccgaggccaaaaaatgaaataaattattgcataaaactagctggttttataatctgctagtaaaaaaggtggatacttaacattgaaatggcttaccttgaggcttgaattttttgcctcctgttttgtctttttttcagtggagtacctgcaaggcgcatgatgaagtaagataatgaagctttttcatttaagactagtgatgacaccgtcccccaccaagccacatctgccattgcaaagtagaagtgccacggatcattttatcattattcaaaatcctattctagggaaatcccttccatgactcttgctaatgacggtatttgtagacccttctgccatttaatgtcctggtgccttggaagcgctcagtcaccttgtgggtgacgaggctgctccagaatgtagtttgcttagccttgctcatcctagtaccaggcctttatggatgcagattttggaataagaaaataagtgaaaagaaaatctaatttcttgatctgattgaagtaagagaggaagctagatagatatcttttttttaaaaaaaaaattatactttaagagaattttaggtgcattattcttagtttgtgacaaaaatgtgatatttctactttatatgttttattaagtataagcagaacataattatttactagtatggttactaatgagcacattgctatttattttatatatatatatttatttttttctttttaaaaatttcttaactgagagtatgtgcaattattgactactttgcagaactggtggcaaatataatttgcatggtagtatgcatgaaaacaattgaatttgaataattttaacttttgttaagtaagtggttcataataaaagttatgtatttgtcaatttttctgtgagatgctactatgatcttgagaacccttagaagtaagttagtcaaaactcacatataatataccttgctttggaactgcttagctgttttaacatttttaaagagtagaagagcagataagatctagttggctacttaatgacttttttttttttttcccacaaagcctcagtgttatgtttgtgttgtgtcctgtttctcctgatacagtctggagagcagctctgtccgatttatttcatgtcatctacattgcctatttagtgctcagcacactatcctagatggactactgactggctgacttcatttaaattcctaggaaacatttaagattgtatttgttgattgtcatttgcttttgagtaacgtatacttaaaattatagcaaactgagtatatggtaatgcttccctgtacgacaccttttggaatatttcctcagctgcatgcatctgtatgagtcattcagtagctattctttcatcaccgtcatttgctttgtatgaaatagcaaatgtacattttaataattcttttcatctcttggctactttttcatatagccagctcctgcttgtccatacttatttgagtggagccagtgtcactgttagtcctgagtggcagataatccaaaaaattacttctacttgccttggctttgtatttatatttgaataatcagcttgaaatcctttctggaagtaggtggggtataaatatttatacttgaacctgcatgtcattgtttttgaaggtcacaatgcttccaatttaaaaagcgattaagatatattagaaatcttcctgttttgacacattgccctccattacttcttagagtggattgtgtcattctgtgactgaagaaaatcttctgtttaaagcagaagtcacctatctctacatatgttggtatacattttcctcgtagaagggaggttagcacctgatgtagggaggtaactgtaaaaatgtttccttctcttctacctcccttctccaaagagtaagatgtttatgtcaccagagttgttaagaaggataagtaactgtaattttaatttgaaaatatttgccttataattggatgtgctaattgaaagttaactattttgtattaagtcttactgtagaatgggaggaactttagtcagttctaatttttgcaaaagttataaaatcttattttgcagggtaaaaaaattaggattaactttgtttacatcataaattcttaagtgatctttgcctattttccagtgtctctggaaaaaaagtgaatgcattattaaattgtgctttttcttaatgtcatgcaaccatatttttctcttctagaaaccaggtgatgaggaaaaaactcattttattttttaaaagaagaaatcatgcaagaaaacaaagggtgaggtcctatccttgttaactgaaatttatacagctttcccattcatgctcatttaggcattcactttcctactgttaatgagagtggtccttgactccatttgaggataagtgctgatttagaaagtaaccatatatatatatatatatatatatgacttaaatctaattctagtaacattttgataccataccttacatttaatattatcaaattaatttcattggtcatctttctagaacattttcatttagtcaaaataaaacggtgagtagtttaaaagaatatgaaagataatttagtttcttaagcctcaaacagttgtaggtaagttgcagtcatgctgatgagacattactattctttcttttattagaaacggggtcagctagggttcagctttttcaaattcaaatggttttccatatttttttatgacttgcagtccaaaagttttgtggttatataattttcatgggaattaaattatagaaaatataatgccagtgattttattttcataatatgtttatactaattttacagatacactgttaatacatttaaactgaagtgtctgctaaataaatgctactctttaaatcgacatcaaaaatgaactttgtgcctaaagttaatgacctgacagtttgagttgtaaagctcaagagtcagcagctttatttggtggaaaacgtctaatgttctaatttgccagtctgatcagatactgtcttaaattactggtcttgagttgtttttttttttttttttttttttttttgccaagaacatataaatatcaagtaagaaattagctcatgtatttttttttcctttccaagtaattttgttgtaattctggtactcactaaataagttcactggtgatgcaaacactgtaaggtttgtattttcaccgatttgcttaaatatcacttggctgtgtactctgtcccatatattattctgcaaaggtgagcaagatagccatatggttttagtaattagggggagcctaaggtgatggaagtcagacaggtcagtcctagtattggatcacaccgtggtcatggactacggatgactgaggaggacacctaaggcagatagga

SEQ ID NO: 85449 - DNA, 1086 bp, Homo sapiens
ttacctattattcaggcattgctttcaatacaaatgttaagttttgactgaatttggtgaggaaagctatgacaatacaatttcagagttttctatcattgtaactacaaattaagaaaaaataaaaaataactggagcatatttcagcctgtcatatagaagaaggatatttggaaataaggataagttcatctatagattagtcttagataaatatttctaaataattattttgcacttagataatgtaatttttaattatatgatacaacaatgtctttatctctagaaaaaagcagaagaagctcataaaatttttgaaggtcttggcccaaaagttgaactggtaagtaaattttttcatttccagtgatttttttttttaatttttggtggtagtttttcttgggataagatggaatatgatccatttattttgggataagagagatgtagctgagcagagatgtagcttgagatgaagtttaaagtaatgatgagtgaacttggttacctttgcagacctttgcagaaacatcaccctgagcttgtttttgcttgagcagctatttaatccttccaggcagaatgagaattaagaacagaattagaaagctctttgaatgttactgttaaaatagtgacaatggttaatactccctagtattagggagtattaatactttgaaattaaaaatctgtgcataaatatacttatgggaaacaatggatttataaactgtattatgggagtgacaggagatgggattaacagttactcagggaatctaaaagttaggaggttttgccacaatgagataccatctcataccagttagaatggcaatcattaaaaagtcaggaaacaacaggtgctggagaggatgtggagaaataggaatgcttttacactgttggtgggagtgtaaactagttcaaccattgtggaagacagtgtggcaattcctcaaggatctagaactagaaataccatttgacccagcgatcccattactggatatatacccaaatgattataaatcatgctactgtaaagacacatgcacacgtatgtttgttgcggc

SEQ ID NO: 85450 - DNA, 1416 bp, Homo sapiens
cttttcttttcttttttttttcgctttccttcttttcttttcttttttttttcgagacagagttttgcttcgtccccgaggttggagtgctgtggcgcaatctcagctcactgcaacctccacctcccaggttcaagcaattctcctgcctcagcctcccaagtaactgggattacaggtgtgagccaccacagtcagctaatttttgtatttttagtagagatggggttttaccgtgttggccaggctggtcttgaactcctgggctcaagtcatctacccatcttggcctcccaaagtgttgggattacaggcgtcagccactgcaccaggcctcttttcttttattccttcttttctttctaacagacagtgtctcattatgttgcccaggtcttgaactgctggcttcaggcgatcctcctgcctcagtctcccaaagtattgagattacacgtgtgagcccccatgcctggcctcatcttttctttcttatgtatgttttatacatgtacctgtgcagtttcagaattgtaacagggagctcccggaggggaggaggagagcacaatgggcctagaacccaggctttctgatatgtactccccaaggctttttctgccccagtatgctgccttttgaaaggccctccctgcctcttttaacattttttaatgaatgagcttatctgtttcagcaccataggcaaggaggaatggggtaattacagaagtacacctccctcttatttcttgggtggcagcagttacactagttggaattaagccaagtgtggcttaagagatcgagggaccatttcttttatttagaaaggtagtgggaggaaaaaaactgccccaacgtgttaattttaaagttgacttcctgagaaaagttgacttgcatcatagttaaatttcagtctaagtttgtttagtctctaaacagactatttttaacagttcaatttgattttaccctatcagttgtaagttccaaaaatatttgtaaatattctaatttcagaagaataatacgtatagaaaagtgattattgttgggctctactagagaaatttgcagaatatctttgtgggtgtgtgtgtgtgtgtgtgtgtatttttttttttttttttttgagacacagtcttgttctgttgcccaggctggagtgcagtggcacgatcttggctcactgcaacctccacctcccgggttcaagtgattctcccgcctcagcctcccaagtagctgggattataggcacatgccaccatgcctggctaatttttgcatttttagtagagatggggtttcaccatgttagcaggctggtcttgaactcctggactcaagtgatccacctacctaggcctcccaaagtgttgatattacaggcgtgagccaccatgacct

SEQ ID NO: 85451 - DNA, 2817 bp, Homo sapiens
agtgattctcctgcctcagccttcttagtagctgggattacaggcatgcgccaccatgcccagctaattttgtatttttagtagagatggggtttctccatgttagtcaggctggtctcgaactcccgacctcaggtgatccacctgcctaggcctcccaaagtgctgggattacaggcatgagccactgcacccggcccagaattaaaatcttaaaggatgcttcctcttagtttttttttttaaactctatctaatgaaaatttgtgttgtttggttatgaaataaatctgattaattctctttgagctcttggtccatgagaccttcatggattaattggttaccctacagaatctgcaagcaaagcttagtagcctgtgttatctccagtggttaatcactgctgggtgtggtgtgcagcacatgcttgactctttctttctggatctcttagcaacagcttgaagaagaggcagctaaacctcctgagcctgagaagcccgtgtcccctcctcctgtggagcagaaacaccgcagtattgtccaaattatttatgatgagaatcgggtaagctcataccatctctggcagcacaggcctttaaccccacttgacgatgcccttttcagttttgaatgtatcctggtataattttaactttattaaaacctgatttctcttacaattttgaatgttcataaactttggctgactgaagcttggtgtttttttccttatcaattgaaagaaagtttacagttgtgccttaaattatgtaatatttcattttacattatgtattttataaatatttaatcagtgaaattttgtcagctgagtctcctattatatgaattctggcaaggaagcttggtagcatataatacaaaacaaccatcctgcagtttttcacttaataaatgatgtttaatgctgactactgataacatttcagtaaagataggtcattgcatgtggaaatgaactttcttatcagcattagttcacagtcgatagttgggctatggtttgaacttcagttaaaaagttcaaggcggggcatggtggctcatgcccataatcccagtactttgggaggccgaggcgggtagatcacttgaggtcaggagttcgagaccagcctggccaacatggagaaaccctgtctctactaaaaatgcaaaaattagccaggcgtggtggcgcatgcctgtagtcccagctactcgagaggctgaggcaggagaatcggttgaacctgggaggtagaggttgtagtgagccgagattgagccacttcagtccagtctagacaacagaccaaaactcaagtctcaaaaaaaaaaaaaatcaaagttcaaggtagattttgacctttaggtagactttgcttttttaggtttactctcatactcttaattaaaaatattcatggattcagaaacaccaggcatgaattctatgaatcatttttgtagtatcaaagttagttttggccagaatatggcccaggaactagcagttagagggaaactgattttacctcaacatgaagaaagtgtctgtttaacagtgggcttccagaagtccacagtgcaaaaaatgataatatgctttatactgtgggatagaatagggtttttagctaaaggcatgatcatcaggtaaaatttgggattgttgttttgattgatttgatttgtagtgagtggattcatctgtcagtctatcttacacatacagtctgtaactttatagtagtccacagccgaaaggaaattgaccttaaataaagcaattgtgaattaataaatatttatgcacatgtactcctgaatttaaaagttgaataaataaataaataaatacacatttataggaatgatcttggatttagatatacatgtatcaagtagataactgagagtcatcagaaatatacttacggtaatggtaagtgttatgggcaggtaaaaatatgggcaattaatattattttcttggctgggttcaatattagtccaatttattgtatggccacagcagtctacatgaagataaatccagtaaaggaagggaaggaggtgaccatgcctaagatgggggctgtgttccaggatatacagttgctcccttgtttaagaaaagcccaaaataatggggttttatgtgaaatctctgatttgtttttttaaaaaaaaaaagtcctctgcatagctgcaaaacacttttgtgggctcatgggctccatggccagtttgtgactgtgacctcagggataaaataaataggaattagtggtgatacaaatggagatttgatagtttttttttttaagttttataaaatgtttcttttttagtatgaattatttttcaaataaattggatttggtaataattattaatggatttattaatgagccttgtcttacaatattagtgaattctgtggttgcctcactgggatttgaggactgaatactattgaacaagatctgatctaatagagaatttaattggtgtttaatttttatatatagatgtttttattaattagtatagtgtttcttggtgcacattagcaaaacttgaaaactccttttgcacctcttctttctgtttgaacatttccatatttggtttgttgtttattttatgaagaaaaccaaatctgaaacctgtttcagtgttaaacttgccttcctacactgaagattgtttctaacccacaacaactatagaagtcatctttcttttccttttttcttttttctttcatttttcttctccaccctctcctttcttttctcc

SEQ ID NO: 85452 - DNA, 1052 bp, Homo sapiens
agttttggtttggaaagcctaaaaacttttgataggaacacttggccatgttatagttgttaagttgggtggacacacaggttttacctggaataatactatttcccagccagttgttcagaccatttgaagagccgttgcaaggaaatggctgagaagttggtatcttcctttgtcatgattgcattatttacctataaattctctataatttcagtattgttatactagaggctgatcaacactaactcacctcactttgtatagcttttagggtcttcaaaatagtacatggtatatctaaactataaaagtgaggtgagaatttgcatgtatgtgaatatgaaagttactactaaaagtttcattagacaaatagtacacatggctctgctgtggtttaaaactgactttttcatttaaggcaatctggactctattagtgagaaataaattgtttttcttggttttattctctaaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaagtaaatgtctttgcttaatatattctaagaatgtatgtttgtctccctacagtagatatttttgagttttccatattttgaaactttacataaaaggaatcatgccttatatattcggacttgctgtttttttgctactgttgtggttttcttacattcattcattttccttgctgcactgtctgattatatgattgtagagagtgaaatttgtttgtccattctatttttgatttttttttttctattccatacaatggtgctggtttttggttcacatgtagagattttctagggcatgtgcccaggaatggcagtgcttggcccaagattatgtacagtgaactatttaatagatgatactaaatttgctaagaagtaacacca

SEQ ID NO: 85453 - DNA, 1199 bp, Homo sapiens
tttatagatattcttcagcaactaaactttctgcaaatgttctgttttgtctttcacttctagattagtttttaatcctccccccaaaccttttttttttgttttaagacggagtctcacattgttgcccaggctggagtgcagtggcatgatctcagctcactgcaacctccacctcccaggttcaagcaattctcctgcctcagcctcccgagtagctgggattacaggcgcccactgccacgcccagctaattcaaaccttttttaaaaattagactagaagtttaatggtactatagtgaggtatatattctttgggggtgggaacagaaggggtacggattcactttgaatgtaagcatgactttttcatttgttatttcaaagtctaaccagggatgttaccagggagttgtacatcacttacaaattttcaagtgtttattttctttgtatgtattaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggtaaatatttgttctcttaccctgtagagttgtaggtttgtaatgtttatttagttatactcatgcatagcacctcaaagaaagtccagttacaccagtctctaaaggttagtggtatgggaaagtaaaaattttgttaaacaaaactagaaaccacagatgagtgctccagactgctaaagtgagcacttttgccttttcggtaagtgaaaacagtccaagaagactgctcccataaagaagaatttctattaaataatgctcaagcatttttttactggcttgctggctataaaatgtggtcagaggtactcaagactactagttttgttaaatcttaattaaattttaaacaagtcccttaaatttagtagcagtttattaactgctatatgggagaaaacacatccaggtaaggttgaattgtgcatataagttctatacaaaagaaaattgttcctaatttatgtaagtaatacatacttatagaaaactgggaaaataaagaggaaaaaagttacctgtaatcctgtaacttgga

SEQ ID NO: 85454 - DNA, 1020 bp, Homo sapiens
ttacagatgcctgcctccatgactggctaattttatatttttggtagaggtggggtttcaccatgttggccaggctagtctcgaactcctgacctcaggtgatccgcccgcctcagcctcccaaaatgctgggattacaggcgtgagccactgtgcctggcggaacatgagttttttaaaaagaaaattaaaaaaaagcagtatcgaagaaagtaagttagtgaaatcctaggatttctcatgaatattctttgattggagaaaatttcaattggtggtggtgaatggtttgcttgagaattcccattatgccatcctggtttctcaacagctgcagaaaggacagttgggatgtgccattctgtaaagtgatgagccagaaccctctggagtggtctacatgtctggctggtagagggggccagagtccttagcagaggcagttacagccctaaccaagatttttcttcctttgccccacttacatgttccctcgggccatagaacagtatttagaaagccatacctattcttccatttgcagagaagatgactacatgccagaaaaagtgggaacaatcaaggagaacccacccagactatcccacgccaaagagaaaggctgccacaatgtacctgagcaggagggtggggaatggcacaaatgaggcgaatatattcctggaaaagaaaattaaagcaacatagtatgccaaaaataaaatcgccacgtgtaagaaacataaagagcatgcctcgtaagtgctatgcactataaaagaacttaataatataaataagttctatatttctatatttcttctataaaagaacttaaataatgaagtattcaaaaacaaaatgataagacagccagatgggctaaatgtagttcagacatttgagtgccctgaagatataaaattagaaagaaaaggaataaagtagatgtggcttaaggtaaaccttgtcttagaacaaagtcttgatataattagagtgagtgcagaagaaaaggac

SEQ ID NO: 85455 - DNA, 1047 bp, Homo sapiens
acctaccatctgtgattacaaaacttagtattttatcatccttgcttcagaattatttaataaagacaatacttccctctgcacaaatgcttaccttaaaactactcttgaattcttttcgcaattgacttatcaactcccaaatttaaaaccatgtatttttgtctttatatttctcagacatttatagaaagatatttactgagcagttattatgtgccagatcttatgctgtttttatatactgtttttactttatataactaattatattatttgtcacatattaacctattttaagtataaaaagaaatgatgcattaatgttttcaaaccttggtaacttttattaagtaaatacatgagaggaagcttttactggtaattgtggttttatttatgtagctatagttataatttattagaagtacacttggtgttttagttcttactaattctgtttttttctcatcctgtttaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggtaaggaacagatagtatgcaaattgcacatgttttttgtgtttttctttacttttcctatttaatacacatgtgggacagaaaccaccaaatttatcttttttttttttaagttgcaagagctatttacaaagacaaggaaccaaagattgggaattaattatttctgtcttactgtggctttatgctgatttcaggagttgaacttgtctttgcttttcatgataggagttgatgataaatagaaaacttaccaattctctagaatttctggggtaagacctatatttatactcccaagttgtggctgagttttaagctggccagataacttggcatgtcttgggtgagggccaagataaagacctctctctttttaagaaattga

SEQ ID NO: 85456 - DNA, 1050 bp, Homo sapiens
atttgatactgccacttaaggtgctcccttccccttcagtctgaactttaaactagattcttttatttcagtgggtttcaaatgtaaagtattctgccgaggtatcttagtgagccaggactagagtgaagggtggagggaaggatgggaaagggcagggggagactgaaaagatgaatcctaggtctcccattcttactagatcggaatgtttctccattgtatcttttgtacatttagctttcatttaagacttttgaggaaaacattctggttaaaaaacaaaatctgagcactgttgccgtgtatctcatggataagttttgaggaaggaggttgtcgtggtctccaggctgcagttcatgcgaggacaggaagggcttgctttgacctgtaaatttgtatgctagtaggggctaatttcctgattttgctagtgtgtgtgtgtgtgtgtgtgtgtgtgtttttttttttttccttctgtattgggcggatagtacttttaaagaaaactgactttttttttttttgagataataaagttaaacttcactaaagtcataccacaaaacggacaaggaaggattactgagatgagggaaaaaatggacaagtcacttaacttgtgactttgagtgacattgagtgtaattgttgaactcaggactcaccatagctgaaagttaaacaatgtgcattaaaaaattgtacctcatgggtttctaatcatttaggccactgttagaaaaaaattggatgaccctgggttaaaatctttttttttgcctcttcattccatttatagctttatttatttgggatatctgagttgggaggagagtgcagagatagataacttaaagcatgttttaggacagcagatcagaattagttggaaaacttttacaaaatgcatgaatgttcatatagtgaaatactcttttttttttttttttgacagagtttcactcttgttgcccaggctggagtgcaatggcacgatctcggctcaccgcaacctctgcctcttgggttcaagcgattctcctg

SEQ ID NO: 85457 - DNA, 1061 bp, Homo sapiens
ttccacctcagcctcccaagtcgctgggactacaggcacaggccaccacgcctggttaatttttttttttgtttgtagagaaagggtttgaccatgttgtctaggctggtctcgagctcctgggctcaagcgatctgcctgtctcagcctcccaaagtgctaggatgataggggtgagccactgcacccggccttaaaagcattaaaaaaaattgtgttatgaattggtgaaattttcttttcttacctttgttatctgctgtagaaggcaaaggcctttggatagactgggggttgatgtaggtgagtgtcaggctgtttgttttttaaaaaatatgttttggttatttggttttaattgtattctgtgatctatcttagttgtaatttcaaattcttcttgatgcctgggaatgatggaactcttgcatatttagttccatctgttcttttacttaagatactggattttactagactatgatataaaacaactagtaaagattgatcagaatttattgtgtatagtcttatttgtagattagagattcatatatttttgtttactcacttatattcaaccagtatgaggtgctttttatgttctggcacactactaaatactagaaagttataaaatatagtcgagcagatcagttatattcacaaataactcagtctatagattatcttttttttttctttttttttcctttgagacagggtctcgctcttgtcacccaggctggagggcagtggcgtgatctcaggctcactgcaacttcagcttcccaggttcaagtgattctcctgcctcagcctcctgagtagctgggattacaggcatgcgccaccatgcctggctaatttttgtatttttagtagagacgtgttggtcaggctggtcttgaactcctgacctcatgatctacccgccttggcctcccaaagtgctgggattacaggtgtgagccactgtgcccggccctatagattatcttatatttggtccttttcaggtttgaggatgcaaaaaatacatgtatacatgtaaatggtta

SEQ ID NO: 85458 - DNA, 1064 bp, Homo sapiens
ctacaaagattcattcattcgttcaatatatcttgatcaatagctgctgatgctgggtcacatgtgattgtcctgtggataactgaagagttgatggcatcgtttaatttttaatagctttttaaaatgttttgatgtaccttttcatgaagatatttattggatgaaccaacttgtacttgcccgggctcaggagcagaccaattttagaatgttatttagacaagggtaacaattacagaagaagtaaccgcaagttactggagagagaaatcttgtatctttttttctttttctgttaacatccggtggaagtttatttatttgttttaatatttatagtacccagttgcttggccttgctttaagcacacctgttaatggaaatcaagattaattgtatatatggatatagctatgtataaaatgctcacagtaggaactgattacttacaatactaaaatactctttccttttacaaaaggcttgccatatgttgaactactcccccggagaaaatataatacaaagtatcttgattcttgctctaactatgtgattttggaacttgatcaacctttctgtgcttcagtttcctcatcttgaatattaggtaaacatctactctcctagggttggctgttgtgagcctaaagggagttaatagttataaaattgttttaaacagattgaaggggttatatttctgtgaggtggtaacagctccctctgggctcctgtaatgctttttctgcacatctctcgcggcatttacactttctatcttgtaggtatttatgtacctattttatctcttgagagcaggataggcccttcgctgattttatcttttttttttttttttttttgagacagtcttgctctgtcacccaggctggagtgcagtggcgcaatctcagctcattgcaacctccgcctccgggttcaagcaattcttctgcctcagcctcccgagtagctgggactacaggcgcgtgccaccatgcctggctaatttttttgtactttgagtagagacggggtttcaccgtgttagccagga

SEQ ID NO: 85459 - DNA, 1040 bp, Homo sapiens
ttggaaggaaagattggagtcaggaaaatcaattcagcccagcctttcttctctagactgcactgccagctctcatatatcagatttccatgtaattctggtctatacactttagtcatctcaacaaccctgtcttaattactgtagcttataaaagctacactaggccagaagtgttggttcacgcctgtaatcccagcactttgggagacagagacgggtggatcactagttcaagagagcaggaccatcttggccaacgtggtgaaaccctgtctctactaaaaatacaaaaattagctgggcatggtgatgtgcgcctgtagtcccagctactcaggaggctgaggcaggagaatcacttgaacctgggaggcggaggttgcagtgagccaagattgcgccactgcactccagcctcttgctcttgcgacagagcaagactccgtctcagggggaaaagaaagctacactatattatagaagcgctattatctgatatgaatagtcttctgattgttcttcagggtatgtttgctgtttttgaccctttttccaaataccttttttatgggggaagacagagcctcactgttgcacaatcttggctcactgtagcctccgcctcctggattcaagtgatccccctgcttcagcctcccgagtagctgggactacaggcatgcaccaccacgcccagctaatttttgtatttttagtagagacgggattttgccatgttggccaggctggtctccaactcttgacctcaggtgatccaatccttcttggcctcccaaagtgctgggattacaggatgagccaccatgcccagcccccaaatacattttagaattagcttggtgatgttcaaggaaaaatcttgctgacattttttcccccttgtgacagagtctcactctgacgtccaggctggagtgcagtggcgcagtctcggctcactgcaacctccacctcccaggttcaagcgattctcctgcctcagcctcccaaatagctgggactacgggcatgtgcca

SEQ ID NO: 85460 - DNA, 1050 bp, Homo sapiens
ttttcctgtaatactcaggagtagcaacctctattttctttttctataccaacaagaatgagcttggaaagcttcatccttaaatcaatgttaaacaggatttgaggactgtcaatgaagagggggccccagttgttctgagtggtcgtacatggtgtgatcctaaatctgcttaacttcaaagttagtacccttggctgtgtaccatgctgcctctagcatgtgactgaaatgcagacagacagataggtatatagatacaaagatgggaaagaattgtgaatggtgattctaaagattgtgctactggtagtcttctcacaggagtatcttggtgtcgtgttttcttaaactttgtatcataatcacacattttcaggcagcttaaatcctttaaggaacaaaaacaggataagaatgagtgaatagataggtctccactgttaaaaaaaaaaaatctaccactgtatatttgttaccctcaggaaattactacaatcaaggagagactcgtaagaaagaacttttgcagagctgtgatgttttggggattccactctccagtgtaatgattattgacaacaggtaatatatcttttaacaatgtagaaatttattggcaataaatatgcagtgatatactcaaaagacacacaaaaaactaatgtgagtggctgagaacatcttgtatgaaaagtctagggctcggtgccatggttcacgcttgtaatcccagtactttgggaggccgaggtgggcggtctcaggagtttgagaccagcctggccaacatggtaaaaccgcatctctactaaaaatacaaaaattagctgggcattgtggtccagctactaaagaggctgaggcaggagaatcacttgaacccaggagttggaggttgcagtgagctgagatcaagccattgcactccatcctgggcgacagtgagacttcatctcaaaaaagaaaagaaaagtctacataaaataacttcacagcggggcacagtggcttacgcctgtaatcccagcactttgggaggccgaggtg

SEQ ID NO: 85461 - DNA, 1065 bp, Homo sapiens
atgaatgtgtgtgtggtctctaagaactcgaatgatgcctaagctatccaacccactttcctcagtttttatttacgcagaaattgaaattaacaaactaatttctgagtcttaagtgaaattgttttcgttttatttaaagttacccttgacttacatagttttaaccttctggaaagttcttcttttttctctctctcttcctgttcctgattgccacactggatagaaagttctaaatgaatacttaggtttgaaagtatttttctacatctatttattttgccattctacagatttggctccattgtcctaaggtttcagcacaataaaaatctcgtttctcccagtgcttgtcttgacatcaatgtagcattaaaaagtccaagacttttacagactaatttaagctgaacaaggaaatataatctggtacctactaagaaacataaatgggcctgggttgctagcagttcctggaagtcactgtgttttccaataaatccatgcaaatcgtaacagggaaagagaagccacaaagcagaggctgggactgttgggatcatgttagtaattaaactctctctcctcttgagactcagtgagagccttccccttacaaaaaaacaaaaaagaccatagcttgctgccaaagcggatctgaccacgcgtcctctcactctaagagattaaaataaagcctcctgcagtccttttctccaaatacacaaagaagtggctgggctgaggctcaagggcacagttccagtccctgttggcaagagaagggcagggctctggttctcccaaagggtgcaaaggacaagaatgtttcctagaaaagaaaccagggaaggagaccaaagtagacctagctgatatggagctgttatgtgaaaactgaaagctgcttcgatactacttcaaagccagattattctgggaactgaagggagactgagccttcaagtaatatgactagggaagtcaagtacaaaaaaaaaagtgagaccaggaaggaacaaagcatgcatttggagctaataccactcattggaagaggtt

SEQ ID NO: 85462 - DNA, 1040 bp, Homo sapiens
gggctcctaagctgcttagaaatgaggtccttatcacagcagatacttaataaaagtgcactgatctttatatacctcttttttcagtcctttttctttttctcagatcgccttttccttctcttacttatcttttcccctatttcttttctctgcgtatggcttaggttagtccttggcggtgcagagacaccccccagaagttgttggaccctgctgcaacctccctgcagcttagacttcatttcttcacactcctgtatttggagcagcgacgctagtgccaggccctcagaccaggagacagttgctgcctcccacagtggcccttggggggcgatattggcagtcccaggttaggcttccacgtccttggctagccttaaggttagctctgaactctactgacctttgctcgctttggatgacaaaggaaatgatcgagtttagagatgggccagaggtgggtggaggggtggctgaaccttccggcttgcgctgtacaagccacaagaccaaataagggcgtgtgagccgcctccgtctgtattaaagttcagagtgcagtgtgcaaaagtgggactcggttttcagagataagctgttacccaaccctgcttgagttccagcagcggaggctgcgaagtctcctgctctgagcagggctgggtctgggggagaaagacctgggcccctgggcttgcttagctggggagaggaaagaaggggggcttccctcaccagcacctggtgactgaacggacccacaaccccacagattttcacaaagggtttccatgactctcccgactaaaatgtgccggccagtgtgactcattagaatgtgtaggaaaggtcactgtttgaggatattcagccagtgggggaaaaaaccacaacgttattttaatgaacgcttttagcctggcttgtttcctgaacattaaggtctagggcgggacttcgagtttggggccttttccagaggtattaacactgtgtttgctaaatacaccccagggaaggagtcgtcgggcttc

SEQ ID NO: 85463 - DNA, 1066 bp, Homo sapiens
ctatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgagccacagggtagagggaggatgctcaggggaaaatctggctggaggcctcaaggcttatcacttcaccctgtctcctctccatccagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaaggtgaggattgtaaattcctggacaccccaactcagatccctgccccagacccctgtctcctcaaagccccacctctgcagaagccctaactgaaggtttttcacagtggttcagcacctgtccctgagaattagggctaggccagctagatcttgggaggcatagatttttcaatgactttagccttttttttctaattataaaaataatatatgctttttctaaaagtaaataacacatgctcattgcagaaaatcttgaaaaacataaaagcatcaaaaagaaaataaaaataagaacaattacctgcagtcccaccaatcacaggtaatccttgttaacatgttgggctacatctttctactctttttttttttttgagacggagttttgctcttgtcacccaagctggagtgcagtggtgcaatctcggctcactgcaacctccgcctc

SEQ ID NO: 85464 - DNA, 1122 bp, Homo sapiens
ctgggcaacaagagctaaactccatctgaaaaaaaaggaaagaaagttatctatctaaacacaggaaaggcctgtgaattcttcaggctgccagtcagagattgctctgggctgtgcctttctgcatgttgtactctcaacttggtattgaatgttgtctagccttggccaaacctggctcagggagtgtgattcccatctggcagttgaggaaagtgagtcagagggctgaagcggtaggctggagccagtgctttccgagccagctggcagcctgtgggtctcatcactgaagccataagctgtggcatatcctttggaagccctaatgtgtagcgtgatgatgcctgcaggtgggggcttatccaggagccggtacaccatctggtctcacccatactgaggatccccctttgtctgtgccactttctcgtaggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcatttcttttgtactgtgatttgcttctgaggccagtcgattaatagcagatatatactcagcactatcaagatgtttgccaccaggcattgtggcttaagcctgtagttccagctactccggagggttgatcgagcccaggaggttgtggctgcagtgagctgtgttcgtgctactgcactccagcctgggtggcagaatgagactgtctcaaaaaaaaaataagaaaaaagaaaaaaatgtgtagctaaattggaaagaag

SEQ ID NO: 85465 - DNA, 1048 bp, Homo sapiens
tgaaaaagttctaatttagcacagaatcctctcacaagttattccacagtgcttcttttccaatctggactctattgttagtagcctggtcagttctccatttgagtaattccatcgtatgtgcttattattcatatataattccggtacctaggggcaaaaaggactggatgctgttaaataattagctgcatgccaactttgggtcccaaagccagagcctgtcgtccctgctccatcataacgccggggaaggtggtacaaatcaggccctccacagccagcagtgccatctgcctcaaccgaagagcagagcgagagtggagggcctggggagcctccaggtgtatacaccctttactaacataccctccaactctccccaactctagacttctatgaagattctgcccaaggctttccactcagtacccagccaggcacacctgcagctaaccgcccccggctcctcagcagtgtcagtctgagggtgatgctgccacaagccacaagccctgaggaccctgctctgtgtcacctgggccatgctgttgaagctctgtgatgagccatataaaaggaacaaaaatagaacaatgaacctttctgtccccatcacctgacttcaacagttaccagcccaaggccaatgtttcctctgtaccccaactccccagattattttgaaatattgcattttaactctgaaattcttttaagccaatttagggaaaaaaaaatactcacttgcagtcaaatatatgcaagtctgctgaggcccaaacttcaaaacgaactgctccacagtggcagcctcctgtgtgcttcaccaggccctggtattcactaaatgaaacaaaaatcagaaagataataatttctgaatagctgcctcctgctctctttttgttgctgaaagaaagacagaagattagacaaaagtcttttctacatgacaaccagatgcatttctgcttttaaggaggcactgtcaatttcctaagtgaagaatggtttcagcaccttctttgtccatgagctctctttt

SEQ ID NO: 85466 - DNA, 2758 bp, Homo sapiens
cgagtggattctgggtatcgcgagcgtaggcccaggcgcagcccctctgcctgcgggactgaacaggcaggtgcgtcccagcggccgggcgggccgggtctccctcctgcgggcaggcgccgcgctgcggggcgcggctggcggagcggggcagccgggcgcagcgccccctgggcctgaagactggcgggcggcgggggcgcgcgcaggccggcgggggcgcgccgcgctgcgaggcctgcgcgccaggctgcgggagccatgcggcgatcgaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacaccttgtgagtgcggcgggccggggggcgcgggagccgttgccacgcggaccccctcggcaggagtcgggctcgcagcccgcgtgcaggccttgggcgcctttcagctctgagccttccacgttacggagccgacgcggctcccccgttagcactggggttattccttaattctaagggcggcggggcggggcggtgcttctagggctgtgtggcctgggaatggaaagggggcttcgtccggagcttgagggcgcgcgcagccgtcttgggacacaaagagtctttcccggccataagcatcgtgctcggggacgttgtctcttgctggcgcgcaaagggtgtgggggcctttcttagtgaaaagaacataaatcccacggctttctcttacccgaatcccctttttttttgtgtttgcacacgtgtttttgagggtgggtggaagggaaaggtagaagcgttgaaggaagcatgaatagttttgaactcactgggaagcaaaatcccgtcattgttccaggcactgccagggagggagcagggggcggaggttattgatccgggagagaagcgcgcgcgaagagatgctccggcctcgcgcggcggcggggatacctacgtagggaggcttttatgtgctcagccagctaatgctccctgccgctcgccctcctggctgctccgcagtcttttagatggcccgaggagcatctcgagtgtccgcgatttgggaaagagcttttaactgggctgttaaagggctgccttcttttctccaaatgcgatctggattcctgcctcggggaacagttgtgctacagagagatattttaacgccctgatattatatttcagtgtcaattttacgaattaaaaagaacaatcaaaacactagggggaaaaaaccgacaagaataacctagcaattgcataacctgagaattacttcttttcttgaacatgttcctttgagcttcttgcggaagaaattctcttaggatgagtcgtccccgacagaagatacatatttggttttctgtgtgcttcactttttggtttttcatcttggactgcacactgaatttttaaaaaacgttcatccatcaaacatttgagcacctatagggtgacggctgcctctgggcagaaggaatacgaagatccttaggaatgtaaaactcatggtgtcttcaaggcatacagaaaaaaagaagaatgtaaaactcaaatttgagataaatttttattttaagacaaactgataaatggtcaagaaaaagttttaaaatattgacataaaaaagctgtttttctcccactagattgccatgactttgtacttataaagtctactaaattatattcaaaaagtgtgtataactgtaccattttcgttaaaatattgtgtagaaaaaagtttgggggaatatataacaaataattaactgtagatccctctgggtgtaaagattacaggaggctttcactttgagcactctcaaatagtgtgaagtttggagtttttacaataagcattatgtgtgcagaaaaaattaaaatacataaacgtaaagaaacatgaaaaaatgatcagtcttaatcatgcaaattaaaactgcagtgagctatttttcctataattattgcctgagactgtacagtgaaatgttttctcatttatttatcgggtaagggtgttcaatccttttggaaagcgattttaagacatttatcagatcttaatgttcatttctgagtttggcttatatataagctttaaagggttaaaattgtatgtaggctgggtgaggtggctcatgcctgtaatcccagcactttgggaggccgaggcgggtggatcacctgaggtggggagtttgagactgcctgaccaacatggagaaaccccgtctctactaaaaatacaaaattagctgggtgtggtggtgggcgcctgtaatcccagctactcgggaggctgaggcaggagaatcatttgaaccctggaggtggaggttgcggtgggctgaaatcgcgtcactgcactccagcctgggcaacaagaatgaaactccctctcaaaaaaaaaa

SEQ ID NO: 85467 - DNA, 1045 bp, Homo sapiens
ccacaggctaggggcctccctcccttcgtgaagcccccagaggccctgaggcacacaaaggtagtattcgatgccttcagagctgaatcagactgaaaatatagacagaccctgaaaggctttgaaaacggaagaggaacgtcatggtagacgcatggtgtcagatccggctctgccaacaactggcgaccttgggaaagccactccccctttctaagccttagtagtcttggcagcaaaatgaagggtttgatagtctagtggttttcccagttatttcttcttagagctccccttctttggcgaggggttgagtgactggccccatcccagtcatcgcacttttatctgttggaatattggctgccaggcaagacgttgtgtaaagaaagggttgtgctgttaatgtaaatggtaacaggggttgtgacccctcagattccaggaagtcccagaggaaaagtcggggacagtcatggctcttcctgggggacaacatcaaaagggtggccctattggttccctgttcctcaccccacaggcctccctccctctcctcacccctgctgctcatccctcctggcccacttcccctgcattggggctgggctcccacacagtgggtggacctacttgcacttggcatttttgccattagaagtaatgagaagtaatggcaaaaaccgcaattttttttttttttttttttgagacagagtcttgctctgttgcccaggctggagtgcagtggtgccatcttagcttccgggtttaagcaattctcctgcctcaccctccctagtagctgggattacaggcacaagccaccatgcccagctaatttttgtattttttttagtggagatggggtttcaccatgttggtcaggctggtctctaacagctgaccagccagcctcagcctcccaaagtgctgggattacacccagccaccacgcccagccttttgcactaacctaatacctccttttgcaggctccagtcaggccaacaccgacgcgcagctgggaggaagacaggaccct

SEQ ID NO: 85468 - DNA, 3781 bp, Homo sapiens
gagggggagtcctgggtagcgcgccggtctaaatcgttacttggcggaaagttcccatgagtctttgccagcgtccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggtaagccttgctctatggggaggctagtggctgaccacgcctagctgtcaggtcgaatattggcaattggatttggttaacctaataccttgtaacagtgtagcctatcccagagatactgattttagtttccggtggcagtggagccagggtggattacctagaaagaggggctactctatttacctcttggctgtttagtctcgggcaaattacctgtctgctgagatgtagttttcctcagatgtgaaaaggaaaagtaatcttagctttgtgaagtttaaattgatatgactgaaatggagattacaactcccctgaggctgggcacagtggcctgtaatcccagcactttgggaggctaaggtgggtggatcacctgaggtcaggagttcaagaccagcctggctggccgacatggtgaaaccccatctctaccaaaaatacaaaaattagccgggtgtggtggcgtgtacttgtaatcccagctactttgggggctgagccaggagaatcgcttgaacccgggaggcggaggttgtagtgagtcgaaatcgtgccactgcactccagcctgggcaacagcgagactccatctcaaaaaaaaaaaaaaaattacaacctactgagaagctaattaagatttgtagtcctcaataatttacaaaaacttagaaaaattacctctaattaggtcttaaggggcttttgttaggatggacttaaatttgtaaagtcattaattgactgtcatcagaaatgcctgtcctgctctgcatctgcagtctctaaggtgtatgcgccttctccattcccccaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaatactacaataaaggatggtcttgggtgtcaattcttgaaaatgtgtatttgaagaaaaagtaaatttcgcctactgttgtcagatattagcagtccagatattcgctctagcttgtaaacttccctgtggtcagcctaagctcttaaccccctattctacagctttagactgaaggcaaaagctcaaagcatttaaggcctcctcaatttcggcccctgctgctctgtgctctgttccttggtgtagctttgttccagctcctgcagcattgcaccattcctaaccacaaccttaacagcatgtagggccccatactctaggccccatcttgctgtcttcctgtgttggaatcttgcctaccaaggcctgtcaagagggtcctcccccatactgtttgcccacaaggttcaagagtgattggctcccagtcttcctggactgaactacttggatctaggggttgcctgttatttagaagagatcccttaactggtagggccctttcagtaggacagtatttgggtaaggggagggtataagatgagaacctttgctaagttaggttcctttgggagcctccagtttgtttctccctctccccagccatcttgttggatctgccaagggattggactccttcattgtcctaggtttttaaggttttaaagcccaccttctgcagtcggttt

SEQ ID NO: 85469 - DNA, 1318 bp, Homo sapiens
ttacagtacctccagccatgtgcccatttccacaagtctttggggaaggccatgagctgagctgagagggttctctggggcctgggatgacttaagaaccaaatggcagataatgggatagggggcagatgcagaggaccaacgggaagttttaacacaaatccccttccccagatgatatggtttgcctttctgtaggtgggtggcccaggccaatttttggcaatatccttaacccacctgataggagaagcgccctcccctgcctgccttgcccattctacccaacaaggactccctggtgaggcccttcacttccatgtcacgtctgagctgcagctacagtctccttgccctcatggtggtcttcggcaggtgccacagggccccctccagggtcctcctggcctactgtcccttcccggacctcctccccactgcctgggccctcacccagctccaggatggtgggtaggtggccctgctttggggagcgcttgcgcaggctgagcaggaagggctggggcaaggagaagatgtccacgttgttgcccaggtcaatccacgtgacattggggaacttgctgggatccttaaggatgtcagtgaggtcgcgcagcacggcccgggtcaaccggttgccattgagtgccagtgtggtgaggcggggcagggtgctgagtgctggcagcagctgcaggaccatgtcgtccgtgaggcctgtgaagcccagctccacgctgtctacctgctccccacagcgctgtaggtagctggtcacccgctccaggtctcgggaggtcagtgggattcccgacaggtccactgtgttgtctggggggcttccggccaggacagccttgaggctgaagggaaaaaggacaaacaaggctcaggcacatagggcaggcctttcccccagaagctgcagtgccagcctctgctcggctctccgacgctagggactgcttttacgaaacacttggatgtcggatgccacaagtgcagaggtgggagcaaccagggacctcagtcccctgacactgccgcacgtctcagctgtcagggcccagctggccgtagcctgaggtatgtggctgcccctatttaccagaaaaattgagttaagagtaccattgggctgatatatggaagaagttcataagtgcaaaatggtgccttgtatagtaggcgagtgaggaataaacatttgctgctgtattcatcacctggactcagcttcccacttctaccaccctggggtggcagctcagcccccatgaatggcacaaaggatctctgagtcccctctttcaag

SEQ ID NO: 85470 - DNA, 1046 bp, Homo sapiens
ggtggtgaacagcctgagctgggtttgaattcagccccaccacttaccagttgggtgatcctaaccagtcaattgacaacagtgatatctcctccctaatttgttcctttttgtttcttggagatggagtctcactctgttgcccaggctggagtgcagtggcatgatcttggctcactgcaacttccgcctcccaggttcaagtgattctcctgcctcagccttctgagtagctgggattacaggcgtgcaacatcatgcccagctaatttttttatttttagtagagacagggtttcactatgttagccaggctggtcttgaacttcctacttcaggtgatccgcccatctgggcctcccaaagtgctgggattacaggcgtgagccaccgtgcccagcccatttgttcttttaacaaacatttgttaaactcatctgtgtgccaggcagtatcctagacactagggtcacagtggtgaacaggatggacaaaatccctgttcttcctctactagggggagacagaccacaaacaaaaccctgagtgtggggcgatactgtagcgtggggctgtggctactcaggagaaggtagcgtgtggactgacacatgaaaaagtaagcatgggccatcaaaagagtttggtgaaagttccagcagagggcacaaaggccctgaggctggaaagggactggtgtgtctgtgaaccagcaggaaggccagtgtggctggggcgggagagcaggagaggtgagacgagggggcgaggagagcaaatcagaggcccatgcttggatttcattcaggtgccatgagattccacccgaggggaatgagacctcatgacatggcttccgaatgaagaatggactgagcatgggtgtgtgtggggaaccaggagaggcccttaggttccagcagagctcaaactaccagctttccattgctaaagaaccagctcagtctcatggcattccaggttccaagggccccccgtcttgctgtatccccatatatgtcccctctacccaggtagagcccctc

SEQ ID NO: 85471 - DNA, 1003 bp, Homo sapiens
aaaccaaaccaaacaacaacaaaataacactgatgcctgggccaccccaatgatgggtgggtggctcaggcacagggatttttttttttttctttttgtttgagatggagtctcactctgttgcccaggctggagtgcagtggcgcggtcttggctcactgcaacctccatctcccaggttcaaacgattctcctgcttcagcctcccaagtagctgattacagacgcctgccaccacaccccgctaattttttgtatcttaatagagatggggtttcaccatgttggccagcctggtctcgaactcctgacctcgtgatctgcccgcctcagcctcctaaagtgctgggattacaggtgtgagccaccctgcctggccacacggggatttttaaaaggtccccaggtgattccctagtgcagctgaggtggagaagcactggttcaaagaccatgggtgggatcaggtggtctgcccagcatcactcctggaaccaccccaggacagaatgtagccagtctccaaagcttagaactgagcccctcagctgcagctcctccttcaatcacttcccagggtttccaaaatctggggccaaaatccctgtccaccctctcagcctgggcagctgagccttaaaagaagagaatagaggccgggcgcggtagttcacgcctgtaatcccagcactttgggaggccgaggcaggcggatcacaaggtcaggagttcgacaccagcctgtccaatatggtgaaaccccatctctactaaaaatacaaaaattagccaggcgtagtcgtgggtgcctgtagtcccagctacttgggaggctgtggcaggagaatcgcttgaacccgggaggtggaggttgcagtgagccgagatcgcgccactgaactctggcctgggcgccagagtgggactggtgtgggactcctaaacacacacacacacgcacacacgcacacacgcacacgcacacacgcacacgcacacacac

SEQ ID NO: 85472 - DNA, 1061 bp, Homo sapiens
gcagatactttgggctccccagtccctgtagggctgagtgtgattccacatcctggggacactgagcttctccctgccttgagggagagtagataagcccctgcagccccactgtgggatccttgaaacaagaagcatttcctcagacatctgcacatgggtcttattggtgtcctggtacccgcctcagctgcaggactgggagggctgatgggggggtgggagggggcttatcagacttcccccttttctgtgaaagcagcaggtcctcaggctctgggcttctgggctcctgttgggctcccttaacccctggctggggatgcaagggccgtgggcctggagctgccctgtgtggcctggaacggatggagcaggacccctcccgaaagtggtcatgggccttgagcagtgtgggagtggagcacaggagtgttcacttgcctatgacagagaggtggctttctaggaccctgaggccatttggaggaatgtccagctggatttgtgctgtgcactgaagtggctctttctccaaaattgcattttcctttccattccagtttccttctctagtctggtggtggtgatgttcagaaagggaatgagcagctagtgagagccttgagaacacacaagcctcacaggggtcagaccagcaagaacctcttcctcagcaagacagccagtaaagacaggggtctgcaaagcgtggggcaccctgttctgcaggaatgtcatgcaggcctctggggtgggagtcaatgagcaggcacagaaccagggaggggcagcagcgaggacagtagccctcacctccattcacacagcatgttctcctgcatttgataacttgggtttggctgctggatttgtgtatgcccagagccatatggctggtggggactcgggagcctttgttcctgtgcttcttagcctctttgagtccttgatctttttgaggctctgaaaaagctacacacaatcttcccaggcaaatgcactgactcacgcaatctcacaggcaatttcggagggttcacaaagcccctgaaacccag

SEQ ID NO: 85473 - DNA, 1051 bp, Homo sapiens
acaatcatatctgcaatgtccctcttgccatgtagggtaacatattcagaggtttgagggatacggttgtgagtctgcttggggagaggggcattgttctgcctaccacggttgtgctcttgccttttttcatgggtcagtataagagaagcctcctaatagaaaataaaaagtgttagccaggatgtggagaaattagagcccttgtgccctgctggtgggaatgtaaaatggcgtggcagctgtggaaaacaatatggtggtgcctcaaaaaattcaagatggaatttccatgtgatccagcaattccacctctgggtatatacccaaaggagatgaaagcagggactcagtcagatacttgtgaccccatgttcacagcagcattcttcacaatagccaaaaggaggaagcaacccaagtgtctatcaatagatgatggataaacaaatgtggaatatacagacagtggaatgttatccagccttgaaaagaaggaaatcctgacaaatgctacaacatggctaaaccttgaggacgttatgctaaatgaaataagcgagacacaaaagaagagctattgtaagattctacttatatgagatacctagagtagttaatttcatagagacagaaagtagaatggtgggcctagtgcagtggctcatgcctataatctcagcactttgaaaggccaaggcaggaggattgcttgaggctgagagtttgaggccagcctgggcagcatagtgagaacctctctctacaaaaaattaaattaaactgaaaaaaaatgtagaatggtggttgccagaggctaggataagagaatagggagttactgtttaatgggtagagtttttgtttcctaagaaggaggtggagttctgtagatagatggagagtctgggttttctaaaatggggagagttctgtagacagatgatggtgatggttgcataataatgtgaatgtggctgggcgcggtggctcacgcctgtaatcccagcactttgggaggctgaggcaggtggatcacctgaggtcagga

SEQ ID NO: 85474 - DNA, 1124 bp, Homo sapiens
caataaactcttattagtgaataagcattctccagatcctgtgtcaggcactggggctcccaagaagaataagacactgtccctgtcctcagagctcatggtttcagagggacaaggcacacagttgagcaatgtatgcaacagagtgctctagagtattctgggtaataaaagcctacaggtgacttgaggaatataggggagggagtggctggttcttctggcaggctacagtgcgagtcaggaagcctttctggaaaatgtaacatgtgacctgatttctgaagcctgaacaagtagtcaccaagcttcgggggttagggagggagaagtttgagcaatgcaggggcctgacatgtcgtggtgtgttcatggctctgcacttggttctttggggctcgaggtgacagaggaagcctgggccagcagcggatagggtagagaaggaagcagaggccagactacagagagtcagtctctggctgggtgaggtgctggacactccctgtaggccatgggaatggcctataggacagattctgagcaggagggtgacaggatcgccttgaagttagaaccatcactcggcaatgcaagattacttatccgatttattcattcttgcttccagactatgtagaaactggcaaaaagcctaaaagtctagtgttttcaggcctgtttggagagaatgatggacatgggtttgtgaaatatcaaatgcttgttctgacccaaattgctcataatcagaaagagtaccttttcttttttttcttttttttgagatagggtcttactctgttgcccaggctggagtgcagtggcatgatcatagctcactgcagccttgaactcctggattcaagggatcctcccaactcagcctactgagcatctggaactacagtgtatgccaacacacttggctaattttgtattttttagtagagagagagtctcgctattttgcccaggctggtcttgaactcctggccccaaaggatcctcccaccttggcctcccaatgtgttaggattataggcctgagccactgcactcagccagaggagtatgaatacttagatatttgcacacaaatctcagtctgacataagtctgca

SEQ ID NO: 85475 - DNA, 1141 bp, Homo sapiens
taatttctcatattcttttatagctatttttatacttagctttttaatctatcagacttgttttttaggaaaataattctggttaaaggcagaagatctactggaggctattaaactgggtaaattacaatcaaggcattctctccagatcagtgctggtgaggatggaaggaatcagactctagggacaggatgttgttggttgatcagaggtgggtgttgaggaacctggggtagttagaagtacctttaacagagattgagaagaacagatttggagtaaacttgggggatggggaggggtaaaaaataatatggtaagtttgacccttatggacgtagagggaggctgggttggaattcttaagtcttggatgtggaggtggttgctgaaatcatgggagtgagtgtgagcactcaggaggctgcatagagtgaaaggagaggaaccagcctaggaagcccccatgtagtgggcaggcaaaaggggagcaggtgcagaggctgggaggtgaatcagaggggtgggcattagtgggagaagcaggtctggaacccagggtgctcagcttctacatccgcgtgttgatctgggggtgatgtctctttctcctgctgactgtgtaacttcaggcattgcctctgtggaaggagcctgcaagcctgtttctacttctttgtctagccctgtttttttgtgggaccttggctgggtcattttcattgctcaggcctgttttcccatctggaaatgagctcggtcttgatctctcccagggttcttagtcttcctggtgtgattctgcccttgctgtgcccataccccactgccaaggctccaaagctgcgggggcctcaggtgggaatttcagacatagagggtgtgggccaggacgaggtctcagggaagcatttcatcaggtttccctttgttcctgtagacattcgtagaagttctaaggcataggacttcctgatttgacttaatgtgtatctcagaaacaacggggagatttcgcatcccccccttgtagaagatctgtaacaggagttggtgtgttgcttggcagggagcgtgtcaaaaatctcagacacacaaaatcccatttcagacggccaagcaccatgacaaatgctcagc

SEQ ID NO: 85476 - DNA, 1144 bp, Homo sapiens
gtgtgtgtgtaccagggagcacataggtggcactccctacgtggtgccctcagaccgtgatgttgcaaagcaatccctacctgggcatttgtctccaaaagcagcagctctaagcagcccgtggctacctctgaccctcccaggctcatataataaactatagcattttatggctggtctgtgccctccacactcaatcagcatctatttcgaattgttactgacttatatgatgttaccatttgatttcatttgcttgagtgttatcttgccaactagactgacttcttgttgttgttgggcccgtgataattcttggtgtgtctccccattgtctagcatggggtttgggcggcacaaatctagccaggtgttctgtaaatatgtgtggagttgaactaccaactttgtaaatgccttgctgcgtaatttctgctcccagcttgaaaaccttaagacagggcgggtaggaaaagagagaagataggaaaaggggtgttcctcggagggagattagcaatgtagtgacctttagggattactcagcagaagggagaaaacctcccaagagctccagataactgggatggggaaaattcggttacctcagccccactgggttgggacctggagaggaaggtggacatcaggaggtcacagcgtgcaggagagggaggaaggcagcagcagtccctggatctggggacagtggcttcgggaagccctttctgctcggggacttctgctggggctggggctgctggacttcatccagttccggaagctgaccattgcctctccaggcagccctgagatggggctaactttggggaatctcttttccttttttgggaaatttctttctcgatacacccacgtaccctgtaactggtgggtgtggaggagaggcaaatttcccgaaaaaggaaaagaaatttctcaaatgcaggctgaggtgaggtggggtccgggcagcctcacagacaagtaaaagcctgagagatttggctgggcccctggtttttcaggagtggacaaagcaacaatctagaaacccagattgctgcctctgtcctctgcctttgtttctccacctgtaaagtgctgcccatgattttacctaattctgtcaccaagtttttgg

SEQ ID NO: 85477 - DNA, 1031 bp, Homo sapiens
gtcttcccagtgactctccttggggcctggggaaaccacaagggagcttggattcattcacccattgctgccttgctgtgtgcctcagaggggctcagaggtggaaaataaatatgaaaaagcatccttgtcttctagaatctcgtcggctgctgggaagaccaaggggccagccatcgcagggagcataagcactgagacaggcacacgtgcctgcccggctatcgtagccaggctggcagccttgcaactccctggggaagaacaatctaggaacattctggggtgtggagcaggaagggagtgtcacatgcaaaaggcaggatcagccaaagcagaggggctgaagaagcagtgattcccccacctaatgtcagaagtaaaatcagttcatggtgaaaatttggggaaacaaaatcatgcagcaaaattgcctattaaaccccacacggaggtaaaaatcggttcatattgtggttatgtatctattctcttatgatgtgtatttatgtgcttatgtaagacctaaaaacaataatttttaaataaaccagttatttttaataagaatattctggccaggcatggtggttcatgcctgtaatcccaacactgtggtaggccaaggtgggcggatcgcttgaagccaggggttccaggctgcggtgagctaggattgcactactgcactccagcctgagtgacagagggagaccctgtctcttaaaaaaacaaaacaaattctatctcacaattcctttcctatccttctatgcatggtctttaatagctacaccccattccattgggtggctgtatttgattcctttattctgtactttcggacatccaagttgttttcagatttttacttttttaatatgatgcttcagagaacattcctggaagtaatgttgccagtgcagaggtgcaagcatgtttgagacagctgatagttacctctgtccagaactggctcactcccaacagcagcaggaggcacccagggtctctcactttcctttcaattt

SEQ ID NO: 85478 - DNA, 1110 bp, Homo sapiens
ctcctttcttcattttctccttccctctcttcctgtcctcctcccctccctccctcctccccatgctcttcctctcttcgctcctctatcccttttccccctcccctcctctcctctccacctcaaattaaagaaatacctctgggcacagaagactcgagcccttctcctgccccaggctcagtgtgctgctgggtgctgcacccgtgtgatctctagcaggatacagcagtacagacccccccatccccaaccctgggcccaggctgccagcaggcccagcgtggaccctggtgctgaaagaagacctggagcggtgtcttctgaggctccttccactctggagaggacactagggctgcccttgcacaaccaggcccagggctggagctggggcttcagaggcaggacctacactgccctccgctcctcccacccccgtcgtctagcccccacaggactgacaggcagctctggcaaggcaactgctgttggttcctttgtctgttgtaaaattctatatggtggaagtagttgtgccatgatctgatctagctcctgatttcagaaatgagaagattgaagctcctaaggggccaggagccacccaagattgtgctgggatagtggcagaaccagatccagagtcgtcctgctggcagcgcctgcttttgctgtgttcccttgctgcacccctggtgtctatccagagtgaacttgccacacacaatccctgatgggtccctgggcagctctgcccagccttcctcaaagccagggtgcccagcaccctccctctgcagggactgtgggagttcagcaaccccccacaccctagtccctcaagagtacccattgtgggaacttgaccagcacagctcctagattctggcctcagggccagcacctgcctctgttgccctaaatgggcacagctcgtctgtactctcaccaagcccactctgggagagcagtgttagggcaattccaggccctggagacagggtcagtaatggaagttacacatcctatgctctgaggccatggccaggccaggcctctctgccagcacggagtctgtgtcgtgtcctgagcctgctgtgggtgtgg

SEQ ID NO: 85479 - DNA, 1066 bp, Homo sapiens
aggagtaggtgacttctcaacaatggatagctggtgcagatcccagtggggccttagccaggaagtccctgctcccatcctgtgatccaggactgatgccaaggatgctcttttaagcaattaagaaaatatataagtaaagggttttgctagagagaggaggaggccagtgggtgggcaggggaggcttcatgctggctggcaagcaggctgtgtgtcgtggtggctccagagcaggatcagctatgtcctggtttagcgccagaccacagaattagcattcagcacacctgcttggcttggcttcttctcggagagactccttttgaactcgttcttgtctcctgtcgcctgggacaggtgcagtctctggggctttgtactctgcatgcactgccacacggggatgggttttcacctggtgctggccccaccccccaccagttctgcatactaatactgcagcatccctttctcctgaccctggtgacatctgattggctgctgtcgctttctgaggcctgctcactggatccctagtagcccaccctgtgcttggttggattcctgtcccctggttgattagagcagaatctccaaattggcaagagattcttggccacacctacctgaaatggcagccacaataggtgtgcccaggagccagactgctgggaccacagggttggttttttgacaagccacagtcatctaggcaagcctatctgaacctgaccggttctgggcttcgatgtgtccgttcctcagacttccagagtgtttcttggatagtgagtcacctctggctgctgagtgggggaagttgttttcctggttggcctgctggtgactggcagcaaggacagctccccatgtagccctaacccccctgccctcagcacagcggttagtgccctgggaaccctggagctgcagggtgcaggccccgttttctgtgctgaccagtaaggtgcttgctgtcccacctgcagcttccagggcaccaagtaataactttccacctcgcccagtagatcagggcagccagtgtgcgagcctgtggtct

SEQ ID NO: 85480 - DNA, 1047 bp, Homo sapiens
gaggagccctcatcctggaagtggcctgttggtgagccttgaatctcaccaagatcccaccacaatcgctcaagtgtggtggacgcctggcttgcacttaccaagctttccctgggtgtcctggaactccagcagcttccttagcttcctgctctcacaatgccgcggcctctgctgctcccctaccccagcgcctgcctccgctgctggttctagcaggctggcccggcacaagcttctttcctgaggaagacactttgtgtctaagcacagggaggaagctgagctgaggaagacactttgtgtctaagcgcagggaggaagcagagcccggggccctcgccctcctctctccgggggtgaagacgccttaggcagccagttttccctcgcactccctgagaagcagctggcctcttgggggaggtggggtctcaggaattgatcttgtttcctctcttccttgtggagataattaggcttccaggcttgggagcccttcacccacttcctctgggttcttatcctcttgtccagagcagcagtgacaccctccccgccaggtaacttaggtgcccctgggagaacaggcccggccctgtgagctgagcctcagctggtgcgtcccccacctctgaccccaccagggtgacttcttgcagctggaggacaatcatggtctctctccctcttcagtgattaccttgggtttttgcttctttaattctttggataattttggttcaccattatttgatttgaaaaagcagcgctcttccatgtattcatttcccagccttgttttctttcaggtcttgcctctgcgctctcctgctgtgccgctgggtggcgctgcgcctcctccacccgcttcgcccccatctaagctccgtctccggccgtagacagcctgaggaggccgccagccctttcacatgaaatcagcctgctttgtttttgttttaatttggtctttgattccttttactgttggcagaaacaatgttaattcctgggcctcttccttgctaaattttggggtggggg

SEQ ID NO: 85481 - DNA, 1046 bp, Homo sapiens
gtttgaggccttggacattgagaaggcagagcacatggagaccaatgcagtggggccctcaccatccagcgacacacgccagggccgcagcgagaagagggcgttccctaggaagcgggtgagctcctggggctgggcagcacctcaggggtggctcgggggcgggtcagcatgcaccccatgcgccaagtcccctccacacaggcctgggatgtgctcctgccaggcttctctccaaccacctcctctgcatagtgacttcttgagagcaggcctgtctcctgcagcttcatatcagagccttctccgtctctgctgaaggatattctcatgcattttagatcccagatttaattaggatcactctcttcctatctgagacagcccagcaacaaggctgaatgtcacaccttcctaactctttctttcagtacaactacacccctcgtttctccactcagcccaaggtagactcggcttctgaaatcctcctgggcacccgcctgctgcttttgtagccggccaagtctaagctcatcttctcctggcttctctcttgttcacaaggtgcctagtgcctactgtctggcccacagcttgccacctgccaccacagagcccagggctcttccttctgtgacccagagaagctggaggatggggtggggccaggaaagtgacagtgactgggaatccaaaagaaaaggctgctctatcaaccagggcatctcaggacccgggtcctgtcctggccctgctgcagacttgctatggtggctaggcagatcactgcccctcgccaggagcaaggccctggcggctcttggaggggtggacagcaccagctcgtccctcacatgcccacattgccctgggctgcactgaccagcggctgctctctgccacaggacttcaccaatgaagcccccccagctcctctcccagacgcctcggcttcccccctgtctccacaccgaagagccaagtcactggacaggaggtccacggagccctccgtgacggtgagcccaggcgccgcgtcctcc

SEQ ID NO: 85482 - DNA, 1241 bp, Homo sapiens
atcaaggtcctaggttcaagacttggccctgctactgacccccaaagcaagtgcatgtgtcccctcctctacagcggcagtctgctgcctgtgtagacttagacccagtgatccctgagggcccttccggctcttagaccccgagtctctgtcacgtattgtctacatttgcagaccgcagtgcgctgaccttggtctgagttgtcccaggcagcagatggaacaggggcactcagctggcctctgaccatagtctgcctctttgcagactctctgctgtttcttctcctgtgtgctccctgggccttctctttctttctgccccacatgccctagactctcctctccagcctcttctgccatagtcattgccatgccctgttcagacctggtgaacagggcctccctgtgggcctccctgccaaggtcatttgcgcttgccctccaggtttgaggagcatctttttaattcttgattgggcctcatcctataagaactggcttcaaatcaggtagtaaagataaaagttcagcatcccaaattcgaaaatctgaaatgctccaaaatccaaaactgaacgctgacattatgctgaaaggaaatgctcactggagcatttcagattttggatttttggattggggatgctcacccagtaagtagaatgcaaatattttaaaatccgaaacagttcttgtcccaagtattttggataagggatactcaacttgtactaagcagcggactttgcacattgctaacctaggaacctacctctgtctaacttgcataattgcatgagcctacactgaagcccctgttggtcagcactgggcaaagctggtctttaataccttttccctaagtctaataacctgtgacttctcaccaccctttatgctttggaaatgcttttaatcacgactcagaatgagcagggggtctgtggggttaagggtcaggagccagctactggggtgggtgctatactaactgctgggaggagcttgcatgatttggacattgagtgtgaagtgtaacttgaacttaacataactgagtgtcacatctgtggcttccccggccagcagaccgagagggagccataggcaggccagattcttaggctgggctcggctcactcttgtttgtgttgtttttccctatattaatgagttctgtctctgcatgcctttcagtgtggggagttttgtttcatttacgttgtgttttgtttttg

SEQ ID NO: 85483 - DNA, 1013 bp, Homo sapiens
atttgcttgctccttagttaattggggtgcatttaaatcctggctaatggaaaggttcaagccaggattcgttcaatattggcttttctgtgggcaccaaattaaaacagccctctatgaccctgccctgcacaaacaccccctggggctgggaacatagtccctttctcacctgaggccttcccaaggggcatggctgctgcacagggctgtgtatgaggctgctcaggcaggactgggtccactcactgctgctgtggcttaaagattaccccacaggagctcagatgggaccagccatggaacagattgacactagttattgtgacagaaaggaattaagggttatcgattggatcctgcctacgcagttccacagatacacaaagaacctagggaaatggccttcccgggttgtgtcatgcgacttggccccaggcagctctggagtgtcactgttgtgttgctgtcccccaggagctgaacaaccgcctggctgcagagatcacacggttgcggacgctgctgactggggacggcggtggggaggccactgggtcaccccttgcacagggcaaggatgcctatgaactagaggtaccatcaggagccaggccctgcctgactcagctctgcacccaggaaccccaggggagtgcagcatggcccctgtcttacagggttgtgggaggaacagacctgagacagcaggagtcacagggtccaggaagatccaaatcacccgaaggcggcgaggagcagtgagctgccaggtggcatgagagccactagccgagtggagccctcgaggggctgtggggatcctgaccccatctcactccacccactcccctccatttctgctatgccacaaacactgaccactcaaaaggacacgttctgtagccatgtggctgctgcagctcaggtcagggaggctcgctttatgttagaatgatggattctggagtatagggtgtccttttaggaaggcacttagatttctccacatt

SEQ ID NO: 85484 - DNA, 1031 bp, Homo sapiens
tggtgggaggggcttgagggacactggggagagtagcccaaattgaagtatgagtgctcccatgggccacagctgccaaagccccagggcccagcactgagccagcccgagctcaccctgctgggctggttctggtggctttgagctctgtgtctgtcttggagccacctcctggcaatgacactgacaggccagggctgtgaagagcagtgcttggcatgatcagctcctgcctcgaggccaggtttcacccagccctgctcatgtcggcctgctgtcagctgtgcctgtgttgttccttgcacatcactgttgtgacactggtgccgcctccaagagatgatgctgcctgctcttgttccccagccaggaagcagtacatctttagtgtgctgtccagagccagccatgcacaggagggcgggcggaggtgggagcggcaccgcgtgtgtttgggattggttgtgtgtctcatgtctgctctctcctctgacagtccgtaattgagcaggtctcgtgggatacctgaaatgcacccgcttcccggcccatgcaggaggtaaaccgcctctcccaccgcctgcatgcactgctcacacccccatggcaaacgcctgtgtcatggttactttatttcaattcatcctgctccaacaaacacataccaaatccaagtgaggtttctttaacctgctctggggagttaattggcactctaacctcttaacagagatgaccctggcagtgaggtgctcctctagcctggtgggcaggcagagagccaggcacccatcagcatgcatgttggataatctgtgcacaacggctgaactcactccaccccctcaggggacacttgtcttgccctctgtcacgaggtggaatttacagatgtccacactggcaagtgaagtctaccgtcaccaaaggcctcgcccacctagtgagccacttagtggcctctgtctgtcaaggctaacagggtggtcattctaggaatggataaaccaggactagagcttggtgaagat

SEQ ID NO: 85485 - DNA, 1028 bp, Homo sapiens
ctgtctttgccctggtcacctctgactgggttagtgacagccttggcagcaagcagtaaccccgaagggacatactggctggcatagactcggaggtgtggcctcacccagaccacggcctgcccagtcccccatagcctgtgtgtgacgctctggccctgtgtgtgatgtcccctctgtggttctcagcgtccctcctgggagcttagccgccaccactctgtgaaagcatggcgggctttcctggcccaccaaactggaaacatatagtaaagccagtagcccccaggaacagtccacactgggggcgggactcctgcatggaatgaaatcaccttgtcctttctgcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttccaggtcgatcccattcccttccctgattctagaaaagtc

SEQ ID NO: 85486 - DNA, 1115 bp, Homo sapiens
tcgagggattgtgctgtggtgtctgagtgttttgttttggttttcttcagcaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttttggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttt

SEQ ID NO: 85487 - DNA, 1052 bp, Homo sapiens
gatcctgctgggtgggatatttggtattatatgatagatgtattagctttctgagtccaaaatactctggctccaaaacccatgtggccccaggggtttcacatcaagagattgtgaacctatagcacccttgtgaacagtgtaagttagaaaggatgcagctgacctaaacccgccgctgaccaccttctaatgtgcctgtcatgcagatgctgaagtgcattgagctggatgagcggctgaaagccatggaccaggagatcacagtgaaccctcagtttgtacaaaaggtgatgagggttcccttattacaagaagtaggctgggtggagaaggaggggtgttgtcacatcaggcacaggaactaagtttcaggttattaaatatttcttgaaaaccttaccagtacggtcatggagaaatactagttgagagcattttcaaatgatggcctggaagtacacttagggatgcttagggtggttcctggaattgcctgcccttgttcacagggggctttgttctgggagggacagggcaactggtgtgcttattgggctgccggggaacccttgataaaagcaaacataaatacataacttcactttacctttacagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttgaacattaatgtgtcttctgtatcacttttttctcctctgaagtttttaataagcacattcattgtgaacagaaatagctggattttaggaatttttggaagatttggat

SEQ ID NO: 85488 - DNA, 1073 bp, Homo sapiens
ttttgccatcaagaggtagccattaaaaaacagctgccattaaaaacacaaactctgtttgtgactagtaattgaagtttagataaaagaacccaaatgctaacaaacataaaagatagtacatgttacaaaagatgttaaattgcaaaatagcaaatgaaaattaaataacggtttcaaaaattagctgggcgtggtggcacatacctgtaatcccagctacttggaaggctgaggcaggagaatcatttgaacccaggagatagaggttgcagtgagccgagattgcaccactgcactccagtctgggggacaaagtgagactccgtctcaaaaaaaatttttttttgatcaaacaggaagagtctcaactcgaaatggtctttccagggctggggtagtgactcacaaagtcatcaaggtcctgggtccttcgtatgttgacacgaagtggtggattgtggtacactgagctcacaagcactgcctgccagagggacctggggagggctaccataaggtatggtgggcaggaaccgtgtctttaaaggacatagctagtcagaaggttacatctgtgatagtggctgctccatttttggcatgatgtcccagtgctaaaatgaaaagaacggggaaacatcaaaggatttttctagccaagtttttcttactagaaaatccaaagaagtctcaacaggtagactgtatcagtaggtgatggcatggctgggatggaaggcagctggggatgggttaaatctgccacctctcccattgaaatattactttgtgttaacattttagtagatgtttttctttttctttttctttttctttttttttttttttgagacggagtcttgctctgtctcccaggctggagtgcagtggctcgatctcggctcactgcaagctccacctcccgggttcacgccattctcctgcctcagcctcccgagtagctgggactacaggtgcccgccaccacacctggctaattgtttgtatttttagtagagacggggtttcaccgtgttagctaggatggtctcgatctcctgacctcgtga

SEQ ID NO: 85489 - DNA, 1902 bp, Homo sapiens
ctgacaatatgggatatacttgcttaaaaaatagtatgtaagtgtgtttttgcttcctatacacatttgagtcttctgaagtttgtttgtttgtttttggttttttttttttttttgagacggagttttgctttgttgcccaggctggagtgcagtggcacgatcttggctcactgcaacctccacctcctgggttcaagcgattctcttgcctcagcctcccaagtagctgggattacaggcatgtgctatcacgctcagttaattttgtatttttagtagagacggggtttcttcatgttggtcaggctggtgtttaacccctgaccccaggtgatttgtccgcctcggcctcccaaagtgttgagattacaggcgtgagtccccacacctggcctcttctgaagttttaatctgaattttttccctcctttgcatctttagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaaggtgaggaaagtgccaccttcacagggcagctcctgaccccctgggggccatgtttccctttctctcccttttcagagctgaggaagcaggtacagggataaagcatggcaggatttctgtgctgagagagaactctcttgtgattggcttcttagaaagaatttgatgtatacctttggtcttttcagggctagagcagggtatttggagcaggtgaagaggaagaaaggtaggagacaaggctacattgggagacagtgaaaggcagcctcagagaggtcagcagctccagcagggcagatgagggatgctaatgatgcagacctcagtgcactgtcaccagccttgcaacctgtctgttctgtctgtgctgatctctattagaacattttttttttttctctcttgacacagtgccttgctctgttgcccaggctggtgtgcagtggcgtgatttcggctcattgcaccctctgcctcctgagctcaagtgatctgcccacctcagcctcccaagcagctgggaccacaggtgtgagccaccacgcccagctaatttttgtattttttgtatagacaaggttttgctatgttggccaggcggtctcgaacccctgtgctcatgtgatccacctgccttggcctcccaaactgctgggattacagacatgaaccaccgcacccagccaatgagaacaccttatgtgaacatagtactactcggacattaccatttaggccagggttgtacaaactttgtgcaattgacttctaggatgtaagccaattatataatttttattttcttctaggatgtaagccaattctataatttttattgtcaagatgaaaataacctgctaggttttgactatagaaaatatgcttaatgtcaaacgttcaaacagtacagaaaaataatgaaaaatgaaattttttgtgttttaggaaggtataggctgcaagttacaggaatcctgtagctcaacaaatagaggattgcttttttctcttgggaagtctggccagatatgcatagttcacagctgctgagaacacagtgcatctgttcctgtgcacatcctttgccttgtgtcagccatggtgatgcatggttggggacgagccaaggaaccagaatagggtagctgtttttttgctaggctacccagcaatggaaaaggctgatggatttggctacgtgaggacttaggggagaggtgacttcccctagcccaatggagaagctagagaagagaggtgggtcggggtggccgttgaggt

SEQ ID NO: 85490 - DNA, 1093 bp, Homo sapiens
ttttctgaatggctaagaaaatggagtacaggttgactattcctaatctgaaaatttgaaacccaatccaaaaatttgaaacccaaaatgctccaaaatctgaaatctttagaatgccaacttggcactcaaagtgctcattggagcaattggatttcaggttttcagattagggatgcttaactggtatgtattctgcaaatattccaaaatttgaaacacttgtggtcctaagcatttcagatagcagatacatgaaatgtgttgacatttagataattttagtcaataaaatgtaaaacacaattacattatttggaaatttctggaatcaatgaattttctccttctgctaatacctgcctaagtaaaattaaagtgatgatttaatatcaatttgttcacagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggtaatctctctaaaaattagctgaggttgttctgaacttgtgtgatcaaaaaagtgctcccataggtttgtggctagagtggtctgatcccagggcctccgtttcaggtgttggtcctttcagagactacttctctgtgatcatgtaaatagtggtaacctgatccctaagttgaggagcagcgccagtgcatagaagagcacttgtctgggggttctaatctaggcttgcacttataccttatctgatttggaataagttatgacatctcttgacctttatagcttcctttgcatataaggaagagattgaactgagtgatcttggttgtgtcttattctaaaaccatgtgtggtattttgttaagttttatttaatcagtgaaacattctcttgattcaaaatttaaagggtagaaaggagtacacagtaaaagtccctcccaccctttctgtgtctgtgtaatgaaacatagtacacaatttggtagaatattctggaggttt

SEQ ID NO: 85491 - DNA, 1043 bp, Homo sapiens
tttgtgtccgttctgtatagtgattgtgcaaaataaccaggtcaggaaaatctcatggattctagttcttatttatttgttttttgagactggatcttgctctgtcacccaggctggagtgcagtggcatgatcatagctcactgcagcctcaaccttctaggcacaagtgatcctccagcctcagcctcccaagtatctgcaactacaggcatgtacccccacgcctggctaatttattttttgtagtagagacagggtctcaccatgttgctcagactggtctcaaactcctggccttaagcagtcctcctgcctcagcctcccaaagtgcttggattacgggcatgagccactgtcctggcctagttcttaattctaaaaaatactgttgctcatttaattttacagagtattggaggcaggatggatttcttgcatacattgtttctgtattttatcccatgaactatcagggtaatttgattcttttctccttattctaggtttgtgaagttttctatgcccagtgttcctgacttcgaaacgctattctcacaggttcagctcttcatcagcacttgtaatggggagcacattcgatatgcaacagacacttgtaagctaaataacattttattctccattgaaaatattttgcccttgtggttatatttatattttgaatattttgttattgtatctagttgctgggctttgccatcagctaacaaatgcacttgtggaaagaaaacaggtaagaaatactattcaagtattcctagttttgttataatatgtaactagcttacacaatgaattactttatcaagattccagttagtactgagcatccaccacctagatatctgtggtcacttgagagcactcacagccattgctgtaagctcaggcagtccccgcatcccctgaatgaggtggaggcacggggtggtttggcacctcagggaggctgctgctggaactaccaagtagttggaattaccaagccagtaccctttatgttgtaatatgctgggtttt

SEQ ID NO: 85492 - DNA, 1410 bp, Homo sapiens
agagtaggtgtgtgaggggaagtagcaggagataaggctggaaaggtagcagggaccagttattgaagggccttagttcaggctgaggcgtttgcacttcttaaagtcattggaataacttgattgaatgcacagtttatagaacagacagtactaatatggagtgcgggttggaggagagaaagatcacagtaggcagaccatttagaagatttatgatgtaggctgggcgcggtggatcatgaggtcaggagttcaagaccagcctggccaagaaggtgaaacccccgtctctactaaaaatacaaaaaaattagccaggtgcagtggcaggcgcctgtaatcccagctatttgggaggctgaggcaggagaattgcttgaacttggagggcggaggttgtagtgaaccgagattgcgccactgcactccagcctgggcgacacagtgaaactccatcttaaaaaaaaaaaaaagatgtagtccagacaaaaaatgatgaggatctgaattagggcagagaggggagagagaaagaaatggagctgagagactttggaagtaaaactaaatcatttggatgcagagagctgttaatagtaacgtgcatttctggcttgggagactagaaaacagaatagagaaaaaggtgaaacattcagggtcagagagaagtgggaggtccagtgtaatctctaattcgttttgagaccacggacaggttgtttcactcctctggtccttctggatcctcatccgaagtgaaggagattaagaatcaattttgggaacttcaggctctgaagtacaaagttgtggttagagttccatcagtttggttagtgctgtagctgaaatgcaatagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtaaggagcatcttcttttatagttctgtgcttgttaaaatggaacactgtgcacttcctggctttatttttatttatttatttatattttttgagatggagtttcgctctgtcacccaggctggagtgcagtggcacattcttggcacactgcaagctccgcctcccgggttcactccattctcttgcctcagcctcttgagtagctgggactacaggcactcgccacccgccccagctaatttttgtatttttagtagagacagggtttcaccatgttagccaggatgatctcgatctcctgacctcttggtccgcccaccttggcctcccaaaatgctgggattacaggcgtgagccaccacgcccagccctggctttatttttatttattta

SEQ ID NO: 85493 - DNA, 1024 bp, Homo sapiens
agaaaaggcagttgaacccaggctgcttggctccagagtctaatatcacggggaaaacctcacgggagacgtggcaacgaagttgtgcttcattgaagtatctgtccaggtggaaaaccgcagggcctctctagcaaaatccagaaccagaaaatacttgcttaattatgagtttccttccttcttttgcccactatccccatttaacctgcggagggatttcagaagtgcagtgaataaagatgcaggggactatggaacactaatttccggctacggcgaattcaggctgtttccatggaaacagtaacgggtgggcagctaggtatagtctcgcggtgcttgaaccagcggaagtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaaggtaacgccctaggccgccgggctgggcatgggcgggtaccgggaactggcctggatccccaggcgccagcacggacggctggaacagcccttttagtcctgagactcttctccggggccgggcttggggttgcggcgtttagatcagggcaggatcgagcgcggccgagtgtaggcagccccctcgcgctccgctgtcctcgccggccggcctcccctccctcgggccgccgggagccccctccccccggcctgggccccttccaccgggcgctttgcttgacagtttgggggcgtgacttccgccaggagccatctcgggcgactattggttccttctgtctctcttgccttcggtgattggcgcaccgccatgtcatctttgccgccgatccgcagcttgctgactaggccgccgggagcgggcgggaggcgagtccgttctgggtgtcttggctctatggctcgcctctgccagctcctccgctgccaggcggcgca

SEQ ID NO: 85494 - DNA, 1095 bp, Homo sapiens
tcaatcatccatgtcttcagctacaaccccaagagtgctcgaaagcaacccacggtgtggcagttcctcaagaggttacaggcctttccgctcggctgttttcctgctcaggagccgcagggccgtaggcagccatgacgcccagccggaatggcatggtcttgaagccccacttccacaaggactggcagcggcgcgtggccacgtggttcaaccagccggcccggaagatccgcagacgtaaggcccggcaagccaaggcgcgccgcatcgccccgcgccccgcgtcggggcccatccggcccatcgtgtgctgccccacggttcggtaccacacgaaggtgcgcgccggccgcggcttcaatctggaggagctcagggtggccggcattcacaagaaggtggcccggaccatcggcatttctgtggatccgaggaggcggaacaagtccacggagtccctgcaggcgaacgtgcagcggctgaaggagtaccgctccaaactcatcctcttccccaggaagccctcggcccccaagaagggagacagttctgctgaagaactgaaactggccacccagctgaccggaccggtcatgcccatccggaatgtctataagaaggagaaagctcgagtgatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaataaaaaaaaaaaaaaaaaaaaaaaaaaaaggaggttacatacagctttccatctggcccaacaaccctacttctgggtacatgcccagaagaattaaagacaggtattcaaaccaaaacttgcacacagatgtccatagcagcattaatcacattcactaaaaggtggaaataacccaatgtccatcaaaagacgaagggataaacacaatggtgtgtatctaggcaacggaacattaatcaaaaaaaggaagttctggtacatgctacaacatgggcaccatatggatggatctgggaaacac

SEQ ID NO: 85495 - DNA, 3299 bp, Homo sapiens
gaggctgaggcgggaggctgggaggctgaggcgggtggatcacgaggtcaggagtttgagaccagcctgaacaacatggtgaaacctcgtctctactaaaaatacaaaaattagctgggcgtggtggcggatgcctataatcccagctactcaggaggctgaggcaggagaatcgcttgaacccaggaggcagaggttgcagtgagctgagatcgcaccactgcactgcagcctgggcgacagagtgagactccatctcaaaaaaaaaagaaatgatggaactagacacagaagatgccacccatgtttatatagcattcttggtttatctggacctcatagaaagcaaaactggcatgaactaaactgtgtcagattaccagaactccagctcatctgccttgttggtactgagatagaagaggaggggttacagactgtggtgcctacccccatcactgcttccctcagccataacaggataagggagatcttgaaggcatcttgaaaattgccaggtgatccagatttgctgatgtcttttactctggccataatggagtctgattctacaatagtctattataaacttactgatggatttatgctgccagaccctcagaatatttctcttagaagatgacatctatgtttcctgatgcttgttttattcatacaagattggatttgagacccgtcagactgctttgtcttttatctcagagatagtcagggttgacttagatagtgagggttgacttccctattccataaggttttcattctgaagaataaaacttccccagggggggctgggcgcagtggctcatgcctgtaatccaaacactttgggaggctgaggcaggtggatcacgaggtcaggagttcgagaccagcctgaccaacgtggtgaaatcccgtctctactaaaaataccaaaaaattagctgggtgtggtggcgcgcacctgtaatcccagctactcaggaggctgaggcaggagaatcgcttgaaccccggaggtggaggttgcagtgagccaagatcatgccactgcactccagtgtgggtgacagagcgagactccagaaaaaaaaaaaaaacaaaaaaaaaaacctctccaggtagaagactttttctttcttaaaaaatataggtggtttctttacaactttcttatctagagacagtttaattacagttgtatacaggtttacgcctaggatgtgttcagacaggtggaacctgtgtgctgcttttgtcatcccacacttatagcactcatagttgcctctgtttattgctcccactgctagctcattgttgagactgccatctctttctcttactcaactctcccagtgccttttggccactgcagctaccttggaatggcattttatacataccttgtcacctacttctgctttttcctacccagtagaaggtaaaagatttctttcaattggtcctcctgttgcaatgactgttatttctcttttttggttaactttaaatcaaaactcaaaatatgttcatccagagtgtaaacttacatgtcctgagtaacagggataggagacatgctacccacaagagttctgggccttccttttcattcttattaccaccatccttattatatcatagcttgaatattacaagagagatagtgtgggacagtatcagtttttaaaatgtcttcattaattagacccagttattccacttttgttaatgtctctcaaattgtacaaggtatgaaaaattatatgcacaaagatgttgcgagtgacgttacttttagtagcccaaattataaaccacttaaaagtttggggtaaatatcggcaaactttttctataaagggccagaaagtaaatattttaagtgttttcttttttctttttggagacagagtctcgctctgttgcccaggctggaatgcagtggcatgatctcggctcactgcaaactccacctcctgggttcaagtgattctcctgcctcagcctcccgagtagctgggactacaggcgcctgccaccatgcgaggctaatttttgtatttgtagaaacagggtttcaccatattggcaggctggtctcgaactcctgaccttgtgatccgcctgccttggcctcccaaagtgctgggattacaggcatgagccaccacgcccagccctattttaggttttgaaacctactgtctctgtcataacttgtcaacactgctgtatgaagcataaaatcagccacacacaatacataaacaacatgggcacggctttgttccagtaaaactttatttacaaatgtgttgccatagtttgccatccctgggtctaggaaatagtcgataaacaggtatatacaaacgatacataatgtacttattaaaaattagggccaagcacggtggctcatgcctgtaatcccagcactttgggagcccaaggtgagcagaccacgaggtcaagagattgagaccatctggctaacatgatgaaaccccatctctactaaaaacacaaaaattagctgggcatggtgatgtgcgcctgtagtcccagctactagggaggctgaggcaggagaatcacttgaaccctggaggcagaggttgcagtgagcggagatcacgtcactgcactccagcctggggacagaacaagacttggtctcagaaaaataaaataaaataaaataaataatgaatattattaaaaacatgagaattttacattaagtaaaatttgcaagatgcaaaagtgtatgagtgggtgtaatcatggctgaaataacacatcaagcatttgataacaagatgacaaagtaaatcaaattactaactgtggttacagtgggatgggaggcagtaaatggatgactttgtcttttctcaatgtttatttttatttgtattacttttataataaaaatgttttaaaatttaaaaaaagaatgaagtgagggtgtctaaggtgtaggagcactctgtcccaagaaggggagctttgccggcctgccattttgcccagactttcttccctccccttcatcaccctctggaggcctgggatgctccagcaaccgaacctatcccctctccatgaggctgtctctcagtaggaggagaggcggtgtcaggagtcacagcccggctttggtggccttttatccctggcagtaccaccatttacatagctgtgtgcatggtccaatcatgctgtgcctctcttccctcttccataaattatggagttatcaatgaggctggaaatgagcaatgagg

SEQ ID NO: 85496 - DNA, 1056 bp, Homo sapiens
taaaaccctgtgatgtttgcctttgagtctggtgacacggatacaactgtctgtcagacgtgggaaggatgctcagaggatcacccctggcggtagtatttttgtccactctttaaaaaaaccatagtagggggctgggtgcggtggcttacgcctgtaatcccagcactttgggaggttgaggtgggcggatcacctgaggtcgggagttcgagaccagcctggccaacgtggagaaacaccatctctactaaaaatacaaaattagccgggcgtggtagcgcatgcctgtaatcccagctactcaggaggccgaggcaggagaatcacttgaacccgggaggcggaggttgcagtgagccaagatcgcaccattgcactccagcctgggcaacgagtaaaactctgtctcaaaaaaaaaaaagaaaaaaagaaaccacagtaccacagtagttgggaccaaagtgctctgaccttgccttgtttgtacgatgttcatcctccttgacctagtggcttttttcattccttctatagttggccgatgactaaccttgaacacaaaggtaggcccacttagagctttctgcttttattcactcggtatttggtcctgtcccttttcttttggcttgaatatttcacagtcatcctggcttagcagatgcccacttctgaatagcatgttctcttcactccaggagttccatgctatttacctccaccaactagggcagttgggcttgcagaggggcctccctgtgggctgcatggccccttttggctcagctgccctccaggcggcttgtcttacagctccttttttattatctgaagactgtctcctttcctgaaagttcaccaaagaacacgcaacccttgctatttgggggttttcagagatgagcatcttaaacatgacccactttcaactttcagaactaaattttcttttgggccaggttatgtttgcttcaagaatgggattatctgtcatccacatttctattttaagtacttttttgtttgttttaccatgtcctttgagactcatgt

SEQ ID NO: 85497 - DNA, 1035 bp, Homo sapiens
ggcctagaaatggctccagttagacaaaatgtcgtatttcaacaagttttgtttggcatttgtcacctgatattggtattggtttgttcattgaaccaacatgttcatgagcttatttgctaagcattcattctttccacggacatttcttgagtgcctgtagtgacctacacactgggccgggggtagggagacacctgtgaccaggcagacatggtccttgacctcagagtgacagttgacttgacagaagatcaagagtgtctgtgtgtgatctgcaagtgtgctaggcctgggagctctgtgccagctgcctaaaaaagaacccgtccctgccctctgggggtggacagcctagtcaggggatagacacataaaacgaagtgttctaaaagctatggcaggaatgacagccagctctagggggtgcagggcaggaacgccaagacgtgtatcaagctgtgaatgctaacagctgttcttcccccacagcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgcatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgctgctgcgcgcgcttcgcctgtgcgggagccagcgcagagcttggctgcgccgggggttcctcgtgtagatccatatgtctagatgcataataactggagtgcctgctggtggaagtcagaatgctcctggaggctgcagagggggtggaggactctcccctgcctctggggagggggccatctgctgcgc

SEQ ID NO: 85498 - DNA, 1034 bp, Homo sapiens
ttggagtggtccttgtcaggtgtcccctccctcatgcctcctcaccctgccctctctgactcagggttgctgacttttggggccatccctggcactacaggtgtccagcaatgtccccggcctctgcccactagatgtcagtagtaccccaagcccaggccatctgagtggtttccagacattgcctgatgtcccttgagggccatggctgcctgggcgttctgagtacctacccctcagcacagcctgccatacctgctgtcactgtttgtctctcactgtccccttcccaggagcatcctaagagagttgaagcggagcctgctctgcttctgtgtccccaatcctggcatgtgcagtgctccgggtggcagctgctgcctgaccttctgtgtcaaggagggtagggcacctgttgtagctcagtgcctgtgcccagcaccatgcctggcagaaatggatgtccaggcagtgtttattggctttgtgagcgtggattgcccattgactggttttctgcagtggcacctggtggacaaggtgaggctccattgtgccaggttctatgcacaccccgactctgtgaaataaagcactgcatggaggtaaagagcagcagtcatttgtagcaggctcagcgattcctggcatcccagtgaagataagataggcagcctgtgccactccagctcccagagcccccctgcttgccctgccctgccatgccctgtgttgtcccgagggagccagcatgggaggcacagcagctgccttgagcagttatttacaagagcaaagtgtgcacatgctttggtattttaactttattgaagaccagttgcatgtaaccaacatcaaagctgctggagacatagcaagttggaaccctacttccaacctagaaggatttctaggcagagttgcctgtgtctgacttcccttcctcactgggaccccgtaaacctgaaggggagctgtaaggaatcctgccaagacggcagatgcacacggggtcacgccggtttcctccagcc

SEQ ID NO: 85499 - DNA, 1048 bp, Homo sapiens
gcactcaagattgtcccctgtcgagtgtgggcgaggagaggcacaccactattgttttaatttgcttttacctgattcctggtaggttgagcatctcttcacatttatctcagctgcttgggtttcctctggggcctctgagaaccctcatccaggagggtctcggtcacaccagggttggtgtcacctcccttcagggtgccaggcacccctcttcagaggtgctgatttcctcatctggcatccaggcacatttctgcggccgccctcccaggacatgacacagctcattaggtttcagctttttatcttcccttttatgagactacactgtagtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatcccagctttgtggctgccgtcatcaccatcaccttcaatccgctctactggaatgtggtaagtgatgtgcctgacactgtccagacgggagtatctcactgcttggtgagccccacatgcaggggatcgcggtggttgctgctggctggccagacagacagacagctctgctcttccctcccgtgtctgtcgctggctggtgtggagtactaggcgcttcctgccgtcttgccttggggatccagcagccattgggctgcccaggctggcgtcaggatggtccaggactgtaggggtggccctcctaccctcacaagaacctgcaggagaacgctgccatggtggggctgccattggtcacatgtgcctggcagtctggtggccttctcatgcatgaagtgggttgcccaggaagtaggggctctcttccctctctgccatgtcacacagtaaagccacttgcttgtgaatctcccacccctcgtgtgttccacaaacatggttatttttcccacatgaggcttcctgca

SEQ ID NO: 85500 - DNA, 1222 bp, Homo sapiens
atactgaacaggccatttacctctctgtgcctcagtgtccccatctttacaatcaggagaataacagtacagacctcacggtactgaagtaaagatgcagtgagttaatccatatgaagtttagagcagtgcttttgccaataaatgctgattgctgccgtcattgttgtattgttattgctgttctatctccatggcagcccatgtttgaaatgcattgctttccacagctgcctgtggccatggcatgggtgtctttttcctcccctatccaacgtgtggctccacagggagggaggaggtgcaacagcaacggtgtgcgcagagcagcgtctctgcgggagaggcacctgggcactgggcccaagggaacagggattttccaaggacccactgtttccaaagttctgtgcttaatgtcggggtccaagcaggaagcatccctgcacttgaccacaagaaggtcacagcccagtgggtgattgggacccagctcatagccaaggcctcgaccagagctggaggcttcctggaggaggggcctttgagcaggtgcttcaggcacggcgaggtaagagtgagaggagcattcctggcagagggaacacagtgagcagagcgagtctttggaagctggaagggatgtggcctgtgtgctgtagccaaacaagaggggaggacttggctcagaaagaatggtggcggaagaggttgggctgttgctgggacctcctcactggcctccctgcctccatcctgtcccctcccaggtgctggccagcagcactgtcagagcgatcgttctaaacccagcagataacctccagtggctcctgctgccttatgaataaaggtcccatctgtagttcttcccatgctgtccagggccatttctggtgtcctctgcctgccctgtcctcattcagtcctgtcccctccagccacagctggcacctccttgttaaggtgcagccatgtgcatccttgcctctgtgcatcgggctgggctgttccttccacctgggatgcccctcaccttcctccctgccgccccagaccaaaacagacgtcctgtctcctcctcctctgacctccgaggcagaatgagtcatctccctttgtctatactcgtggcatagcgtttatcacggaattatcggcaattctgccagtgtctgtcctccccatgaggctgaagcatcgaggcctgaaagcacgtctc

SEQ ID NO: 85501 - DNA, 1002 bp, Homo sapiens
ccccaggtgctaccttccagcctggggccaagccttttccctttctctcatttgcagctttctgataggtgggaaagagaagcaggaaaaaagagcagaggaaaaacaatattttcatttcaaacacagataggggtgagggaggcgggaagtaatctggtttatgatacctttgagacaagcacagaaaatccccaccgtggcccgaaatagcactaaaacagacgttttgccaaatcagacttaattgagtggctctcttcttgactccagcaggatgtggctggagctggctttgttcccttggggtgacactgtcccctggggcccctgccctggctaattaaacaaagaggacctggtctcctaggcaggacaggagcctggggagctgaacttgacagcccttggcctctgcctgagagggccagaaatggttacaggggttgggaaggtggggggttcctgacaggagggccaactgagtgaaagcattggtgggagaggcctggttcctctaatatgtgaatatctgtctctttggatgctgaaagggatggagaaaagccagcattgagtgcctactattgtgccaggcattgggtggtcctcgctaagtcttattaactgccctatatccattatcaaggaaactgaagcacagagaggttaagtgatctgcctgaggtcacacagcaaccaagtggcagagctaggattagaaatcacatccgcaggctccaaagccaggccctgcctgctgcttacccccttccccatgttagtcactcatccattcgggagctaattcctggctatgaaataatattgtgaccttgtgggaagtgaaggcttgcagtcagacagccatgagcttggcttctgaccaaagcagtttttcttttcatggttttctccctcagaacctcctctttcctcatctatcaagtgggcataatcatgcctttatcctggagttgctgtaagggttaaattcagcac

SEQ ID NO: 85502 - DNA, 1025 bp, Homo sapiens
ccctctgcccagctgccccttggccctagctacaagctgcccttgccctgacctatccctactgccaggcctgtctcttctcccctattccagaacggttcaattctaacacatccaagccctgcgtgaaacaggccttgggaaatcacagttgccagggacggtttggcatttaaaaggcatccaaggctttggggaaaaagctgaagagacaagaggatgcagggccctgtatcagaacagcatctggatttactggatggaaaaatcacagaatgcccctttcctcgggaataacagtcctggccgaggggcagcgggtgtggcatgggcacgccatgccctgcctggccaccacctgccatcaccgctgtgtactctcagaaatgaaaagattagggaaaagattagggagggacattgtcagcctgcagccaacggcccgctctaacaggtttattcagttgtaaaatatttaagacctgtttcactttacctgtatccaggaggcagccaggctggggccgagattgatgtgctgaacatgatttatttatctggatttgctcttgtggtctgggtgttacctgggtgtggaatttaaccaaatgacaagatgggtttgcgtgtgttcctgagcttggggattgtgtgtgtgtaaaaagtgagttggggtttgtgtacatggcagggggttgctgttaggtggcttgtgtgtctgtttgtcactgggaccaacgtgtggttgtgtgtgtgtctgatttggggaaatgagctgagggtatgggtgcttacacaccaggcagtatccacagcaggtcacacgttctttgtgtgttgggggcacctctgtgtgtggccgagtagctgtttgtgtgcatgtcctgtggtgtgagacctggatctctctcacccacttttcatcagtggtggggcattgcgcactgactgagttgctggggcatctgcttttccatccggccctgggtgagcactgacaacacctgactgtcttccagtagaac

SEQ ID NO: 85503 - DNA, 1694 bp, Homo sapiens
ggcccagagagggccgtcttcttgcccaaggtcacacagcaagttcatggcataagctagccagcctcgtactccagagctctcctgagggcccccatgtgtctgtgcgggggtgttgatggggggcaggtgggagggaggaggtaaggctgatttgtttcccagcctcctccccctcccctgctcccttctctccctcacacggtttgtttggagaatgactcacaggaatgcagcaaaatcctgatggatgggaaggcagggccgcagtacccggaaaacctctccagggtagggaggcggggctgagccttggggcctgagaggctggtgataggggagccctgcatgcaggtggggcgactgaggccctggaagaactctggtcacgtcctggctgggggttgtccctcctcgacagaaacacacaggccctggctgccgcagcacccctggagcacccgtcccccatgatttccatctttgtgtccccgaggcatctggtgcactgtagctgacaaacacatgcattttggcactgagtgtgacccaagtcagaccctcctgtgtgtgccctgtcccccaggtcctcccagctccccggagttggggggcgggtgcttgccattcagtcctttcagaggcagccaagggcctacggcatgctggacactgccaggggctggggaggctgggatggagctggagggaagtgggaggtgtacacgggatggacacctcctgtgtatgttccaaatgtgctggaggcctcaacaggtcttggtacaaggtgaggcaaaccttagaggacctaggatgaagtttcacgtaaaggaacagtggctgtaagggctcccagaaagtgtagggaccctgggaaggtcccagtctttgaataaaggtgggtgggaccttattggtagcttggggcattagggcccagatatcaggcagcagcatgaggtgaggcccgggctctgtcccagggcaagccctcctcctgcgcaccacatctggggcctccgaggagggacaaagcattcaactcccgggacctgtgggtgggaatgtccccaggcccagccctttagtgcctgctgatggctgtcacgcggtgtccggccctgatgaccagatatgtgttttcaagagaagctggaatttggatttttatgtgaactctcctgattctcaaatgctggctccgttaacaaaaggcacagtgtggtttaaaccacacatgtccgcaggcagaggaccaccagtttctaatgtctgcgctgtggggcgcttgggtttttgcatttggttcttttacattccttattttattggaaacagcccaaatagtcactgagctgcaactctgtgctaggtgccggggctctatcagcgaataaaacaacatgtgacggagctgccattttagtgggagaagacagtgaataaacatatatcaggtgatatgtgttaggaagcaaatggaagcagggctccagaacagagagcggctgcaaggccaagcccacatttgggtggaaggggcagctagtgcaaaggccctgaggtggggctatgctaggtgtgttagaggcctgtgtggctgcagcgggagtgggtggggaagtgggaggaggtgaggtcagaaggtagcataggtcaaatggcataggagactgtgggctgtggtataa

SEQ ID NO: 85504 - DNA, 1029 bp, Homo sapiens
agaccagggctgagcttgaatgcgacttctgggtcttagtgtaccagcctggcctgatgggcctccccgtcccttgtttccacctgggtgtccctggtggcctgtcagtgagccttgtccttggctggctccactgcctgcattccctaggaccctgcttagagtccccagccctctacccaccctgcctctctggtcaacagctcctgtttactatttagctctggaatggcatctggacacacacttgcatgaaagcagctattgagatagtgcttggcaaacaaaagggctgacatgtccagacctaggttctccagaacacagcctcacctcaccaggaaggactgggccctttaaaacctgtgagcacccctaccatcccagcgaggagggaggatcctaattcccctggggcagactcttggtgaaaggtgaaatcagaacctagggagcaggaagcctgccagccaggcagcctcctctgctggtgttccagcaacatttgtgggtgctgggtgctggttgctggcaccatgatcccatggaatcctgccagtagggtctgatggagtaagcaaggctttggggtccatgcacacttaggtttgaattgtgaggttgccactccattctgctgcactgccacacgccatgcactgtgcttggtggaggtgagcaaagaatcttgaaattgagagtcggatgggatccgattgtgttgctgtggtcttggcaagttctttgcaggctctcagcctgggtttctcctctaggggatggtcagatcctgaccttggggtactgtcttgtgactctccatgataccacttgtggaagggccctggccaggtcagggtttccatcaccctctggcagatgtgaatggcagccctgctgaatcaagatccctccgtaccactgccccaggagctccagggagtccccagggagccagggaacaagagaggcccctggaacaaatgacaggctctgcccttttttgagataagccacccaccaccatcc

SEQ ID NO: 85505 - DNA, 1033 bp, Homo sapiens
gcctcgacccctccctcagggccgggaggagaggaggatgaagggggaggagagtggtgggaacttctcctttcccattgaggccatgggaagggaatgctagcccagaaaatttctggggaccgcagttctgaggcggggactcaatccaaggggggaccaccgggtcagaggcttcccggcacgcagaagcccccagattattttgctccatcgggggatgcagaggaaggggagaggtggaagagcgaagggctagctggactggcgttgcgggggtggagagcccgtggaaatcagccttaattggattcccaggcaagcagccaggctatcaaggtgccccctcccctttttcttcctggggtagagagccaggtccagagacaccaagctggcaacccaggcaggtgaaggcaattcctctccctacttaaaaagagaattcctgggggagaggggaggcaccttttgagagggaggggggcggctagactgtgttcaggctgttctgtctcttggtccaggaatagaaagagttaaccctcccccagaaatttgtcagcccccacacagcagggaaacattgttggaccctctgacatgctaacagtgtgacaccggctgactggagctagcagattctagaccctggactcccccttcaaagcccaacaggactcggctgggtggtgccttgttcagggaccttgtgggaggcggaaatgagagcccagagagggtcaggcagcaaagcagtggccttgtggcccggagggaagaggggttacaagccagggccatcggaaactggaagggaagtcgccatgggtctggggtagagggaagggagaggcccttctaccctttgcccagactcctgagcaaggctttgccctgctccccacccttcccacacacccactcagctgcaggcctggccattaaatgtgggtgtctgacccataggttggaccatgagaccctagtggctgagggaggcctgggtgaggctctgggaggcaggactgaa

SEQ ID NO: 85506 - DNA, 1934 bp, Homo sapiens
taaaatagcattcacagaaaagctgaaaaaaaaagagaaaaataaggttattgacagtcttagagggctctgacaatgttagtattttgatgtagttcttcccagtccttttcgactcggtggttggtttgttttttaaagactttgtcgtcattctctatattcagatgtatatcctgcttgctttgccggcataatgtgagccttttcctgttttgtaaccaatgcttcataaacaccatggttaatgtcttcaggcttttccaatcaagtggatgtaccataatttacttaatattccccttttgtccaacattctggatgttcctgatgaatgatgtagtggatatattttgtatagcttttcttgatacttaaaatgatttgctcaaaatgccactgctgatgccgaaggctccgactgcctgcagtgggagaaacggcttctctagttttccttggataaatgggacactatttttccttccccacaatctagaaccttccatcagagccgaaaagagccttggcaatgaatcacctatctgacctccctcctttgacagaagaggaagccagagcccagagaggggaagcgagtcccaaggtcacacagcagttgctgggctatgcagcagcgaagacccagctactgatttgccatgttggttttcgcatctgaaaagattcctgaggtctttaaggctgaccctgcccatttcacagatggggggactgagaccccaagcttacccctggtgccgccagctggagccccagacaggcttctcggccctcctgggccacccccgactgggtgtgttcacgggatctggcggctacaggctccctgttgcccgccccacctgcccaccacagttccccttcctctttgccatcccattctccagacaaaaagctgaggatccaaagcagatgcagtgagggggtgggactgtaggtctctggggaccctagtggttgcgtccttgccccatgcctcagtttacttgtcagagacctaaccttggatctgttcaggagcagaggcagatgttggcacagatatgaggtatgaaggagtggtgtgggggatggggtgcaccttaaaatctctctctggcccgagattcaccccaggagaccccccggggagaagggaaggagagagagagggaagaaagagttgaagcagagacagtattccccatcagaggacagggactttctgccccctcccctgcagcacaccaaccatccgtgtgcctctgatcctgcttgtgtattgcttaaggggtttgtgtgccttccagcttgggcatgtgttgtgcatgcgtgcctctgtgtgtgtgtgtgtccgtccctgtgtgtgtcccctctgtggtgtcagtctctgatcccatttgtgcatttctggggggaagggagggtgcccccgagctcggtcttgtgtgtgcgcgtgcatgcatgtgtgcatgtctgtgtgtgagcacactgtttcctcctaatggccccaggagggatccaggcatcaggcttttgtgctgcttcaaggttgtggctgggtgggcgaagagagggaaggccttcgacagggaggggtggggttgagggaggcaaaagaaaatcttaaaagaccgtcttccctctggtctccaaggagatcaggctgtgaaatgatccgcacgttaattaaaaacgattatatcctgattgagccattcctgctcacatcccccagccagggagaggaagaggctgagagcagaggatgcaaaatggggtagggtccaatggcagggcatagccaggtggagccacagcccacggaggggagcacaggctgggggagtcaagtgggaaggtgttgaggggcacgtgcccaagtctgattggagcttctcctttgaattttagggactgtcttccagtgg

SEQ ID NO: 85507 - DNA, 1167 bp, Homo sapiens
tcattcccttcagtccttccacagtgtctgctgatggcgccaaggttctggcccagatgccctggcgaaggcacccaaagggacaggggctgggtctccaaggggaagcattttgctgcagaaggaagggtgttggctgcaggacacagcatgccagaggcctgggggtgtgggtggcgagcaggtgggattggggaggtggaggcagggactgaggccaaaaaggagtctgggccttgactgcttgaagggttttatcttgaaggcagtgggaaaagatgggtgctctgggcagtgagcaccgctggagcaaagtctcggcagtgggaacacacagggacaatgaggagaggcttaagaggatcagaagaggacccaggtggggcctcagtttcctccctgagaactcctgagtcctctggggtgtgggctggatgagagcagcctccctcctcctggagctgctgtgcaggcctagaatgctggtctagagggaagcagggacctgaccatctccccaacctcttgcctaagcccagagcagctcggcctagccctgcatcccctgtgagctgagcactgggagggactgttcagtctcggctgagaagtaggtgatggtcctgggggactgataattaaagctcagcagattataattccctgaaagaaagctcagcacagagagggaggaacagtgcccagagccttggcacaggctggaggaggattgctgggggaggtggtggtggggggaataagaatgatacctggaaccatcgtgttcagagcttcctctcggtgaggcctcctaggtgcccagccctgggcactttgctgtttccagtcttcagaccctccttgccaatgaaaggttcctgccatccccattttacagatgaagaaactgaggcttggaaaggtctggcaactgtggttcaaggcccatggctggtaagaagtgagcctgcggctaaaccctgggctgtgttgggagcgttggcctccttactgagaagaaggcactgcttaactcagagagaggctgtctgatggcagagtcctgggcaggccacaggcctgaagcaggaacaggttggagcagggaagacccctcaggacattccccatgtttgtggccttctgtctgggagagggggatgggat

SEQ ID NO: 85508 - DNA, 1071 bp, Homo sapiens
caagaattccgactcctgactcccagtccagtgctcgttctctctaagacactggaaaaattggctcttaggtgggcttctttctctggcacattttttaaatgctcctttagttaatatgcaggagggatttccatgttctcgtacataaccttttgctgaagtgacaacgtgcgataaaagggtcccaggagagccagtgtaatttgggctgtgagggacagagaataccaatgcagaagcctctgcagaaggcctggctgctcctgggggctgggagacccggggccccctcaccacccaatgcaaaggtctggccatcttgggccctgggaccacgtgtacgttctgattcgtcttccactgcttggtttatttttctcacgtttttgggtgaggatcttggttcctagaggagggaggtctaggcagagagaaaatgagcatccaggacagggggagagattgaggaggatgcctgaggcagacgttgaagccttgtttctagtcaagcactggctagttggggggtatcagacaaaggggtccacatagaaggcaaactgaagggcatgttcaagtgctgttcacgcctgcctttagcccccaacgaccaaaagggggcttggcatagcgagaccctctctctacaattttttttttttaatttagccaggcatggtggtgggtgcctgtggtcccagctactccagaagctgaggtgggaggaacacctgagcccgggaggtcaaggctgccatgagccaagattgtaccactgcactccagcctgggtgaaagagcgagaccttgtctcaaaaaaataaaaagttggggggatgttaaggaggttccagttaattgtggctgattctaaattgggaggcctaacaaatggtacttatcctcccgtgggagcagaccagggctaaccaaggccgctgggaatgggggtcatggagacagagccccttttccctcccacccacctgaaggctccaagaacttccactgcagaggtgtcagggacggacctggtgcagaccagtgggcccacacctgctttcctat

SEQ ID NO: 85509 - DNA, 1147 bp, Homo sapiens
agcactgctcttgactttgtccttgctctgggataagagcaggcccagcagatggccgagaggtcccaaggaacagaggaacaggcggggaggaggcccagtcactgcttagcttctctgtaggagatgtagaaggaagtgggtctttgtgtttctgcagcatctggaccagatggagagacctttctggagatggcatgcacacttccagataggagctggaacatttccagaaatggaatgtttttagaaatgagacatggtgtttctggagacaggatgaggacgtttctagagaagagatgaaaagcatttctggaggaggggcatttctgaagatgaaatgagaacatttctggagatgggagagggcatttttgaggagtaaagatgaggcttttctggattctgagcattgctagagatggaacatttctggaaatggattctttctagagagaaactagaatacttctggaagtggtgtgtttttgaagatgatgctggagtatttctggaaataaaatagggcacttctgaagatgaggtatttttggagctgaaatgcaacatctctggagatgggatatggcatttctggaagtggaacattcttggagttagggtggagcctcagtagaccactggcatttctggagatggattacatttgaagatgacggggaatatttctggagataagatggagcatttctggaaatggaacattttggagctggggaatttctgggttaaaatgaagcatttctggggaagaaacaggtcattctcagagaagggacattttttggattgaggatgggacatttctagggaaggagttttctgaagatgagggggtcatagctcagcctggctgtttcaaggccacttgaggaggcaataggggagggtctcaggggcccagagaccccacctgtggtccttgttttgcacatggcccgagggagggtcttgcccagactcactcctgctgagctgcagagtgggcttctgaggaacctttccagaatgcagcctttgccaccccctggcccaaaaccctggcctgtgctggaatactaccagagggaggccagagctgcccagtcttactcttggggtccctacctgcttctggtggggt

SEQ ID NO: 85510 - DNA, 1098 bp, Homo sapiens
gggaagacagagatggctggacaggatgggacaagccagcccccaggagctggggaagcgaaggtgggtgcaaatgaaaacgcagaatcccatttgcagtccatttgcttagcagccctgaccaggagggagagaaagaagagggcagagcagggagagatggggagggataaggatacagagagagaatctggcagccaggggtcagggagcctttggccgtaaggcctgggatgcctgctgcttactgaggctgtggcccctcctgccttccagagctaagaaagctttgctctgtctcagctccagacaccgcatccccaccacacattccagcacctgcctgcttcccctgacctctggctgccccacagaccccatccctacctccactccttggggattttgaggtcttatgccaccactccactctgagcaggctcagtctccctgtgttggtggtggtgcggggtggtgagagtggtcctggagcagtgggaactacccggaggccacctggggtgggtcccaggcaccagtccagctggccagtgggccacgggggctgaccttgtcaccttgggcccagatggagggcagcggtgctcggcccttcccccaagcacatacagccgctgagctaacatgactcaccgcgtggcagctccctctccccactgggagtggggatggaagcctccagatgctgcagccccaccctgagggaatcacaggccaggctgagcccttccaaagtggggatagctggggatcagacatcagcatccattgaagggggtgttcacccgcatggggtaagccctgtgcctgggactctgggcttagtgcccagctagggccttgggagacccttgggcttctctgtgctcagggggaaaggagctgtgcagcctctaggggtcctgcctgccccaagctgtgctggtggtccaggccccctttggggaggaccctggccaggggtccctagctcctcctctgtcatccagagaacccttaggtcccaggggctggtggtgttcctcttcctcagaaacactacctgcaagactggaaccctaacacagccacctctgg

SEQ ID NO: 85511 - DNA, 1087 bp, Homo sapiens
ccacacccagccctgaaggcttttaagcagggaggtaagtgagctggtccagcatgtgtttttaaaaactctttctccagcagagcttacagaagggtgagcagggtgtacccggggggcttgtgtggagtccaggccaggcagggacggtggccagcgggtggaggaagccgtgaggatgtggccggaggagaggggcaggcttgggccctgcgaggtgggtgctgccctgggccatgattgggcatgagtggggagccgagccataccatggccggggacagggactgggtgcgttgttcccacatgagcgttgtggagttggcatgcattgggaggcatccctctgggctcagcccctgcctaccaggccaccattgcccctttcttggccagcagatcctccaccagcacctgtcagccccgagcactggaaacggcagccggcggggcctttgtgcttcaggattccttctccagggacacgggtgatagccaagcccggcagatgcccccgggggtgccaccgtgcccccactcgccatctccgatgctcagctgctccccagaatgaaagaccttgtcacaaagggaggcagggagaggatgcgcttccgtgccgcagcccatctgggagccaacgttattttcctgattgaaggaaacatctgttcagtcctctttcagagcgaggcaggcagcggactgggtcggtctggctctgggcaggaggtagagaacctgggctgagcccagagcccctgccctaaggggtttaagaggagctaccaccgttctctgtccctccctaaactgggagttcaggagctcctgccatccccttaagaagcctcggtcactgcctcccccaaggatgggggctgctggggcaaaagccatcgcctgtcccagagcaccatatgtgttttctttttttttcttttcttttcttttttttttttttttttgagatggagtttcgcttttgttgcccaggctggagtgcaatggtgctatctcggctcaccacaacctccgcctcccaggttcaagcaattctcctgcctcagcctcccaagtagctggg

SEQ ID NO: 85512 - DNA, 1044 bp, Homo sapiens
aagacggcagctcatctggctgcagagtcaggaaagatttcctgagcctggactgagaggccaaggtgggtttgcggaggcaggagagagctccagatcaggaggcagtgtgggccaagccggggggcggcaggatgtgagcacagagagggcagcaacccttctacagaccagttcaattccagtaaccccagcctgccgtaggggtgggggacagcctggctgcagcggggcccacctgccagtgtgtgccttgcctgcgctccaccttccccctcgggcactgcggctttcttgggacagcaggaccccagttaaacagccctgtttcctgcccagccgtggctgccgcctcttctcggaggatttttttttcccacaactcaacaaccactaccacttgcagctaagcagaagggaagttaggactcgcattttgcctctgtagcgcctgtaatcagccccacacagcccccgccgcaggcgcccatcagtgccacttccggagactacttgagatacacctgctcacgctaaaaggagaagcagtaatccatcaaaacaaccccaggcgccggggcgggagaggctgagactcagtttcccctcccatggaacagggcagtgttgggcatctgaagtccccacgggtcctggcattctggaagaacacgactcagtagctttccccttctgggcctcggtttccctgtctgccaaaggtgcagggagatgagctcccagctcatgcctctgggcctcctacctcgcccccaccctcatctctccctttccagagacattataaatcaaacggcttagaacgtaaggcatcagaaattctgaaaccttcatctattattaacgctgacagtaaattccccctccgagcgttttacatagcaactgttaccaagactcggtggtggagctgctgctccagcggccgcatcccagcagctccgggcaggatggcagggccgccacaagccctaccaacccggccaccacctgggcactcagcaaaccctctccaggggatgg

SEQ ID NO: 85513 - DNA, 1025 bp, Homo sapiens
tgcagctgcccagggctggcgctcagaaatggcctgtgcttggtgcatgctgctctgctgttgctatcttgagtttttattactttgtgagcaagaggccctacattttcattttgcactgagccccacaaattctgaggccactcttaacaagaggattaatccctagggcagactggcagggcaccccacacatccacggtgctcaatagctatttggagggtgaaggcaggactgaatgggccttggttcagaggagaacagtaccccagcgaggccaggtggcttgcccagtttacacgccagacatagggccaggcagtgctctgaccatcacgtgaggggctgtcagggcgacggtgtgtctgtcaagggcaggaagtgggctgtgtggagtgccagccaggatgggcagggtagcctgcgccctgctgacctgcagccagacacactggggagacacaagacgactcaggttggaatcgattgaaaccaagccaagagcttgggccttggagtgcatgggagggggaggaggttcagacccaaggtggcggctgcggctggtgttagcacttcttcccggcagggtgggcagggccccattaggggaggcaggcctggatgccccccagcaccctttcatgagggggagagaggagaggagcaaggcccaggccacctggtattcagaaggctgaagtgacagtgtcaggcagtttggggggcagatgaagccgtggcaaagggtggccaggaggccagagcagcactcacagatgaggtgggattggggccacctgcatgtgtggggaaggagcccccaggactcggtgtgtgggcctctggctgacaaaggccactctgcagaaaggaaattagaaagaagaaatgatttcttggctcatgtcttcacgaacaagggagaaagttgctggcgtggtctcctcacagaagagccagggtatctgaggggagccctttctctgccagctgggtcaccctcagggctggaggtgctgga

SEQ ID NO: 85514 - DNA, 1053 bp, Homo sapiens
tgcgcaggcctccttgggacagcccgggtcggatctcagactgcagcatgtggggctgggagccagctcccccgaggcacgggggctcaagaggtctgagcagcatgctgaggtcagggctggaggagcagaaagtagtagggagccactgatggcgtcataatgaaggagcgacatgacaagcttgtgaggggccacacagggcagaggctagggacgaggagatcccgctggcagctgggcatggaatttctggtgggtagtgaaacagccagacctaggacctgtggcagtgaggatggggagggggccagatgggcacacttcaggcaggggaaccccaggacttgggggcctcctcagagaggccttacagaaggactggggcagcaagcaaggcctgtggggcgaggaggcctaaggacaccatggatgcactggagccaagccattaaggaccctgcaccccggccagaggcctcactcaggatggctgcagtggagactgaagagatgggtcgggtggagggaaatgggctttgccctcaggaggtggttgtgggaggagatgcggtcacccgggaagagaggccagaggatgggaccgaggagcagcgacacgggaggacggcagggcgggtgagcgggggggccctgcccagggtgacagggctttgctgggccctccaggaccctaggcagggtctcccctggaaccaggcggtacaaggcctgtgatgggaggggcgggaggatgagggattgctggcaggagggcctgggaccagaagtctccactgcagccatcctgagtgaggcctctggccggggtgcaggatccttgtctacctgcggggtagggagacagcctgtctcccaaagggcggtggggtggctgagcctcaaggacaaaggcaggcgggggcaggggaaggagcctgtggctgggagcttaatggccccgaaaaaaaaacataaaaccagagaattatggggagacataaacagagctgtcaggcattagctgcagggagacggctcagcctgggtaag

SEQ ID NO: 85515 - DNA, 1041 bp, Homo sapiens
cacggagcagtctgcaaaatgtcaagtgagggagagatccagtcaaagccccaggggggcctctgagctcagtcagctcctctgctgctccccacctcttgggggaaggacaggctggggtttgcatgggtggccttttggagagcagagtaatgggagcctacttgaacttcctgcggcctcattccctgactgggggcggagggtagtctgagctgctggcctggggtgcttggccgcaggggaaggggctgggagggaggggtctgggtgagtctaagggagggtgagcctgaaaaggggacggcagcactaaactgccttcggggagtccccactgtgcgcccctggcactttcccagtcccctggcgcggtcgcaggcacgggtggggtctgcctcaaagttgttggtacggccagcccgctgctgtttaaatggtgtgtttgtttagagcggcttagggagggaactggaaatggggggcgggggcagcgccccacttggcgccaccgctgccggagggtctgcgtgttagaagccccagcttcgtaaatgaccgaagaagggtgggcgttgaggagggaaggccgaaaaccaacggagggctcggggccccgggccggccgccccctttttgcggggggagagcaggagccgcctctcgcagccactctgcgcgcggggtgggagggagagagggaggcgaagggacgacagcgccgggctccccgcccccatcccacccggttccaatatttcgcagaaaggcacgcggctcctaatcggtcttttccaggctgagatttagccgtgcgatgcccgcgcaggggcgggggccgcgggccaggggaggcgctcagagtccggagccgccgagcgaggtgaggagcccgcgtcctcggctggtggagcgggcgggcgggcgcgcaaacccgagaggcagatatagaaaggggggcaggttaaaaataaccctctccggctgggaagctcgcgcgcgctctctcgcctcgttcggtgccagaggactccaggggag

SEQ ID NO: 85516 - DNA, 1104 bp, Homo sapiens
cgtctttggtgcgctttccggattggcgcagaggccgggaaacaaggcgggggcgggcgggggaacacaaatagaaggtgaaattttacctgcccctgagggagtcctgcggattttctccggcagcagcaggcgctctgcctttgtcttacacggctgaaacatctgttgcagaggggcggagaggccgcaacaacccccacacaccctgcgctgctccccgtccccctctgccccagccgggctgcaggactccaggcgccgcgttaaccctgctcgcgctggggcgcgcgcccgcactcgctgccgcagtccagcgcctcgcgtggggctcctcgcccccgccccggatctggtcctggccggggcgcccggtgacccccctccacctcgatggggtgctgaggtgtaggcggggggcgggggcggaaagggttaatggcctagtcgcagaccctaattgtcagagccggccccgcttcgtttcaattaccctaagtagagactgaatgcgcaattaacgaagtcagcttgccaactggaaagccggccccgctttcacgttgagcagaatactccaccagctgacttggacgaagcaatttcctcctctctctctccccttttttctctccttctctcttccaatccccctccctctttttctctctccttaataataaaattataccaagcagtttgcggtgtggcaggcggccagaaaagcgtttctttaaacgccgccgtctcacaattaggcagcaagaggatttgacacgccgtggcggcctgacaggcggcttcctcccctggggactggggggagggagggggtgccaattccccgctcccccaggtggaacggggactgggaggggctggcctgctgtgcctccccggctgtcagaatggctgcagcgagggggtgtcaaaggcagggaagcgaggggcggttccgcctaggctggggaaggcggaaggcagcggcacattccacgactcctctgggaagctggcgtatccaggagggagaccttgttcccctttctgtttgacagacaggcactctggggcatagagctgtagacggatctcagccctgct

SEQ ID NO: 85517 - DNA, 1029 bp, Homo sapiens
tcctcccggcagccttccctggggggcctaggaatgcctgcagctgctgtggaatcccatgttgctcccccacacctcacagtggaggtgggactgctggccatctgcccctcgtccctggactgtgggccctgcggcccaggtctcccggcctcttgatagctgtatcccaggaatcggcaccaaggatcggtggggtgggagtggagagcagggcacagctttagagttaggggacctgggcacctaggcagggggcctggctgtgcccatgaacagcaggtggggccaggccagcgggtgggcgtggttaggccctgcagggatcccattcagctggcttagcaggtctcagctgtccccacagctgggtccctggaggagatggtgttgggggctgtgaggggaggctcctcaaacatctggagagtccagatacctctgcactctgaagggcccagagcccccagccacaccagggctcccccaacctcaactgagcctggctagggctgcccttctgcttctcaccccatcactggcatcctgatatttgggacccccagaccctatagagagggtatgttggtcaccccgtgggattcttccttgagcatgggggggccatgaatgaggagggatgcatatccaagcgttgcccacagggagtggtctggaggggctgcctggtcctctggggttcctgatgtcctaggagggtcctccatctgcccgaagcaggcctctcagcccgtggaccctaacctgtcccagaagcctatgggcacccaacctcttgtcttgtgggctccttggaaactcgcccccttcctcccattcaagccaggcccctaggatatggaattgagcccatacgatagcagtgaatctggcgaacgatttctcattttcaccaagtctcctgtattgattattcatcacccacaacagatggggaggcctgaggagttccaccttctccacccctgcctggactcctcctctgccctgtcctcagcttctggagcc

SEQ ID NO: 85518 - DNA, 1395 bp, Homo sapiens
tcatggcttggagtgaggacacccattgctgtgtcaaggggaatcctgatgccctgggtgctatgtgattccagctcatgctccctgctgtgcctggcctgcctcctctgtccagcgctgagaagactaagttccaggatctgattctaagggtgaagtgttcatgtatctggtgcttagaggatgcactagactccgctcctcctgccttctagtttcagcaagaactttggagataaggcctggaccaagtgtctgagaggagaggcaggttggggagaaacggatggatgggaatgagtggggaccgtccgggcagtgtggttgagctggaccatgaggagtgagcccagtgggtggggggtgccctcccttgtcccctctcaccaccccttctccctccagcccaagccacaggccaaacccacaatctgcctgctaggccacttcttccctgcccccaggttcaaaggtcaccatcgttctgccggggccagggaggggggtgctctttctgccccctcctctcctgaggcctgcccagcccaacccaacccagcccagccctgctgcctgcctcgccttctgtgtcctgtcctagtgctcttgaaaagtaatcataatcataataattaataacaacagagcccatagcaggcctgaggcagcccttaaagaggcagtgcccccttttctcccagcagagctggcagtgggacctggctggcactgagaggcggcctgtgcctttgttcccatccctccctttgccttgggttccagggtggtgttggggcgagcatttttgcctgcattctccatcagcactgggcttctcgtgttttaattgaactgtcttttcttagcaatagatgctttcaccgcatccagctgctcgtgtgtattgggaaacctgcctgtaatacagctcggctaaattaaaagacacagcagctggaccaattaaacagggagggaggaatgcagacggacaggcagggagggggtactggtaatagcaccccctcactgtctctgtctctctttaaataatgtttctggtaatgcattttggagaatgtgaaaaaaaataaaaaataaagccgtagaaatgttaatgatatccacaggacactcagcaggaaatgagagtgatctgggactaataaaagccgaaatgtaatttgtgcagatatacgaggcgcagccttcagagtggtcctgggtttgcacattctgggctcataaacatgcgcctggggagggcagggagcgggcgctgtgccctcggcctgggcacaggcccgcctgggctgccctgtggcagtctggccagggcaggagcgtgaggctgcccacctggcagggagctgccagaccagaaccaagtgccgt

SEQ ID NO: 85519 - DNA, 1001 bp, Homo sapiens
gacattttatgtctacagtggcttggcagcccctaatcgatgtctgctagaaggaacagacagattccagatggcgtggcagtgatagaggaggtgtgtgtgtgcatgcgtgtgtgtgtgtgtgcgcgcgtgtgtgtgtgagcatacatatgcttgtgtgcacgcatgtgcgtggggacaggggcagaccctcctcagtccccagcatggctgggtcatgcttgaacacggtcgcgaagggactaaattacaggatccagcaggccccaggggatgagggagcgggaattgctctgctaaatgcttttgagctgtcaggaagggctgggagtgatgggtgggggacattggggaggagctggcaatgggcggggggggggcgggtagctccccagtgacctggcgctgggcagccggttttgcctcccgcatcagtggccgtccttggcaagactcagctgcaggcgatgtgggagcgggaattacagagcacacctccctgacacagaagttgtcaatatgcgcacagctggtggggaggctcaggcgaaggggggactattaagagctgcgcgggggagcaggcagggtggggaggtgggtgggagggtgctttctgaggcaaaaggaagtggcccgtctgaatcgctcatcctctgccccctccctgcccatcctcccctccctccttccctccctccctcccttcctttttcttttcacagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccac

SEQ ID NO: 85520 - DNA, 1050 bp, Homo sapiens
acctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggg

SEQ ID NO: 85521 - DNA, 1032 bp, Homo sapiens
ggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatggtaagaggccagcccagccagggtggggagtgtggggttccaaaggacaggcaggcaggcagtcggggagccccttgtttctagtgctacagtgtgggccaaatgtgtctgcagtctcgggacaatctgcagagtcctgagcctctctggggtgtgtgggggaagtggaggcacccatctggctaaggcaggtcacactcacctaccctgtcccaggagacttcccgccggggcccgtatgcccagccaccgccactctcccactcacctggcatcttcaggctccagccccacccagaatccactgggcccctccccatgctgtcaccggagatgccaaggcccagagaacacgaggactcccaagattgaacatcagggctgccccgggcggtgcaagagcaagttgcccaccctctgttcctgtctccattgcctctgggatgaagctaagggctcaggaagaccctctctggcgacacag

SEQ ID NO: 85522 - DNA, 1186 bp, Homo sapiens
cctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggg

SEQ ID NO: 85523 - DNA, 1354 bp, Homo sapiens
aggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggtgggcagaatcctgaccccccccttcccagccccatgctctctggggtccctccgattctgccctcaccaccctgcccaaccccaccaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagaggtgggaccggccagcctgggcatctttgggagggacactcggggtgagcccccaggcttgtgaacttggggctctggatttcctgggagctgtgtccccagctttccctctgtccatagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccgggtaaggggctggccccggcagagtgggcagggcagggaccccaggctgtgaaggtgctgggtgtcaacccttgttcctgctccctgtgcacaccatgaatctgtcccgtcctccctgtgcctagccacgcatccgcagacccccaccacccctccagagcctgctgtggacggctcttctgagctttggggcagctgctctgacctcacttttctcacctggaaaaccctcatccacagggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtc

SEQ ID NO: 85524 - DNA, 1042 bp, Homo sapiens
tctgtctatgaaatgggaggtaggatctgttagggtcttcccggccctgtcatgaggctcagaggatatggctgggagtggggaagggggcaccgtggcagggcccaaccttgctgtcctcaaagactgggctgtcaggctccgagtcactgccactgccaccgctgccactgcccctgctgccaagggacaaggggctgctctggaaaggtgagccagcatccgaggggggtggggtcagtgtgtcctccacctcagtcttcacgccctccatgagcacgtctgtgttccctccactgccacaggccgacaccagatccttcagagattctgtgggccgaaaggaacagagccaggagtaaaggctggatatgtgaccccaaatcagagcctaggcccttggaggcctagggactactgtagctcctaaagctagcccaggacgctttgatggggctgggttagggccaaagggaggcaccaggtctctttcaggaccagaggtaaccaagggactagagctgaatgcagggctacagccaagggtgaggtgggcagggcagagggtgggccagaaccaagggtggggtggggctagggatggggtggggccgggaggtggagcaaggctagagaagaggccagactggagctcaataaagccaggactcactgcttttgtggacagcagtgcgcagacttaggttctcctgcttgagtttctggttgctgtgttgcagaaagcgaatgtagtcgatggccttgcgcaagacagcagatttattcagctgcacggtgtgggagggagggggagcgcacaggtggcctgtcaggtcgggggttgtggggttggagagccctagcaagggggtgcggagctgctttgcaacattactgcctcaggacctttgcacttgttccttctacctgaaccgttcctcgcctagtagcacccacctcccaggccgggcatagggttagaatgtaagatgcagacagcagggtctggctagctgctgctgtgcctgccgccatctcaggg

SEQ ID NO: 85525 - DNA, 1688 bp, Homo sapiens
gagggggtctggccaggggttggggagggggcagccccagcccagacacacagcttacagccaagcctctcccaccctcaggtcctgctgcagccccacttcatcaaggcagactcgctgcttctgacagccatgaagacagacggagccactgtgaaggcggcaggtctcagtcccctggtctctggcaccactgtgcagacagggcctttgccggtgggtgacgtgggcagggcataagggagtggggtctacacacacacacacatgcccacctggtaacatgtgcctggccctgcagaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaaggtgtggagaggcctgcaggggcacagaccggggtgtccctaggaaggaacagatcaggggcaactggaaggaagagagggagtgagactgagcctggacaagcagggaattggaattcagcctccccaggcctggccagcctcgtttatttagttaaactggtttgcaggcctcttcaataaaggtggggctgtgctaggcattggggatgcagcaatgaacaagacagacaaaaattgtccctcaaagaagagccgaccttctggtgggggagatggacagtaggcaggatgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaaccccacaacccccgacctgacaggccacctgtgcgctccccctccctcccacaccgtgcagctgaataaatctgctgtcttgcgcaaggccatcgactacattcgctttctgcaacacagcaaccagaaactcaagcaggagaacctaagtctgcgcactgctgtccacaaaagcagtgagtcctggctttattgagctccagtctggcctcttctctagccttgctccacctcccggccccaccccatccctagccccaccccacccttggttctggcccaccctctgccctgcccacctcacccttggctgtagccctgcattcagctctagtcccttggttacctctggtcctgaaagagacctggtgcctccctttggccctaacccagccccatcaaagcgtcctgggctagctttaggagctacagtagtccctaggcctccaagggcctaggctctgatttggggtcacatatccagcctttactcctggctctgttcctttcggcccacagaatctctgaaggatctggtgtcggcctgtggcagtggagggaacacagacgtgctcatggagggcgtga

SEQ ID NO: 85526 - DNA, 1917 bp, Homo sapiens
tggccaggtggggctgaggtgggagtgtgtcccagtctgtatgaggaggaaggagtcaggacagacagcacttgcttttacagagatgaaatcaaagccctgagtggccaggcctgggtcttgaggctacttggctgcaggcaaagcctggacttgagcccagaactctacacagagacacactggttggccatgtggccagcagctggcttggccctaagccttggtctgttccactgagtaatgggttggtgatggcagcctggctcttggcttcttagtggggcaagaaaaggcagagagacaatagatttgggattttgtagacctgggtttgaaccccactgcatgctcttgggctgcttgtggtcctccctgagcctcagtgtcttttcttgtctccaagatgaggtgagctaatcttttgaggtagtctagggtagtggccagtggttggggcattggagtcaaaatagggtctggactcagttgagtctctgactctataagaacttaggccagtaagtcacctctctacagctcagtttcttcacgtgtagaatggggccaatgatcacatcaccctctcagctgtgggtgaggattaggggtctagcctggccccatcaatgtgggtagccccacagcgggcctggcttttggaccagacccacccttctgacatgggcccccacccttagagtccttctagtgtggatgaggaccctgctctgatctggggtcctcttgggggacttccctgtctgccattctctttggggatcctgcgctgccctaggaagagtgggcccaggctgcacagttggtccttggtcacagaggatcccaccacttcttcagggcctcaaggcaatcctgcctctctctgcacccctcttccccctgtaaactgaggggaggggaaaatcacccactcctcagcagtttctaagttgctttgtcaaattcagtgcccagaggatcctgctgggggtgcgttttaggatgagaccaggagtggccaatggtggggtgtggggcccatcgctcctatatgaagaccccctctgccctagactgctcctccctccccatccccatctccatcccaaagactggagctgctggatctgtggatggaggcgtgccccccgtttcacacattgagaaacaggccccaagtggagccagggaaggctgcacctgggcctctggattccttttgttctgtgtggggttgggggtgatggactgtggagagggcaggagagctgtctggaagggttggtcacctcatgggcaaatgcttggaagctggtctgagtccacggtgcagtgtgtatgtgtgtgtgtgtgtgtgtgtgtatgtgtgtggactcagaggtggatgtcttgtagaatgcatgccccatgaagacaggagtaaaagtttaccaccatccacatcaagctacaggacactcccagctccccagaaagttgcttagttctaggcagggatttcccttattcacagccgggagcagtgcctggcatagtgtgggcactcagcactcagcacatgctcactggatgagtgaatgaatgtgagcctgctgtttgctgtggactaaggatgtttctagatgtttgggcaaataccggatggtgggaagagctcaggctctgaagtctgcagtcttgggcccgaccctgggctcagccccagcctagctgtggggcaagattgtgagccttgtggtgcccaccttgtccaggtattgtgatgcactcgcagcagcaggcattgctttagacagcacaggtgctcgcaaaatggctgtatgtccgggaacaccagctcctgtgggtggctttctgtcctggtggcattgcccacacatacagctgtgtgccaacaagggttgtgcaaataag

SEQ ID NO: 85527 - DNA, 2580 bp, Homo sapiens
cagtgggatgggagggggttagagcaggaagatgagacaaataaagacacaataagaggcaggaatatgtggtaaagccaagatgggtaaggggaggggacaggcttgactgttcacagtggccctggccctgctgtctcaggctagtatctgcttgttggtctcaccacattctaggctcagaaactggggagcaaagtaatgaaagaaccaggctgggaggccatggggaactcatgcctggagttcagctctcagtgtgcttttgggtcaaggacgcttccctgtcttaagtcactcatgtcagagcctttgccaagagcaatgctgtgttttgttttgggggtgagggaacacccgcgggctgaggggagggttgggccatgctagagaggccgtctgttgtccttgaacctcccaaagctgggaaataagggcctgggctggacggcggtggcgaggacaggttgcgagagagacatggctgggttttcttgcttagggtcctgaatagagagcaaggttgaggccgcagggaccccagcccccaatggactgctgagtcgctgggtctgcccagggttcaggcaccctctcaggttgcagccaactggggtgtggaccaggcagaggcgctggcctgcagtttggggcagaggcaggctttgctggtggtctacttggctgcaaaatcaactggccaggctctgatcactttgtgtgtgtgtgtgtgtgtaacttttacctttgacaaaagagggaagacaggcccaggcacctcctcaaaagaaccctagagcctgtcaccccttccttacccatcttctgtcctagggactgcagcccttcctggcttcccagggccctacaatgaatagtgggtcgggactcacttggtgactgctgggttgtgaggccttgagggggaggggcagacttcacccatctggcagagggacatcggtgctggcagtcaggaaacccttatttccaggcctcagtttcccggaagtgacctgttttcaggagtggcctcatcccagaccatcagccccgctgtggtgaggggtggccccttcctggggctgccctagaagggggaggtccctgcacccaccgcagctgccactcggcagcccttggccttaattaaacgcttcttgcgtactaagtgctgcacccatattatctcccttctaccattcgacgccagggagataatgactgtcctgttttctggaggagtaaacggagggttggagcggttaaggctcgctcagggtgccagcgaaccagtgatttcgaacacagagttctggtgtgttgggccaggacttctctgctttgaccctttaacgaagggggcgggagctgagggccagtgaccgccagtaaccccggcagacgctggcaccgagcgggttaaaggcggacgtccgctagtaaccccaaccccattcagcgccgcggggtgaaactcgagcccccgccgccgtggggaggtggggcgggggccggggccgggccctagcgaggcggcagcgcggccgctgattggccgcgcgcgctcaccccatgcccggcccgcagccccgaagggcggggcggggcgggacctgcaggcggggcggggctggggcggggctgggggcggggcggggcggggcgggcgcgccgcagcgctcaacggcttcaaaaatccgccgcgccttgacaggtgaagtcggcgcggggaggggtagggccaacggcctggacgccccaagggcgggcgcagatcgcggagccatggattgcactttcgaaggtatttttggaggcctccccaccagccctttatacaatgcctccgtctcctgcaggttctcctggggtgggcgggcatgcgggctacgcaacttgagcaggaaagagccccttcccgagggagaaggtgtgacagttaccagctcgctggggaagtggagggctacctccaaccaaattagtgtcccctgcaactcaagggggaagggtttgcttagagacccaaaagcagcatcccgacctaagagggtttggagggagagggtggtcttctctacattctctgcacccgctttgggacaggaccaggaggaagcagggaggagggcccgttgtccctctgccacagcgtctgccctattcagcacccctgcctattgtgggcatcttagacttttcaggaagacagtgggagccctagattgtcaaaattgtcagtttttctttcaggcctcagtttcccccatctatcgaagaggctcacacggactggggtaaagggatgggaaaccctgcagttgaaagtccattatgacttgatgacttgtgacctggggggtccacaaaccaggagagtttctacttgagaagccaggaagactggggctgccaccccatcctgttctgccaactgctctaggaaattcccctcctgcagtagcttccctgcctgggtacctgtcagtaggcaatgttgggtctccactcggtgccagctgcctgccaagcaaagcctcgggcagccgtaccaaaaggggtttagtcttttctgtt

SEQ ID NO: 85528 - DNA, 1075 bp, Homo sapiens
tgaggcctgcccaggatttccctcatggcctcacagaatacatcggccagagtcattaaagggcgcctgcatctgccttcagagagaggtttgaaggtagaactggggagggatgccaggtgggggttcaggtttcctgttgggtcctgatagaatcagggcaggagaggaagaagaagagggaagaggaggaacccaggcttggggaggggtggcagggcttcacaagcctggggaaggtgaactagggagcagttggggccaccatggcccagagtctatgcctcctcttccttcctgtgttcagagtgtgtgtgggaaccacaagggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtgcctcagctgccttactctagactggccccgttaactccccttaaaaaaaaaaaaaaaaagactcagtcgaatggtaatggagctccaacgtgaatactgcaagtatcaggcaactcactacctgactttccagttctaaaccattctaattgctgtagagagaactaacctttgttgagactgttgagtgatggatgttttacacacttgctttcccagaattcccacctctggagatcgtaggtgtgggagctcagagggtggggagtggactgtccccatcacacagcaagggaggggctaaaggaagagcagggcctggcatgcagccccagatagcccacttgggtgtgtctctgagggaggctgcagggctggctctagagtttcctttttcagtcttaacctggtgaccagcttccacagaaattggcacggtgactcatgcctgtaatcgcaacacattgggaggccgaggtgggaggatcacctgaggtcaggagttcgagaccagcctggccaacgtggtgaaaccctgtctctactaaaaatacaaaaattacatttcattacaggtgtggtggcgcacacc

SEQ ID NO: 85529 - DNA, 1001 bp, Homo sapiens
acattcttaactccccagtaagtcaaagaaataatgagcaacacagactcttcctaatctgatcagtgactggcttgggcctttctgaaagtgctcttgtgggcttcccacattgggtccgaagttaggacacagagcacattcctcagagcaaggggccagctgagctcactgagggagtgaagagctctggtggcatcgtagatacctgctcagagtgctggactctacctgggaccccaaaccaccctcccccaccatcagcagcaggtgtcaacccccaggactggagttgtcacatcactgctggtgatatgtgttctttgttctttttctttgtgaaggtcgtgttattttttacatttgatagacactggggtatgcattccttttactgcttatttttactttagtcttaccctagatcatggcattgggtgaagccagctatagacagagctggcatttttgtaatagaaataggggtcttgcaagtgagccccggaagggtacctcccagagccagggtaggtgaggaggtgattaagggtcatcacctcatttctctaggctgggagccaacattccattaacatggcttctagggagcttcttatcatgtcatatttgatggcaacttaaacctttttagccatgtgcatttttcagagtctctgtccctgaggtgcttggcacaggggcccaagcaaggtgactgctcaggcaaccccgtggtacaccttagtatgcctggaagctgtcacctccctggctctggctgctgcgccccagtgctcagctgaacttggtttctttgactcctgaagcacagccagccattgaacacagggaagaaaggacgagactaaagggagctgttgctttcagggctgcttcatgaatttcccctaaagagacacaaagaagactaaagccccatagtcccctttgtcatcagagccctcgtttttgctgtgtttctgttgatggtaaaatgtgcc

SEQ ID NO: 85530 - DNA, 1189 bp, Homo sapiens
ccctgaggccaagtggcttctatattgtaatgagtcagtttccataatttctgacatccctgggtttctgaattagaaaacagaagcaccaacctgaaagttaaggtttctgagtcataagaattgaaagccaaatacaatctagcaatcgccttatttcacagatgaggaaattgaggccaagcattgctcaggcctctgtcccctgctcctgcctctccacccaaatctctaaggcttcttaggatagaagaaactcaggagctctccggtgaagaaagtggggtccagagaggagcgactcaccccaggtcctgccaccagtgagtgtgagggcccagatggaccccacccagtgcactctcctcagcgtgccctctagggcttggtctggaggatgccattccataaacatactacttatttggaaaaatctaggacatggaagaaaagggttcccatgagccagcttttgggaagttatttttgaggaggtgaggaatttcttaagtgtcattgtttattttctgagcatgttggctctcaagatttatccccaaagaagaaaattaaagtatgaccccaggcctcaagggatttgttctttagcagcaacaaaacaattacaagaaaaatctgaaggtttaaggcccctgaccccttaatgtctttgttgtagcttttgcaacacattggaaagctcaggacatctagtctgtttctgctaagtggacaaaagctggtcaggtgtaaagaaagggctggtgcacactctaaccgctagtgtgggactattttctctctggagatgctgctgactttctaagcttcagttttggggactcagcatggcatgcgtcctcccagaggccacacattctgacttacagtcattgagagcatgataactggtgtgtcctgttccaggaatgtctcaaggcagaaggcctgccagcaagcacagagtagcagtgtaccctactgccttttgatgggcaagggcaaggaagtgccagccttaggcattgttaacacatctgtcagtcatttgtgcgtccatccccccagtgaggacccacatgcctcctgtccctaggtttcatgtctgggtgataagactccctgataccttttcaattcaatgttcttttttttttttttttttttttttttagacagagtttcagtc

SEQ ID NO: 85531 - DNA, 1020 bp, Homo sapiens
gcctagcagagcagtaccaaccccattagaaggcactcgagagccagggtttgtttacagagctggtgcagttgggtggtggctgggagggtgtcctgtggcggtgagggggtgcggcacagtgaagtggagggaatggtatgtgtttgggcctccccaaacataaccatgctttctgtacaatttcggattactgaaggggaaagaatgtgtgtcttaatgcttctcatgagatttttgtttttgcctaacaaagaaatgtgtatgaatgcacgtctgtttgcaggggcagggaggaggagggtccttggaatagctgccgacaacagctggaactcctgtctgggtcccccagctgggctagagagggcagtgatcatctgtccactggacaggaaggtttgcaaagggctgtttgcttactgggtcccaatttttagccttctgaagcccctgtccaatgggcccaggcaggcagcagtgctggtttccacgggatgctccttcttgggggaagggactcactccctcatccatgctggtcttcacctggtggatctgagggcatgcatccctctgcactggtcaccagagggcgcagaagagccagctggctgccttgggtcctcagtgccgtgcctttccacaggagtgggcagtgccacctgaacccctgagactgggacactcaaaatcaatgcagtgctcatggctctgattctcccattacttagaatgtcctcccacctgccccagcgtgggcattagagagcccagccaggggcctaccaggatactgcctggtgaggacatcccctcctcgtggccaaccctggcctgcactgggagcagccctgttgtgcccctatgaggctgacctcatttgtccctcactctgggtccaggacctgccttgtccatgccagggtgtgtcctgctgcacccctgccattatcagcgcccaggcctgggtctgagcccaggagatgtgagtgacttcccgcccttcaccctttgtgt

SEQ ID NO: 85532 - DNA, 1036 bp, Homo sapiens
gttcccaccaacagaagctgctcccagttcaagtataaattcctggggtaggaggtggggggaataggaagagagataattggtggtgtcagccctaggatgatcataactgtgggcaggttatgtcccggttgcctcctgcacatcgcaaagcacttttgggtgtagcttcccatagtgaagcaagagcagcagggaagcttggcagtgtgagctgtttgcctgcagactcatgggtatgtggctgtatttgaggagaggctgaggccactctagcaccctgtgctgtcagcgtagctggagcgcctgaggagaaggaaggaagggtgcccagagtgaacacagcaactcctcctcttgagctatgcgtcaaatcctccactctctgagttgggagagaccttccaggaagttggttcagttctacacctgtgttcagatttcttccacagcatcttatctgttgggtctttctgcgtgtccccagtgacaggctgttcacagcagccctcttgctttcaaatggacatcttggttagacttcgggcagcagcacagcaggcatacaaattacacaggcctatgaattaatgcctccccatccttgccctcccactgatgagctgggcgatgccaggtaagtcaccagccgtctccaggcccccttctcctctctagactggagtgatcacttgcaccttggcagtgcctggcgcagggctgggcttaggcaaggcctcacaaatcctagctttcgtgactattgttagaaagccctttcacacattgatctaaggtgtggctccctataactttgatcctggtctgtcttcttagacactagaacaagactaattcctctttcacatgggtagatccttaaatatttgaagattgccataagccccacccactgcacagtctccacatggaacaaatgtggcatttggcagcatttggcagcccaccacagggagggataggcagttcttcacaagaagcagacataaaatggagagcttccatcagctgaaaa

SEQ ID NO: 85533 - DNA, 1517 bp, Homo sapiens
aaggcatgaagtggtgccaggaagaactgccatgtgttttttccccagcctccgacagtgggctgtgaaactggtttttagaccctaaagtcaacaccctaaactaaaatgctagggcattttgaggttggcgtcacaggacttagctggattttgaaccaggtggaggcagccagcgcagctggtgggggcggggccagaggcactccctacgggcaacctactctcctccagctgggccttccagacagtgctctgtgaggcactttctttggccctcctcagaatccagaaggagtgttggccaagaggggctgtcctgatccagtagttttaaatccctgagcatgcaaattaaataagtgcatcagggaaagccgggctgacagtactgttcctggtgagatgcatcagtcataattaaggaggctttttggaaactgaccttttaacttcaaatgggtctgttggttagagacagagtttctgtggctgcctcaggattggttgtaccacattgctggagtgagggagacagttaaattctgtgacaatgacagacttggcaatggagtcatgggcacaggaggctctgcctcctcctttgggtatgtatggtgaatgggacagcatgagaagggccatttctgggaaggcctttgagtattctgtttttgatacagtccaagacttccaaagaacagaatttttttttttttttttttttttttgagacggagtcttgctctgtcgcccatgctggagtgcagtggcgccatctcagctcactgcaagctctgcctcccggattcacaccattctcctgcctcagcctcctgagtagctgggactacaggcacccgccaccacgcccagctaatttttttgtatttttagtagagatggggtttcactgtgttagccaggatggtcttgatctcctgacctcgtgatccgtccgcctcggcctctcaaagtgctgggattacaggcatgagccaccgcacccagcccagaattttttttttaatttttaagtttcatgagtcaacagaaatgataatctacttgaatttttgctctttcctctctgtgatatgttttcactgaagggaatctggtgattgtgcttttcttgggatttttcgatttgggcacacatgtgctgacatttttggcagcggacatcatgaaagaagcttgggtctgggaaaaggacccctgggggtgaactccccagtctggcctgggtctagctcccaatgggctcttcttcccttgaaccacagtcatctcacctactggcagcagcgctagacagagctaggctagacaagctcagcattagttgtctctgatctgaggaaacctgtagttagcctttacttcatgtcacacatcaatttctcctttcctttctgctcaatttgttgccggttcccaactccaccagtagaagctttcagggcagaggtgctcccgcacagagggcaggcaccctgctgagctgacaaggc

SEQ ID NO: 85534 - DNA, 1092 bp, Homo sapiens
cataaaatatctagtcatccaactgacagtttaagattccctagtgttttctgtggccattctcacgaggccaaatgtttatttgctccaccatgttcttcagggaatgtttcccttgatgtatcacattgaggttgagttctttatcaagaaaggtctgcatgcaggtcctggcctcagaaagagatggagggaaagaagaagggataaagagaggcctctctccacagcctctgcagctggcctcatgtggtttgcgccacatagggtggtaggttctctctgcccgttactcacatggtaaacccagctgtgctgctttatccacataccagcttgacttggtacagtgtgctgaaaataatgtcgggcctgtccctttggactccacccccattgaagaatgcagtttcatgctgttggtttttttagtgctaaagaaactagatagatactgtgtttatttttctacagtaaaaatccgaaaagctaggaaaatgcctattccctgttggattttgatcttatttgcatgtttcccttggcaagctttgtttcgtattattcaaggtgacccacttagaactactgtttaaagtcacattgtcattaataagttacacaacctgtgtgtgataagtctgttagccctgaatattgtataaacaggaatacatgcttgtgttggggctcttcttcatatttaaatatggttacatttctttttctttttctttcttccttttttttgagacagagtccctctctgtcgcccagacaggagtgcagtggtgtgatccttgctcactgcaacctctgcctcccaggttcaagcgattcttgtgcctcaacctctcaagtagctgggattacaggcgtgtgctaccaggcccagctaatttttgtatattttgtaaagatggagtttcaccatgttggctggtcttgaactcctgagctcaagcaatccgcccgcctcggcctccaaaactgctgggattacaggtgtaatccatcacaccaggcccaaatatggttacatttaaatgtaatcttccctgtttgttctcactgttgatattcgtgaccttt

SEQ ID NO: 85535 - DNA, 1340 bp, Homo sapiens
tgtggtggtggccctcaaaatgatgcttagggggcatcagaacctcctggggagcttggtgaaaagcccatgaggccaggattgatgggggtcaagggaaagaggccccaagggaatatgaacctcatctgtaattgcagtagacactgttccacaggctcccaatacctgttcctcatttcttcttttctgacggagtctgattttgtttggattgcctatgtgcccagctatattctcttacttagtttcccttgcagctaggggtgactgtatgacacagctctggcctatgaacaagaggcaggagctcctgaggagagcacctcttcataaataagatggcaaagtcctttggccctttcgtgttcttcctgcctgctttatagactgccaggtagagcagtggtgccttgcagctggaaggatggaaaggagggaagcctcaggccaaggatggcagaggaagaagacaaaaagttcctgggtcctttatggaatccttgagtggattccataaatccactccagctctatactgcctgcttctagatttcttcttgttccctgagaaaaataacccccatctgtttaaacgactgttagttttttaattgcttgcagctgaatgcaatcataactgataaggtaatgttttaatattttacaagggggaaatgtatttacatattgtgcaattaaaaatgaaaaataatttaaatccccacagatttctgggccccacatcagatgcactgaaacagaatctttgaatctttggggatgggactcatgtagctatatttttaacaaactctacagatgattcgggtgcacaataaaatgggagaaccatttccatatttattaatagtattaactccattttatagataagaacattgaggcccaaggagttgaaacaccttaccccaatattttaaagtaagatttgcatgtagttctgtctggttccaaagtacattccccaccacatcccatgcctgctccagagaggcctggctttcccccaacaatacagccatgctacttctgaggggaacttctaaaatagaagattcaactgtttgtaaaacagttttacactgctgcccagggacaacattaccataattcatctatccccaggaaacaaagggacgtatgttttctggcatgtttgttaaaaaagagggctgggcacggtaactcatacctgtaatcccagcactttggaaggctaaggcaggaggattgcttgaggccaggagtttgagaccaacctgggcaaagtaccaagactctgtctctacaaaaaataaaaataaaataataagaat

SEQ ID NO: 85536 - DNA, 1007 bp, Homo sapiens
ctgagagcacatgataccagcaggtgacgcaaagcctgcatgacttggggtcctcaatcactgggaaaggccctcccccactggtgacacaaaaaggcaggaaagaacctttgtttcatctggttcatatgtgacagccttcatttgctacagatctttggccctcaccattcttacctgtgaaagtcccctaatccgagcctgatgggacccaggtgtgaggcattgatcatggctggttattcatcaggggtggatattggcacacaggctaccatttccttattggttgactctgatcaaagataaaaataaaaatgtcggtgttccttgaataggattacagtagaatgcttgttacaaaaccggaggagggaattcattaggcttttatgatcatcacttctgtgggaggaagggttcatgttgaatagcctgccagataactctggaatatgtaccactggagtagggacaatttgccaggcattgctctcctttatcctttggggctgcagggacagatggcctccagccttctttctgctcccctggcatttgtcacaacatgctatgggtcaggagaccctaagcagaaagatcgtgggaggtcagcacggcagggtacaagaggccagttcaactctgagccctcatggtatgaggcagctttagaacaatgtggaagaatcaaagaggttgaacttagactgttaaaaagcctttttcccctgaaaatttgaaagcagaaagaaatgtagagaagtagagaaaaattttcattatcccactacacaaaggttactactataaacattttggtgtattttcttcctgtattattaaaacatttttctttacagagataatgctgtaagtacaattttgtgccctgtttttcccacttaatatagaataatcatttttaattaaaaaacagcttataaatatcattattaaatgactacataatattcccttatgtggatgaatacattgcatttcat

SEQ ID NO: 85537 - DNA, 1032 bp, Homo sapiens
agatttaaaagggaaggtgtacatatcggcccatacatatcggcccataataagatcttaatacttagtaactagtattataaatgtcctttaaattgatatgattttctggttagtatagtaatcctgcgaagtatatagtttttaatccccattttacatatgatatgattgagggttaaagccaggattaatgaacttgcctgagatcttggggctaatacattacagagccaggagtttgagcccaggtctgcctgaccccaaggcccccatccttattactgctatttattaatggaaccttgcaatgtggccttgtgaaaaagaacatgctgatcttgggtcaggcagatcagggtcgtctggtccttacttttgtctgctgttttcagctagtgctggttttttataagctggtgaactggattacaaattttccttagactcctttgtccatatcttctgccttctttctgcctctcgttttaggagctgttagttctcataagcccctgtaatggagagaagtagagagaacagaacattcaaataaaaagttcatgcacatcagctcttttgtgctacgtttttgtgggaaagtggctgagacttttgtattttagagatgaggtcttgctgtgttgtccaggttggacttgaccttctggcctcaagggatccttccaccttccctccctagtagcagggactataggtgcatgccactgcgcctggcttagaggctgaaactctttaaggcaaaatgaggttcataggttatctgtggatttttgtttttcagtcagccgagttagtgaggcatggacagggcttatgtatccatttccactgtaaaattgctaagaatggatcattggaagataataaatgtggcagagccagaaatcaaacccaggcctgaccaactcactgcctggctggttccattgttccactctgcctttagggacgggcaggtgagggacccacagggaagacttagactgcccgtggatatctcctcgtggc

SEQ ID NO: 85538 - DNA, 1113 bp, Homo sapiens
gtctgggcaacatggcgaaattccgtctctacaaaaaaatacaaaaattagctgggcatggtagcatgcacctgtagtcccagctacttgggaggaggctgaggtgggaagatggcatgagcccaggaggcagaggttgctgtgagctgagattgtgccactacactccagtctggttgacagagccagagaccctgtctcagaaaaaaaaaagtcaagtaccttcctcaaggtctgtggattatcagtggcagagcagggatttgaacccaggtctgtgggcagcagagctggtgctcttaaccactaaaccagagagcttagtattgtttgtgggattgagtgaatgaatgcctgaatgaacttggtagctgaaaaatctagtaatagttgtcttaaatccagacctacactagtattgtaaattatgtactcagtttcagttttcctcctgtaactcagtgtacaagtgtcctcttcataccagtaagttttctgagaatttcctcaaaggacgtgctttcttatatcctcgctgaggcacttcttagtaatggaagacctgtgtattttactttctctttggatttgccttagaactacagtgatggatggaggaaaagacggaatttaaacacatgctaaattgtctaactgaccaacttgcttttaagacatcaccagctgctcttttaatcattaatgaagcataagccttgtagtctgggaggcatgtcaaaaattctgtttcgggttttggtttaaaattgagtgtaatggagagagactgattctttcatctcagagaattgggctgtctttgagagctggggacaagaactgggtcctgtaataggacactgtggagttttttttgctgctcctcaaaggagaaatcacacagatttctggcacgtcattagtcgaaataggaaatgaggcctgagaaatgatgttgcttggggtttgaaagctgaatttgctagtggcttccagagagcgagagtctcctatgctaactgtggaaattcttaaaccagcaattcaaagaatcagaagactctagttgaaagggtcttagtggtatttggtccaaccctctaatttttgcag

SEQ ID NO: 85539 - DNA, 1030 bp, Homo sapiens
cacttcatcacccaggctggagtgcagtggcacgatctaagctcactgcaacctccgccccacaagttcaagcgattctcctgtctcagcctcccaagtagctgggattactggtgcctggcaccgtgccgggctaatttttgtatttttagtagagacaaggtttcactaccttggccaggctggtcttgaactcctgacctcgtgatccaccctccttggcctcccaaagtgctaggattataggagtgagccattgcgcccggcccaaagactacgttctttaactgacttcaacttttagtctctttggacctaattttccctgcttataaaataatacttctcaacagctgcatggggcttacacctaaataattttgtctgttcacttcagtaggcagttatgagtgcctgtggggggccaggcctgtgccaggctctggggatacaaatattaacaagctgctcttagggagccttcggtagaggtaacatgctcacaaaaggtgtcctgggtctgtctgagcggttggtggagtaattcttactctgtcttatgcgtgggcctcatgtgaacattctaacctggtacgatttagtagaacacttagcgtgttcatctcaagttagcggctaagaccacagtctgacatagttaactgtgcatttcttgcatccatcccgccctttattctggagggcagttcctgagtagaaagcatggtttagggagagagtaagctggacaggtgcggtggctcacacctgtaatccagcactttgggaggccgtggcgggtggatcacctgaggttaggagttcaagaccagcctggttaatgtggcaaaaccccatctctactaaaaatacaaaaattagctgggcatggtggcacgcgcgtataatcccagctactcgggaggctgaggcggaagaatcccttgaacctgggaggtggaggttgcagtgagccgagatcgtgccatttgcactccagcctgaatgacagagcgagactgcatctcca

SEQ ID NO: 85540 - DNA, 1063 bp, Homo sapiens
ttggctaacacggtgaaaccccgtctctactaaaaatccaaaaaaaaaaagaaaattagccaggcgtggtggcatgcgcctgtagtcccagctactcgggaggctgaggcaggagaattgcttgaacccgggaggcggagtttgcagtgagctgagattgtgccactgcactccagcctgggcgacagagtgagactctgtctcaaaaaacaaacaaacaacaacaacaacaacaaaaaaccaaatataagagatatagggatatatagcaagtggaaagagcttgatacttctgtcagggagacctaagttgaattttgacctggcccccatttcttggctgtgtgaccccagaaaattgtgttgctttctgaggtttagtttgtcagtcttctgagagagagagagagagagagaaagattcctattcacagagtaatgtagtttaaatgagataatgtatgaaaacacttagcatagtatctggaacatagtagaagctcagtaaattgaaactgccactgttaataacagaatatttaagttagggttggattttctatctggagaggatatgtgaaacaactggcccgtctgtgacctgtgaaggaaaataccctaccaggccccaggattcaccattgctcataagatgcttgactaaagatgatgatggctccccactgccaggtagccaataggtcatttcagttcagttcaggtaaatgattaatggacagaattaggttctaatgtatattccgtactgttgtgacaaagtgtcaaagtgactttcttgatatttagtgttgttagtattcttttaaaagaatgtgcgggggtgggggattggtgggagggagggggaatacagaaataaaataacaactacaaagctaatgattaaaaacagcagctgtaggctggttgtggtggctcatgcctgtaatcccagcactttgggaggccaaggtggtggatcacttgaggtcaggagttggaggccagcctgaccaatatggtgaaaccctgtctctactagtaatacaaaaatgagccgggt

SEQ ID NO: 85541 - DNA, 1020 bp, Homo sapiens
acagtgtttctcacagttgtcctgggttcagggccaaggcccaaacagtcctcttctatggggatcttatagtttaccacccaacctgggtcccctttgacttgcctgatgatagtgttgttgaagaccagagaggttggagctggggaaagcagcagagttttacacaactgtcaacggagtggcctcctcacagataacagatccagaattttcctgggaaatgataacctgaagtcaacaggatctgaaaactatagtccctattggccatgaattaataaggagaaaattggttgggcgagatggcttacacctgtaatcccagctctttgggaggccgaggtggaaggactgcttgagttcaggagttcaagaccagcccgggcaacataggaagaccctgtctccatttttaaaaataaaaaataaataaataaataaataatgaacaaaatttttcttaaaaaagaataaaatcaatcacttactgaatgcttactgtgtgctcagtgcacatgcattatttaagtacatgtaagctccggaggccataaaaagggagtcctaatgcccttatttcccagctagggaacctgaggctccagggaggtaaaggaacttgtccaaagtcgtacaatgagttactgacagagacggatacagaacttgagtagccgtattcacatccaaagcggtatatacagtaccaagatgaaatcatttgatagttatgaggtcagttatgatggctaaattctgggaaaagttatcagtggaccgggtacctctctttctatgaaaggaggctggaagacggaaccccttaaaaatccattctggccctgctccctcgggaaatgcttccttagtatttttttttttttttattcaaaagcttgacaagcccaggactaaagtgtcttggctgtctcacacgactgtaaagtggctgggagaggacctacgtgctcattttataaatgagaagggccgggccggcgttctccgagaaaaagg

SEQ ID NO: 85542 - DNA, 1110 bp, Homo sapiens
cagcctgcccagtggtgggtgggcagccactggccctgggcctgggcctggactgcacttcttccagaccatccatgccacagagagcacaggtgcctgctccggctccctgggggtggggtggtggggtgtgtgtgtgtgtgtgtgtgtgtgtgtgtgtgtgtgtggtgtttttgagacagggtcttgctctgttgcccaagtgggagtgcagcggtgtgatcttggcttactgcagcttcagcctcctgggctcaaagcagtcctcctacctcagtctctcaaatagctgggactacaggtgcacccccaccacacccagctaatttttaaacctttttgtagaggcgaggttgcaccatatttgcccaggctggtcttgaactcctggattcaagcagtcttcctgcctcggtctcccagagtgctgggattacaggcgtgagccaccgtgtctggcgtacctgggtgttcttacctgccacctccccctaggcatgtctcatgtgttttggcaagatacaaacctgttgccctcagccaacctattggaatggaacgtggctttggtcaggaggcagccaggcactggccactcacccagcaacttgtcttgtccttccctcagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaatgtgctgagccctgttttcacgtatgcctctgcacttctccattcttcctgttttgt

SEQ ID NO: 85543 - DNA, 1004 bp, Homo sapiens
ccccgcaggcagtgacagggtggtttttgcctttgattcagaccacattgtgcaacacatcattggacaacccaacccagagaaacaaggatcagctgatccgggcagccgtgaagtttctggacaccgacaccatctggtaatggacatttagatgggcattccccttggattgaggctatttttcctgatttgcccagatggttatcagtggaagaagaaaccctctccatttattgcaaggacaaggaaggtggcccacttgactttggcacttggctgctctgtagccccttaggaggaggactcctcgggctacaatggtgtcagaacatggccacccctcttctctagcccagaagctgctccttaggctgggagggtggttatgcagctcttgcaggtgccgtgaccacaggccccttaggcctaggggggcctgtgaccttaaacttctgcccaccgacactttctcaggtaaagcatccttggcactatggatgctgataactaggagtgtccttctccagttctgaattctcctctgtgtctatgtttcttggctaattgttcagtgatgccaaaggaaagttgagaaacaatggaaatgattgagcagcaccgtgcctgctagcccaagtgctctaggatcctgagtcatctcacgatgacacaggaagtcagcactgatggctggaggcgtgctttcgaagggggtgacccatagctagtgggaacgcccactccatttatattagggttcacttgattgcagggagcagaaacccattcaacctagctcagacaaaaaggggattcttgaaaactatacagggatcctgacaggaaatgaaggacagttgggtcaccaggaaaggtagctggaagatccaatgtcagagctcctccctgtgccctactagggtgagaggaaggtgagggaggaaaggctggttgtccatctgcccctcccagcaccccagcttttcctgcataactcatga

SEQ ID NO: 85544 - DNA, 1109 bp, Homo sapiens
cttgaaggaaatgtttggagttcctgttggatacacaagcaagctggttaattaggttaattaattggagagaggggatgggaaatgcccttgggagctctgtatcctgccgatgtatcacacacgcacaccctgcgcacgcacactggctttccactcactccttagaggcatcagagtcttgcctgaaatgggtctctagctttgtcccactcagacaccgactttaggtttgaactcgttgtgctggcatgaggtggcactggtggtggggagggtgggagagcatgccgagatgctcctgatcagacttgtccccaggctgcggggctggcagaggtatgaccagcatgttctgttcctcccttctccctggagatcagatgttcccttcccccagctttaatcagaagcggttgattataccgtgttgagtagggcagaccttgaatggggatatgaaaatcaagccaatcaatcaacattagcagtaatgatacaagctggtcctgtcgcttcctgagttgtctcaacgttattttaaactgcctctttgaaaaatctttcttacagaaaggaagaggttttatcagaatgtcagcatcacacagggtgaaggtgagtgtctgaaattttgactgcctctttttttttttttttttgtgaatggttgggaacatttttcatcttcagctggtttcatggtgcgattatccttcctgctttttgtgagatatatttctgtaagggactcagagttggctttgtctgcaccaattcaagtggctaaatataggaatggtcacttgattccacttaacaaatccctgagagtttttcatttgatctttcaaggtggctttgagataaacctggaccacaggaagctgaaaactccccaagccaagctctttaccgtccccagcgaggccctggccattgcagtggctactgagtgggattcccagcaggataccatcaagtactacaccatgcacctggtaacaagttcacagtgtgaacctggaccctgagacccacccagggcttcgtagggtagaccctttaccaaattccgacaaggccctgggggctggtcctttgcctgt

SEQ ID NO: 85545 - DNA, 1051 bp, Homo sapiens
acttcgtctgggttacaggcagactctctcagaggtttgtggtgtctgtctgactgttttccgtgtctccactgcccaacacaagacctgcccagaagggacctagaacctgggccttcattcctccatcccgggcacttctgctgcaggtttcctgactttccctcctaccacaacctctgccatctgcagccttctctcctaaatagaaattgacacctccacctctgactgtggagtcacctccacctccaactctgatgaagcttagaagtagtggctctttcattgctgatggtgagtggtgtcagggtaagagtgagaatgactcatttcagtgaatgaagagcagtaacaccctcccaccattcaattagttttattgtgctggaggcaggaggcacggttgtctttaagacccacctgtatgtattggtagagaagctcaattaaagaagaaaaaggcccacctgaatgatgttcactgttcattgcaaaaggttataatattctgattaaattgtggtttataatatcctgataagggacatacaaagaaactgtgagaacacagagaatcgcttactcccatcttggggatgttcagggtttagaatgggtcttgggtgaaagggcgtttgtttaagctgagccatgatagatgagtaggagttcagcaaaaaggtgggagagtgttgggtatctagaacgtgtccagggtgacagcaaggtatgagggacttttccctgacactgcctgttttagaaaatccagaacttcacaggcagtttggcattgtggcaggagtgcaaatctaggatctgatgctggctgaacctctgaggtctgtgtgatcttgggcatgcaactacttcctcatttttctccatgcgttgaagtactaggttgcctttgaggatctttctggctgtcaagttctttttttttcttcttcttctgtttttttgtgtttttttgagacggagtctcctctgtcacagaggctggagtgcagtggcaccatctcggctcactgcaacctccgcctcc

SEQ ID NO: 85546 - DNA, 1035 bp, Homo sapiens
agccgaggagggtggcggggagggagaggccggggcgcgcacgcgcggggtgggggcgggaggggcgaccacccgcccgctgcctgcggagcaagcgctccggccgccaccgggacccagggacctgcgagcagggcctcccagtcctgagctgggtccccctcccgacttgccctcgcgcacacatacacacacacagacactcacagacacacaacacacaaacacacacagacacacacacaccccgccccttccgattggctcaggcgagcctggggggcgggagcaggctcaggcggcgcttccgcccattggcgggaggagaaaacacgtggcgcggtgcgcgagcggcccgctgggacttgtagtctcctcgccgaggcgcggcgtggagggggcggggcgaggtgcgtttgtgatgctgattgactgggggtgtgcgcaggaggcgcgcggcggcgacggcgcgccgtaggtgtcatgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacaggtaagaccatgacatgttcttttgggttggggccgagctggggtaaggtgggcttcgggcttcggctgtgcaaagcgaagtaactgaggcagggttcaggctcatgaggttatgcaggccagtcaggtctttttacagatgagaaagtgaagcccagacaagggcagacgacccgagagggaacagcgagtcacgcacgatacagtaattgatatttggcctgtgcaggttttctcaaagcttatggctgccctccctttaata

SEQ ID NO: 85547 - DNA, 1029 bp, Homo sapiens
cctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcaggtgagcgccgggccgggccggggcccgagggcctcctcgcggcgctcacgggccgtgcccgcttcggctcctcgaccccgcagccgcggaacaggccctcgccgccggggcctcctgcacccggcgcttcccacccgggaccttcccagcctgtgtctcacactctccgagccccagccctgacctgccccttcggacccagagcccgtcgtgaccggctcctggcggaccccgaacactcccagacttgaagcccgtgaccggcccgtctgggatccggaagcccctcatgactcggagaaggcctgggtccttcctccccatgacctgtcgtccctagatcagggactgccaccagcccttttcagaccctgaagaactctccattggtttcaccagacttgggaccctccccatgtctgggcccacgtcagattctctcagacctgagacatgtcctcctgccccttcctcagttccaggaa

SEQ ID NO: 85548 - DNA, 1087 bp, Homo sapiens
gttgatggacatttgggttgtttccacttctggctactatgaataatactgctatgaacatttatgtacaagtttttatgtggatgtatatttcactttggtagataactacctgggagtgcaattgctgggtcacatggtaactgggttttaacattttgagaaactggccctgcattgttttacatttccaccagcagtgggtgagggttccagtttctccacatccccgccaacactcactgttcatcttttttgttgtagccatcctagtgtttttgaagtggtctctcactgtagtcttgatttgaatttctataatgactgtgctgttgtgcatcttttcttgtgtttttgttgttgttgttgttttggagtactttcttttctgtgattctagtgtaaagagttcctcaaacctttgtgagtttctgactgggtctcctctccaccccgcacttactgtgactcctctttcctcctctgccatctaagaagccagcagtagaagggagccctggtcgctgtgaaaggaatatttaaaagaacagccgttggacacagctgtgctgtgacaccttcttgctaaacacgtgccctgttatctttcttgagatgctcgcctgccgtttggtaaaagctgtatgcgttgtggtgtatttgagttcaccaaccattatcaagatcaatttgggcagagtagagagacgcttggttgaatggaggccaagctgaaattctgattcttgagcatgtgataatccatgcaaaatgttagccaatttacatttcaatttttaatcttattagcaagtatccttgccacctgatacacttttcagcagctgtgaaactccaaactatattgaattcaatgagaattgcatacatgaaatttaaagactcaggttagaattatgtgtcctttaataaaagttctttgctgaaccatgttagcgtggattagctgttttagataatgtccagtgccaaggtcagcagatgaggatatttaaaatgctttggcagttttcacagggaatacctttgtcaccagcaccaaactgtgaaggcactttggcttcat

SEQ ID NO: 85549 - DNA, 1419 bp, Homo sapiens
ataaaaggtattttaggctgggtgcggtggctcacacctgtaatcctcgcactttgggaggccaaggcgggtggatcacctgaggtcaggagttcgagaccagcctggccaacatggcgaaaccccgtctctactaaaaatacaaacattaggtgggcgtggtggcagccaactgtaatcccaactactcgggaggctgaggtaggagaatcacataaacccagggtgtgggaggaggttgcagtgaaccgaaattgtgccattgcactccagcctgggcgacagagcaagactctgtctcaggaaaaataaaaaagtattctaccccagaatccaccctggaaccttggagaattggtgtaaaagggacaaatgactgagccagttggagaaccagtggcttgagggagccttagtggtagacacagtgattttggagcctctttgggtctaaccttggaaagtaaaatctaccaagttatgatctgctttgtatgctagaatattaaaaatttatttgtggaaacatccaaattattttctaagagactagcatgtaacaattgaagtcaaagaagggctgtctgctgctggcaaaatccaggaaacccttcattctctgggtgatttagattcaggtccattgccacagcctgttggcaaactggctgcgatctaactctggtttggattgtcaggtagcagtgtctaggtactggaaagaagttaaagcaaagtttatttttcctttgtacaaaggttaaaaactctcactcaacatcttattttgatatttgggtttttaccataggagtatccaacccttacaaccttcttcgaaggagaaataatcagcaaaaaacaccctttcttaactcgcaagtgggatgcagatgaagatgttgatcggaaacactgggtgagtaaatctgatctgtgctgggtcatctaggggctgctagagaattgaagaaatgctgggagccagagaccttgtcccttattgaggattactggggctttgcaaccaagtaaaaggttgcactgcacacagacctcagttgttccatcttccttatgaggacagtttaaatacgatctgacctgctgcttaaatagcaaatggttgtctgatgatagcaaccccagagttccagccagaactctgctcagctatcagaatcttaacagtgtccccccatccttcccacctgtttgtccatcttctgtccactgttcctttcaaatcacctctgcttggggaaaaccctgtgaaacatgcaatgatgacctccggcttcggggctggcatgagatggagatgatgttgtgggaatctgcctgcccactggcttatcagggcagagccacatcatttctttttatcctggctgctgacagacaagtatagtcttgtct

SEQ ID NO: 85550 - DNA, 1103 bp, Homo sapiens
aaggacaaggctatcatgtgtttctagtgtctgcttagctagctggcccaagcccctagatcatgcagagacacaagcttcacaaagccctcttctctgagactgggcaggctgtttctaagctgttttgcatggctctttttgctacttcggatttacttgcagaggtcttctcattaatttttcttagctttcgtctgtttattttgtctgtctgttcaccattcccatcctttggccttttcctcagccatgttaacaaggcaggtgtagggcagtggggccccagctggagtccaggtatctgccccagggttgagtctgcattcaatggggtgaccatagggccccatctgttacttggtcttagctgcccttttgggagccacgtccctagctgtcatgccttgggaaggtgagtttacctgggcacataagcatagttctgagagcagcctctccttctctcagtcaatcggcacactctcttttctgctttcagggcaagtttctggctttttatcagtatgcaaaatcatttaactcagatgactttgattatgaagagctgaagaatggagactacgtcttcatgaggtggaaggtaagttcccaccaggtggccctccagactcccagcaagccaggccctgtatcgcacctacatattcactctaaccaagggctccccatgtccagtgctcgtcacagctggttgtcatggcaaagtcttcatggcagggtctttgcacgcctataaaaagtgggcccagctccagggcacgcactggttaactgccgatgtcccagacagctcctcctcgctgtgcttttggtgggtagcaagtggatttgggcctaggtggctgcctctaacattgtcttctccctttcctttctcccacccaagaatcttgttgaacccccaagttgaatcactccaagtgttctgtggattcaaggcagagccaaacttgctttgaacttagtcatcagttgtacccagatccctctacaggcttaaacaccatccgtgggccaggtgccctccaccacatccttttcccagagctcaggaaagtctcacctcctctacttccctc

SEQ ID NO: 85551 - DNA, 1041 bp, Homo sapiens
tgcatggttcaggaggattaaccaaaaaaagaaagaatgaatgaaatcaaactaggttcaacttgagaaatagaaaatgaatgtgcatttcagtccaagtatgtgacttgttgggtgctctgctttttgaggggttactaatgtcctttgctcagggtgcattagatgactacctcccgtttctgtctcctcccccttgcaggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaa

SEQ ID NO: 85552 - DNA, 1061 bp, Homo sapiens
tttggcgatttttttttaagctcatcagctatcgttagtgttggtgtattttacgtgtggcccaagacaattcttccaatgtggcccagagaagccaaaagattggacacctccatttatagtataaaatgaaagccactaggctttcggctcagccccttttccttacactgccagtcagctgcgctcagggacccgcagttcagagttcaacacgggcagattccctctcttccttgcttgctcctgccagccgcagccgtgggccagtacagcatggcccggccccgccccggctctttccagaggtccgcagcctggccggcccagcgggcggaaccgatagtgtctggcacttggctcgcccggactctgaatcctggagcaccaggcgcccacgagaacgctgttctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaagggtgagggccggccgggcggggccttcctttctgcctgcctcagttttcctgtctgtaaaatgggggaacaactccagcagtaatgctggggcaagatccgaggccgcggagaagttgccagacaagtgccgaggccgccctgcgcgcccaaggcagggccaggcgggagcgggtctcacgcccaggtctgactgcaaacgtaccccaagagatctggtcagtcccagaccgtgtgcccgagtagagtagtcccagctcacagagcaagcatctgacccagagagaggcggagctggggttcaaacctcagtctcctgatggctgggcctggggcctgggtctactctgttgttttgggaagtgcaagaggagacctctcaggaacagcctcacccagcagctgagagcccattggagcaagggaatcaggactctggagtctggaaggcctgggtttgagccccaggtccaccacgtaccttctgt

SEQ ID NO: 85553 - DNA, 1384 bp, Homo sapiens
cactgatgttacagtgtttggagtgaggcacatcccgggccttatctttttaatccctgtgcagtcctgtgaggtagggaccgggttcatgcccattctacatgtaaagaccctgaactgagagtatggagtttcctgcccaatcccaggacaccccggcagaggcaggattcaaagccaggtttctccaactcccagccacagtgaacggtggtctgagtggtcacatccacatcttcccagttccccactccctccctgcgacacctctcctgtcagctgtctctgcctcagcccaggaggttgacatctccttgcacacctccttacaccctccctgggtgcacagcatgtctgggtactggttccacgagtgccgtgggactgccacctgcttaaagttctctggggccaagagggcctggaggattgtgtggggttaggagaggctcctgatgtatatggggaaccccatcagaatccagatccctgcctctacctgagacagtcctgaggcctccaaggaacagatgggcctctggtgtctgacccatccaggacagggccagaggtgagccctctggctgggaggtctcttcacagccacctaggtcaccaagccgagggtgagagggtctcctcctgctgcctgcacctgcaggcccccagcccctggggcctctcccagaaggccagggacaaggctcctcagtgcaatgatctccttttctcctagtccacattcttgagtctgatgacctccacggccagcgaggcagcgtcctatgagttcaccactctgacgtgtattcctggggtcattgaagtaagtgggtgtgctgggcccagaaggagaaggggcgcatgcttgtgtttggacttgtgcctgtgcccaccctgtgtgtgagtctgggtggatgtccccatgtcaggacaggctctggactgagctgctttgccctccagcactgacacttctggggatcctagctgctggaccccagagatgcctggtggggcctggaactaggaggtcaggccagcatgtggctactttgcctggcgccccctgtgctctcctccccaacaccaccacagctctggtcactaattgctgcttggctggatccttctgcctccccatgaagcttcactgccttgggctgtgtttgctttgggcagctgagtggtatggccttaagttcccatggtgaaacaatttatttgtaaagtgctggtatcatcagtgatgagtgttgtgggattggaagatcttgagccctccctaggcggctactcagctcataggctgtggtctgcactgggctggggtggtgacaaggctcagacttggccacaggttggcatctgggtttccctcagc

SEQ ID NO: 85554 - DNA, 1002 bp, Homo sapiens
tccgggcctcgtgatctgcccacctcggcctcccaaactcctgaaattacaggcgtgagccaccatgcccagccgatgctattcctttttccatccctttagcagatatttttgagagcctattaagcaccaggtctgtgtagacgctggggactcagagatgtgcaaacagtagatccgtgcctgtaggatttgacattctagtggggagacagacaataatacccaagaaaatagagagtttgccaatggggctgagggctactggagagagaattctggtggccttcctgtgagaggtaaggggttggggggtggggcatgcaggtgcgtgggagcagtgacttccaagcagagggaacaggagatgccaatggtcagaggcaggagtgggcctgggtgtcagggaacagtgaggaaggccagggaggatccttggctggtggtagccatgggggtggggagaagaggacatccccagagctgtttggaaggcaaactcagcatattttcataccttggagaccccatggcagtccccaagcctggacccctggggtctctgagcctcacaggtttttactagtccctccctggtctgaggctcctagtctcctggagagagtggtggtcggtcctgctagtgactccattctgttcttgtctgtctctttgtcctccctcctggacgctcttgaagataaaggtactcagtgtgtgtgtgtgtgtgtgtgtgtgtgtgtgtgtgtgtgtgtgtgtgtgtgtgtctgtccaggaaaatgcgtgtggatgtgcctgctcctgtgtgggtggagggacaggcaggaaaggacatccaaaggcctgtcctaggcagggctggggcttgtggtcaggggctgctgtggggggccatggaggctggaatggggaagcatggggcttgctgtgtgggagttgggcagcatggggtgggaaacactggggggcactggagagacctcaggattctctagggagccc

SEQ ID NO: 85555 - DNA, 1050 bp, Homo sapiens
ctcagcgcctgggcaagagcagctccgtcactcggctctacaaggcgcacactgtggccgccaagttccagcagtcactcctggatctggtggaaaagatggagaggtggggtggggggcaggtgggcggagcacccagcctcatccttaacccacctcatgaccctcagaggttgagcgccttctttttctgaggcctcatgctgtcctcttcctgccactgccaggtgcaaccccttgttcatgcgttgcctgaagcccaaccacaagaaggtgagtgagagctgaggcctctgagagagccaaatcctcctgcccatgctgtgtgaccttgggcaagtggcttggcctctcaggacctgcatctgcccagcctagcactgggaatattcaccatgataatgccttttgcacatggctgagccaatgtgcagactccctctctgggcatccctacaggagccaggtctctttgagccagatgtggtaatggcacaattacgctattcaggggtgctggagaccgtgaggatccgcaaggagggatttccagtgcgcctgcctttccaggggttcatcgacaggtatcttggttacggtagttcctgagctctacaaatccctgcccaactccccatggccccaggaatacacaacccaggcagtacagggcttgccatgcacagttgctcaggttgtacacttcacaaggctaccacatgctaactgttaatgtggtagatacatttattgttttgcctttttttgtagttatatgttgtataacgtataatatgtctaatcaacgctccgcgttattagaatggttttagtagttataatgacaagtttccagcaggtggcagtcaagtgtcctgttgtactgaaatcatctattataacaattgtctgacacccagaagtaaagagtcttgaggatggagtgccttttttcagattagaataaactatttgtggagccaccactgggaccaggctttttggacacctggctgggggcagtaaccccatggtctagcagacacctcg

SEQ ID NO: 85556 - DNA, 1041 bp, Homo sapiens
acccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcaggtaacccacccgggtggagggggcggccctgcgcctgctgccttagctacccaccctggcccagaaagcagcagcccgtaggagtctgcgttttttacagttctgaccagttcttctgtttgtagattgtagggagcgagagaagggttttgtgtttaagatacctatagcaagaaaatagggaaccgatgtggaaatcctgtccccgaaggcaggtttgacgggatcactgacttggctgagaattcatcgaaagccatcttttcagaaggctgttccctttgatttttttttttcccaccatccatttcttagcataagtccctttgtgattttccggttttccattctggccttccatttacaaatctatgctttaaaattttttttttttttaatttatctaaaagtctttcttgttctgccatttttggattccttaacagagaaagtagtcacaggcaaaggccccagagattatttaattgaagcacattctccattcccaggagggggagtgacttccctggagttgaacagattagtggttgggccaggcatacagagcagcacactcttaaaattcttccctcctggctgcagaagagcccatcagttctttgtaagaacgtgttacttgtagtcaggactgaatacaacagaatacagctggtctcttgactgtttggccttacagttgcgtgagcagcagaacttaggcttttggcctatattcg

SEQ ID NO: 85557 - DNA, 1100 bp, Homo sapiens
cacgaacccgggaggcggagcttgcagtgaaccgagatcatgccactgaactccagcctggcagcctgggcgacagagcaagactccgtctcaaaaaaaagaaaaagaaaattcagagctggctggccagttggtggatagccttcactgatacagtgctagctctctgggggatataggttcatctctgcaaatctctttcatggggctagtgggtgtacgtgtgccctttggtgaggccagcaaggccccctggacaggcttgctaccaggaaacacagatgggcttttcttcctaccgcctccacaacaaaatccagaaagtttgacagcagacttggttggagttacagcaccaccattttaactcgttgacttcggggaaattaagctttttgaggcctcagttttcctcatctgcaaaaccagtctaatgatgctatagagttgttatagaaagttgaatctttgtcatctattgaatgcttgaaatttagctaaaagtgtctcaggagatgggctaccttctgtgtttagtactgtctatcttggtgtgtacagaattgggacttggcaggttgaccttccctctggattcagaaagccccaggacttcttataaagttaggccatgggtcgtcttggaggcttgggtctggtaaataattgagcctgagctcacaatcctgcccctgggtccaggtggctggtctgctgcccccaaaagcctgaccttcttggtcctgtgggtctgtcagtaaggcaggtagccatagctggagagagacagtcaccaggctgggatcttggacagtccctccatctctggttcatcctggcctaggcagggcatggagtagatggaaaatggtggccatcttggaaatgtgtcataacaactcagtttccaagaccgtcccctagaggagagatgtacagtcctgcatagtttctttaaagaatttttcagggccaggtgcggtggctcatgcctgtaatcccagcactttgggaggccagggcgggtggatcacctgaggtcaggaattcaagacaagaatggccaagatggtgaaagcccgtctctactaaaaatacaa

SEQ ID NO: 85558 - DNA, 1041 bp, Homo sapiens
tgccgcagcatgcaagtcttttctctgtaatcgttggtaaccctggaaggggaggctggacctaaccttactggaggtgtggttaaagttctaaattactagttagataaccaagaggctgacaaacttctggggtataataattcatctgtgaggggagtcttccagttttcccatgattccctagtgctcctgcactagtgcactctgtgcttctgctcctggtaggccttgctagctgccctgtgccaagcatccacatattaaccttgaaactagaaggtatgaactctgtttggaaaggggctcaggtaggaagtgagctgcctcaggtcattgctagttggaatggcctttgagcagggatttctgacttgagggaaacatcaagtatctactatgtacaaggcacttgaggtgggcaccacaggaaatttagtgcccccttggtgcttcacatgtaataagtttgcactttgcctgccattccaacacaaagcagagtgaacactggtgtaaaagcacagggtattctctgggagccctgcaaaaaaaaccccaaaaacccaggccggtcgtggtggctcacacctgtaatccagcacttcaggagggcgaggcagttggatcacctgaggtcaggagttcaagactagcctgactaacgtgatgaaaattctaaaaatacaagaattagctgggcatagtggcaggtgtctgtgatcccagctactggggaggctgaggcaggacaactgcttgaacctgggaggcggaggttgcagtgagccgagattgtaccattgcactccagcctgggagacagagcgagactccatctcaaaaaaaaaaaaaaaattttttttttttttaaattacatccagctttgcgggaggaagggtaaaggtgagcttggtagatctggcccctgagctagaaattgctggccaggcagaaatggtaagctcaaaggctaggaggcagggaaatataggggacttctgtagatgaggaatgaaagagggaaggaggccttaggt

SEQ ID NO: 85559 - DNA, 2923 bp, Homo sapiens
tgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataaggaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattttgaaacagttgtctgatgttgttgtaagagagggcttgcctttggtgcttccttaatccctttactttcttaaacttgaaacaggggttggggaggcagagctagctcattggccgccagcgtcccagaggagttggttggtcttggacactgggcctcctgtgtgcctagccttgggtttatggctgaaggtggacttgccctcaccccactgtcctttctcccactccaaggagggtgaacttcataaaccacaatgtccaggtgcccagggaccacaccttctggagttctggaagtccctcttttagatatgatcactgagaggctggtgctggtgaagggggagatggcaggcacaaaagcaagggagaacctggcttttgtggaaaatatgcgagtgattttgctcattaaacaaatacttggccaggcacggtggatcacctgagctcaggagttcaagaccagcatgggcaacttggcaaaaccccatctctactaaaaatacaaaaatttagccaggtgcgtttagctgtggtctcagctactagtgagactgagacagacaagaattgcttgagcctgggaggcacaggttgcagtaagccgagattgtgccattgcactccaacctgggcaacagagcaagaccttgtctcaaaaaaacaaaaaaaaaaattcttgagttcctattgtataccaagccacactgggaccccaatagtgagcaaaactctggtccctcctttcaagatgctcatgatagtgtggagtgcaggtactggcatgaagcagatgtttttcaatgggtaaggctggggcccagagggctttagtccctccagacttcagacctggctccctatgcctggtaaagggcttctatctagagtctcttactctgttctagtgctcagagctagtctgcttggccaaattcttgctgtggaaacttggataagctgcttacctccacatttaccagagaagagagactccagagtggggcaagtaactggcccaggcttggtctaaaaactagtgcgagggtctgaagagagaggggccagagtctcaagtgtggtctggggctagttgggcctggaggggtagacactgggctaggcagagtggaccttggatcccctggagaaggaaacaccggatctgagagaaagtgacttgcagaatgtcatccagagtataaatggcagaagtaagcatcccccactccatgcctgagcttctgactcttggggcatgggataggggctcagagaagggctgggggagtgcgaggaaccgtctttgtggaggaccctattttccattgccattaaaaagtcagacttctggccaggcgcagtggctcatgcctataatcccagcactttgggaggccgaggtgggcagatcacgaggtcaggagtttgagaccagcctggccaacatagtggaaccccgtctctactaaaaatacaaaaaattagctgggcatggtggcgggcccctgtaatcccagctacttgggaggctgaggcaggagaatcacttgaagccaggaggcgaaggttgcagcgagccgagatcgtgccactgcactccagcccagcggacag

SEQ ID NO: 85560 - DNA, 1036 bp, Homo sapiens
agcccctacatgcccttctcccagtaaagttattgccattaaatctgatatatcatctgctttctcatcctcaaatattagttggattaaaatttctcagctatagcagtacttttaaatttaatctgaatcattaatattttccttcactttctcttttttttgagacggagtcttgctctgccgcccaggctggagtacggtggcatgatctcggctctctgcaagctctgcctcccgagttcatgccattctcctgcctcagcctcctgagtagctgggactacccgccaccacgcctggctaattttttgtattttttagtagagacagggtttcaccgtgttagccaggatggtcttgatctcctgacctggtgatctgcccacctcggcctctcaaagtgctgggattacaggcgtgaaccaccacatccggccctcttcatcactttcttaaatctagacctgtgttcttcagtacagcagccactgatacttggctattgagtatttgaaatgtggctagtttgaattgaaatgtgcttttagtgtaaaataccagaatttgaagagttagtatgaaaaaaacaatgtaaatcattaagaactttatattgattacttgttgaagatactattttgagctgggcatggtggcctacgtataatcccatcactttgggaagctatggtggatggattacttgaagtcaggagtttgagagcagcctgaccaaatggcaaaaccccgtctctactaaaaacacaaaaattaggtgtggtggcgctcgcctgtaatcccagctacttgggaggctgaggcaggcttgcacctaggaggcagagattgcagcgagccaagatcgtgccactacagcctgggtgagagagcgagactttgtctcaaaacccccccaaaaaagaagaaaaaaaaaactattttggacatatgttaaatttggacatactgggttaaataaaataggctgaggcaggagaattgcttgaacctgggaggcggaggttgcagtgag

SEQ ID NO: 85561 - DNA, 1053 bp, Homo sapiens
tgtgtactacactgcacttcgcatcgtggggcctcagtttccctagctgtgaaatgaggctacttttctccatactgtgggccctggctccctctgccacatgggccagctgtcctgcctttctgcaccaaggtggagtgaggtggaggcttttccttcctttcccggagtgggacactaggggccagggaaaggggccgcctcagcccccgcctccctctgcactgatgttagagcagggcctcagcccactcctggctcactgctctggggacgttggttttgtcctcattcttaccccagagcccactgatggcagagcctctcagtgctcttcgaaattagagttatcttcaaaatacaggtgagaaaattgaggttctgagaggggtgacggcttgcccggagtcagagtgagctgcaccaatatctttcttgagttcttgtgtcagtggggttggattttagccttgaggggcagggatttttccaaggggctgctgtggtcctgggccagtgttgtgccaggcgccctgggctgccttgaggagacacttgtcttggaggaggctctgggacggctggacctggagtagtggaggcactgggatgtctcagggtttccctgcctaggtctgcagtgattgccgatgagagctgccaggaccctcacacggtggctgagaacctgctaggaacctgagaggggcccagaagggaagctggtgctccgtggtccccagatggcacctattttctgtgccggggaggctgtgagggtgaggtgagaggagaatggcccttcagggaaaggcagcaacaggcacagggctaaatgtcacttttttttttttgaaatggggtctcactctcacccaggctggagtgcagtggcacaatcacagtccactgcagcctcacaactccctggctcaggtgatcctcccatctcagcctcctgaagctgggactacaggctcgtgtcaccatgcccggctagtttttgtattttttgtagagatggggtttcaccatgttgcccaggctggtctc

SEQ ID NO: 85562 - DNA, 1040 bp, Homo sapiens
ttcccaaagtgctaggattacagacatgagctgccatgcctggcctaaatgtcatttcttcagccagtgaattggggtgtgcagtgggggctggagacagatgggggtgaagctcagcccactctggctagccttggggtggcggaaagtaagggccctccgctgaggatgaagcgtgggcagcagtggtggaaagtggggtggtcttggggaagggacttagtcacctaagtgggtaataggtgatcgctagggaataggcccctgattcctgagcttagggggtgggagacaggtcaggagtgagcagggactttggactctgagtcttgggttcaaatcccagtccagcccacacatcgcctgtggaatgtgccttctctgttaatactgagccccactgtgtgtgaggtctccaaggtgctggggacaacagtagttaccaaaaaggacaaatacctgttaactcaggtggctgatatagttgtgcaggagacagtgaaaagccaaaacaaaaaagtaaaatagactgtagttgggatggtagccagtgctgtggatcaaataaagtagggcgagggggtgagaggtgtggccagggcggctgctgcagccagggtggccttgggaggcttctctgaggagattactcctgagcgacaggaagtgctggaggaagtgcgttccaggcagaggggcagtaggtgcaaaggccctgaggcacaagcctcccttagctgggagccccaggaggatcctgagcaggggagggacaaggatctggctgtggctttcataggatccctctggcctctgtgggaacagactgtagtgagtaccaatccaggcacgtgacggtggggcctggagcagggagggaggtgacttctgtgtgttttgaaactgagttgatggggctcagaaatggactggacgtggggtatgagggaagcagatgctggacagtgcatgtaacctcctttcctcgtttgtaaaatgggaaggctgtggggatttgcgatgcagtgtcccgtctctgg

SEQ ID NO: 85563 - DNA, 1078 bp, Homo sapiens
tgcagccttcaggtgtccctcctgtgttggggtctccagtgcacttgtcctcaggctcaaaaagaacctgaagtgcagatgaggagactgagcctcagaaaggaggctggagcccggggtcctcttccctttttcccctgactgccactgcctggagccccttgggttgggaaactgaggctggagagggccagccctggtcactagaagctgcccctccccctgccaggccagccccatctccttgacgaccctggttcccgcccagctgctcctgtcccctcttttgtcccttcttcggagtttctcgccaggctcctgtagggaatctgagctcaagctccaggcaacggctcctgtgttgtcaccggggcaacgttgctgactcctccctgcaccctctgtcatggggccccctcaggccctgctgtccaccatcagccctggagttgccgggactcaggcactgacactgggcacttcaagcaggtcatccaccccctccaagtctgtgtgctcatctgtgaaatgggcaggctggagtctctcctccctcatgatggcagttgttggctgcctgctttggagggaggtgggttttttttgttttgttttgtttttttgagatggagtcttgctctttgttgcccaggctggagtgcagtcgcacagttttggctcactgcaacctttgcctcccgggttcaagcagttctctgcctcagcctcccaaatagctgggattacaggtgcctgccagcatgcccggctaatttttgcgtttttagtagagacgaggtttcaccatcttggccaggctggtcctcaactcctgaccttgtgatctacctgcctcggcctcccaaagtgctgggattacaggagcgagccaccgtgcccagaggaggtgggttttcttacccatggctgaagtttggcctgaagctgtgggaaaaggcagcctggactcttctgccccctggctttcttgtccaggcctggccttgcacctctggcctgcctgatcccatccggcaaggcgcagctcccagaacccatagacacacggagctgaagt

SEQ ID NO: 85564 - DNA, 1011 bp, Homo sapiens
ggcctggcctataacaggtgcacagtgtacctgtgctgtctacagtaggtgcctattgttttttgtaaaagtaggattccggtcagtgtttggcacgtgcagtaggtgcttagtgagtggttatcagatgagtgaatggaggggcgtgcaggcctcccaggaactcgggtagccctgacatctgccctccctgcagccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggcccctcccctggccctgatgagctggtcctgaccccgcctggactcattactccttcccatccctctaggtgggctgcttcgatccctacagtgacgatccccggcttggcgtgcagaaggttgctctctgcaagtatacagcccagatggtggtggctggcactgcaggccaggtagggctgggtgtcccctgggttggagatgtcagggagggctttctggaagagatgagctggagggtctggtggaaagggagatggactggcacaggcaaaagccaaggtgggaatagggctctgggtggggctggctggggtgaggacagatgggaagtgggcctgtcgctgggggaaccacagtgttgagaggagggaactcatgtcagtgctgtgctccggcactcacatgacatacaggaggtgctcaatgtgtccttattgctaaatgggagatagaggctcagggtaagggtggacactttgccctcagagggcagggactagtgtgtcttggtcaccactgtgttccttgtgctcagccagggccttggtatacagtaggcattcagtgagtgcttgtttagctgatgaactgaagacagtcctagaaccaccttggtggtggctggggctgcttcagaggctccaggctgagt

SEQ ID NO: 85565 - DNA, 1023 bp, Homo sapiens
agccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcggggggggggggcaggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagc

SEQ ID NO: 85566 - DNA, 1008 bp, Homo sapiens
gagtcagctgcgaacacccccacccctgcacactccccaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggg

SEQ ID NO: 85567 - DNA, 1084 bp, Homo sapiens
aaagctgatgtggccggtgccttggcttccagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgccagcccgttaaaattgggggtgggcagagtggggttcccagggaactctggtgcaggggcagtgggcccaaggcaggtaggcagaacaggtgggcaggcagggagctggggttaaagggggtggatcaacgatactgtgcgggacctaaggcagaccgcagggtgaggtctaaggtggccaaagcctgggtcagcaaaggagagttctggaacgcggggcagaattcagccgggcaaggataagggtacaggctgggcatgggagctagaccagtgggctgacacaggggagctgagagtagggtggaaggggtgttgccaagagcagtgagaaggcagggccaaaacctgttattaggaggcaaggacacacctggatgccaaggaggtggggccaagggcgggaccagagtccagtcttgaataaattactgagcagtgttagccgccagctggttacacctagacatatgttcgcatgtacacacacgtggagtttatgcacacaccccacccgccccgagttttttttacccacattcacccaggtttccactcttccatgaacccacttgcttgtgtaccctgatatgcgtgcatctaaacatgctgctggcatctttacaaacgtgggtgaacgtgtccatatttttcatacatcccaacaccccgacgtgtgtatgtttatagacacagatgtgtatgttttattttagacagactctcgctttgttgcccaggctggagtgcagtggcacaatcttggctcactgcaacctccgcccccagggttcaagcgattctcctgcctcagcctcccaagtagctgggattacaggcatgtgctaccacgcctagctaatttttg

SEQ ID NO: 85568 - DNA, 1001 bp, Homo sapiens
ctggtcttgaatgcctgtcctcaaatgatcagcctcccaaagtgctgggattacaggtgtgagccaccacgcccggcccagttaactcacctttgtggatgaagaccacagtcccatgccagccattcccaacttgagcccctgagagcacccttcggggggcactgttagggacaaggccacatgacgtgggaacgcagtgttgcttctctccccttctggagatcacagtgcccgtaacatggtctcttggctctgagaagtccttcaggcagagaatggagacccccgccagttcctctgaccctacctgcctcccctccccaggactaggggttttcttgcccacttccccttgtctgtcacctgcctgaggccctggctggccctgtcttcacaggtgcccaaagctgaggaaacttgtcctgaacaagaaccacctggtgaccctcccagaagccatccatttcctgacggagatcgaggtcaggcatgctgggtttgagagggctcaagagagacaagcaaggggtgtgccctggagcaagggggacccagcagaggcctcctgagggaggtggccagtgccagggtgcccgtggggagaaggtgggccccacctccctgcatccagagtacattccacagtctcatttaagcccccagccagccccagaggtgggtgggaggagaacccagttccctgacctctcagccctggcggctgcagacaagagcaagaaactggattggtgtgtctgggaggtaggacccaggctcagtgccggctctgctcaccctatggggcaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctggtgagtggggaaaggtctggcctgggaacgggggctcctctcc

SEQ ID NO: 85569 - DNA, 1489 bp, Homo sapiens
tggccaacatggtgaaaccccatctctactagaaatagaaaaattagttggacggggtggcatgtgcctgtagtcccaactctcaggaggctgaggcaggagaatcgcttgaacccaggaggcggaggttgcaataagccgagattgcaccactgcactccagcctggcgacagagtgagactctgtctcggaaaaaaaaaaattacatgttcattttagacaaattaagaaatacaaaagtttataagggggtaaaattgcctattaagcatgatatttaacaattacaaagatgtgccataatttattttgccaaatctgttttttgtgtgtttttgatactatagttaacatttgtagacataaatatttttgtggttctccagttatttcctttgaagaaatccttagaaggggaattattggatatgtgtataaatgtctcatgggcttttgatagactgaggctcactaaatcattgattacctaattgaaaattaccctgaaaattactgcttaaatgtgtgcatgaagttgggctaaggccaccaggtgcaatgttgctgtctcttgtatttgaggagtgtcttgctaacttcttacgctttcatcttgttttctgcttagattgcgtttacatcaaagaaccacttcccagtctggaagggaagatgactcctttgcttatctttgccagatttgagttgtgagatgtgtcaacctaaacccatcctctccccaggacttgtttgcctggcactccatgttagtgcagggcctgaggagcagtgtggcctcttctgtgcaggacattaggctaaggctaccagtgatgctcctgtccttgagaggtgatattctagggggagtttcgtactcctcttttcttcctagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaaggtaataaagagtggtccccagtgagagggaggacagttgtgttgtgagccctgagttctctagtggagcaggatcatgttccttgaaatgaggttattttttgcctgagtgtgctgatggaatcatctgactgttgcacctgccgctccctgtagatcctccctgtctatgagcaaggatcccactttcagcccagcaccgtggagatggtggacggggagaccagcccacccaagctgctcaccgaggccgacctcattgccctcatggagaagcatggcattggtcagtggctcctctgggtaactcgcatctcttgagctaaggcttacagtgtaccaggtacaggtttcctctagtcttcaaaccattctctaatgcagctgctatatctttatcccatttta

SEQ ID NO: 85570 - DNA, 1050 bp, Homo sapiens
ctggtggaacttgtcagggtcagtgagtctcatgtgctgcatcagggctggtctgtcagactgaccctcagagtggccagtgacaagccccaggctatgaggctgctggcctttttcctgtgctgtgctgccccttttggcttctttgagtgtgctagcaggagagccagctgcttttcatcccatgagggggtgcatctcatctcagaacttttctgaagcaggtaatgtaggctgccttcagttgagttggctacatcagatgagtgtttgcaggtgttagtgtgtgctttcagttgtttatagaccaatcagagagcctagcaatttctttttctgtttgtttgccttggttttaggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacaggttggtttccctgaatgtactgcctgctggaacccatagggaagtgctgggggtcagtagtaaggtttgaatttactctgtgggctgtgattgtaaaaacaagtgattttgagatctctctcatttcacaatcctctgcctggctttgataaagaccgcctcatccctccccgtggtgggcccccgtcttaatccagctccacatcccactctccatcagctcctgctgcttccctgctagtccttcataggcaacccctgtgcagacccccacctccactgtgagccttgtggccttcccagtccctggaactagagaattctatccatcctcccaaggctggctcagttttggttgcctcctgaaactttgctgccaccccagtcgtgccaccccctgtcactgcagtttcccacacagctctgcttgtctgtctcagtcatttcctcagccaggggcaggctctgcaggcacaggagcca

SEQ ID NO: 85571 - DNA, 1503 bp, Homo sapiens
agggtatgctttcttgtttctccaccatcctgtcatcgacctccacaaagtcttcaaagagaaagtttgttatatgctgttgttttagaagtgctctatcaatctgactggtcaggaggtaacacaggtctcctctgaacatgtgttcaatgtggctgagctgagccagggtctgggtgaaatattcagtgtcacagagctcctccaaggtcttcaacttcttgtcaaaacacttggtggactttgctttgataagttttggggtgtaggctggtctgcaggtgtaaaggtctgtgtcggcagactcatcagggttagaggtagtggatgcctggctggcctgatcctggatgtgctccatctcaccaggacacaaatcatgccccttcaacttccgatgagggtatgagcggatctgcttcagcaggtcttgatgttcaatgatggacttctccacactggccagttcattggctttctcaattgcctgagatgagtaaaagcctttgtcgttggctttcttctggatctccgtttctgtgtgtagcactgtcctggtgtaatccaagtctttcagctttttttcaagttccccagcaaatgccttcctgttgccagtcttcaagcactcagaagctctggaaaattcggctgaaagctcctggaactgctgcatgattttatgctggtctgcagagatataagccatgcaaaacggcctcacgaagccacgggcctccaggtcgtatagggtaaggtggtgcacgtatgcaaaggcgccctccttagaatctcccagcaccaccttggagtcctccacgaagttcagcttggggtaggcagatccaggaggatggcccacgaaggaagcctggtaatccacagacatgatacgcagggagaagtaattgagatcaaaagtgccaaaaactttggtgtcattggggatggtcagtaagggttggggtcccacctgctcagagaactcggaaataagaatgaagtccctcgaaaacttggccccggacagttttgaccaggggttagcaccctgactggcgaaggggaagagcggcaccgagtactcctcaggcagggccggctcattgtaaggctcttcttcatactcttcctctttggtgaaggccactacgtcaggggcgctgatcatatttccagatatatgaagaaaacattgagaggaagtgggaaagaatgcggtgttaatcgacgcgcagaaggcaggcctccggagaaggaagtgaagcccttacggccttctttgcgactccccgaacccggggtcctaggctgcttctcacacacccgaggagaagaactctagcagccccctcacagttgtagctcctccggagctctctgaggcctcatgaacgccaaggccgcaggcccaactgcccttctcttcttcgtccggcgagcgcggccagcacaagaaacctgctgcgaaatcacctgcactctccggaacccactgcgaca

SEQ ID NO: 85572 - DNA, 1063 bp, Homo sapiens
caggaagagccagtgcatgctggctaggtggatgctggcctggggacaggaggcctcacctcccaagcttctgcctccactttcccggcccttgcccttcctcctgaccttggcctgtctgtttcagagtggcctcccctgccggtgccggtaccctccatgccctgagccgctacagccgctacacgagcatcctggaccttgacaacaaaaccctgcgctgccccctttacagaggcaccctggtgccccgcctggcagaccaccgcacacagatcaagcggggcagcacctactacctgcatgtccagagcatgctcacccagctctgctccaaggccttcctctacaccttctgccaccacctgcacctgcctacccacgacaaggagacagaggagctggtagccagccgccagatgagcttcctaaagctgaccctgggtctggtgaatgaggatgttagggtggtccagtacctggctgagctgctgaagctgcactacatgcaggaatctccagggaccagccaccccatgctcaggtttgactatgtccccagctttttgtataaaatctgaggtcggtcccagacactgtgaccaagacctgtgactcagggtatggggaggggaggggttggcatgaccaaacagttgcctgagctggactgtttaagtttctggtgtctggcagcatggttcccacgtggctcctagtagtttttaagttggacatgggcagaagtggagcctggctccctctaaaggcgtctggagggatggtgacagctacatttggctccctggtgaagagtggcccctggatatggagggggccttggttttctgaggactggcagccagggcagaagggaagccaccagtcccttggtggggcagggtgagggcaggaaggccaaagcctgatgggaggagcacactggctgtattcagcattgccggacacttgagtggcaaaatgaacgagggtgacagccaggtaactgttgtggtttggtggaaaacaggagggcagaacacccatcgcctccttcagaccc

SEQ ID NO: 85573 - DNA, 1111 bp, Homo sapiens
cgaagagggcttgcatcacgtcactccagtggttccctccttgtccaagtcctcgttttaagggcatggcccgttggctccagccgttggcttctgttcagggtccttgctcccatcagaggtgtttgattttgctcctggggctgcgatggagaaccttttgtggcagatggtgctgcctacatctcattggttctctgtacctgtgcccgttgcgcatgttcacagacaggagagtcgccagcaataccttggcagcctttaaatgtgaaacgtctgttacttgcgctggaggcagaggctgtgcagggagcctgcttctaatcgtgggctcccttatctgttacggttccctcccctcctgttctagatgctgattcgttttctcactggctggttaattgctgtctacttaggcctccaaggccataactgtgcaacattttatctgagaaggaaggaaggtcagaaagtgatcactggcaccaccactgtggcattcctgtcacaccaacacagaaattcacagctcatactgttctcacctgggaaacttgggaagggctgatgagtttggggcagatcctgaattgcagccacacttggccttctagaagctgaagttgtgccctcaagtggtcctaagtagaagtccacttgaggtatttgctggcacacaccctcaagggtggttcagaaggtcctgaaacctaaggcaaaaggctgctggggcatgaacagaacagaccgtctcaggggcagccatgtaagtggcaagcagggctggtctccctcaaggtggttcttcattaagtaaagatggcttcgtgactagtgtttagctcccagatttatatttgggttaaaaactaacttttcaatgtggcagtttcaaaggattacttgatgcaaagtatgtttcctttcaaagggatcttgacgtggtaccaggactgagtcatgatttgggcagaggcagttaacactgggaagccctgcccctccctatgcccccttcactccggggaactgaaacctactctgagtctcacatctctaaacctcagtgctgagacctatgcagtgggactaatctcatcaagaattttca

SEQ ID NO: 85574 - DNA, 1824 bp, Homo sapiens
ggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagtacacttctcatactatgtgtttggcattgactctggttaactcttgtgcagcaacacctacgagatgctatcacacacgcgccagctgcactcctgcaccagccgctgcaacgactgcacctcacgtggtggcggggactcacattcacaagacgggacgggaacatgcagtaataaaatagctttttaaaaaataacacatataaattcatcacataggattatgcttttcactgcaaccttgaaggtggcatttatctcaatctgtgactccagctatttagtggcagacaatcccggtgaggcagcctgtggtcccaccttgtaggtggcagcccctgcaatctggggtctagcctgtcggcgtttgctttattgtgggtggagcagctgctgcagaatctgtgagttgactcaccagtccctacagttctgctaccaaagtggtcttcaatttaggggcctgacccctccccagctggagacaagctgccatctccagggctcgctgtaaacagcctccactcttgggctgaataagcactcccaagaagctgggcccctaccaacagattaatcggctgcagagtgctcatcccctccccacacccccatccacccctgcctcctcctcctttccactgctttaaccaaaccttaatgaggtaaggccaggctaggtcagggctcaaaggaaaatgggctcaggaaaacttagtttgcccagccttgtcagctgagattggttttgctttccagccagaagtagaaacttgatgctttttcctttttgcagtgttaaaaaccatatctccagttttattatgttccatcacagttttggggcaaagccagaaagctgacttgtttgcttcaaaacacaaaccaaggcactgtcttctgtgcttttcagggaggtgggaaggtaaaggagactgcccactataggggctcagttcccccaaaggccttgcacaccttctgataaaccccctggctgaggcaatcctactggctgtgcagacaaagatgtgacagcagcactagatgctgacccaacaagcagtgctgggcctgggcggtggggcatgttcagcactgcgggcagcagtcagcacatgcaagacattcagtgagcagagggctgccctcggcctccaactgcagccgccctggcgcgtgaaatgaaattggtgggccttcctaggattgtaaaatgggacttgtcatttgtgtgaggttgaaatcta

SEQ ID NO: 85575 - DNA, 1305 bp, Homo sapiens
ggaccataccttggctgtctcttggctgtgcctttgtacttggccctgaccctgccagggagcaaaaagactgatgtagagctgttggaggtggtacattcatcagatgagggaggtcagggcctccggaatccagaggctgcatttctctgtgggttgttaacaaaatattgatgacgcatctcagacccagacagatgttaccctcatttttaggagcaaggggcacatcagaccactttgtgtactagtaattaagtcagagtggccaaacgtggttgtgcctccttgtgccttgggttctactttagtttctgaatcagttgtactccttgctagggacagccagtatcctcaggccagttctcttttgcccacatgtccctttttaaatgcaccaccatcacagtggtgacaatgtgacttagggacagagccccgtttatcttgtaggtgacagaagcgctctgcggcccagtggactgcggctggggaccccagcactgacgtcccgtggacttttggaaaaagacttccaaaaagtagcccactttattcacagaggtaaggataaaagtttggaagttgccacatcttattgtgtgtatttagtttctgattgtgatgagtagctgagaccctgccactgaaagacaattctgcaccaaggctgagtgttggggtgggagacagcaaaaaacacatgtaaatcaccttgtctgagagggttataaatttgggctgcccaggacatctgtccaagggtgggtgcatctcagagtaattgaggtaagcatggagaccttgtgccctgccacactccccagctgggggacattctgacatttgtgcctcggcccccagccattgtaccccctttggtgtgtagtgtggggtgactcatttgtgtcttgtggcacagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaagg

SEQ ID NO: 85576 - DNA, 1056 bp, Homo sapiens
aatgcccgatgatctgaggtggaagtttcatcccaaaaccatcccccgatgccatccgtgaaaaaactgtcttccacataaccagttcctggtgccaaaaaggttggggaccactgctttaggtccctgtttcttaaacttcaatgtgcacaccacccctggggctgttggtgcaatgcagattctgaccaggccttgggtgatgctggtctgggagccacccttggagttgtgagggtttaggccatagtccctgtcaccatgggcatctcatggcatgggcctgccctctccctggtgactgtgtcattgtcactctgccatctgaggacccgatgcacatggctgagacagataatgcttgcaaatgccctctttggtgcctggtgctatgagaagcactatgtccagtatcttacttaaacttcatgacagccctgtgaattattggtctttttgttacaaatgggcatctgaggtttcacaatgttgagctgcctgcctaaagccacacggcaagtgggtgggcacagctggggggctgcaaagccaagctggagccctagctcacccgcatcttgaaagggatccccgcaacacagctcagaagcagaggccccagtgctgtcagcacccaaggcactaccccagcttaatgaaggttcaaagtggaaggatcctcctgtatgacctcgggccaggtccagaaaactctgttagccttgctgttgtcaccttaccactttgataataccatcagcctcacaggatccgggaaaaacctaccacaggctacagtgtctggcacctaatgtgctctgtgaacatgccccttaccccccaaagtaaattgaactgctgcccaatattcatgctgccttcaggggagcctttaccatcaatgttagggaattgcccaagcaacttgtcagagaaaacaagccaggagcagcctgaggaagctgtcccttccccatgggagtgtcaggccctctgctgtatgatcagttacccctttcaaaagtgctctgtccttcctttcacattcttaggcac

SEQ ID NO: 85577 - DNA, 1430 bp, Homo sapiens
aaaaataaaaaatttttttagctgggcatggtgctcatgcctgtaatcccagcacttggggaggccaaggcaggcggatcacttgaggtcaggagttcaagaccagcctggccaatatagtgaaaccctgtctctactaaaaataccaacaaaaattagctggacatggtggcatgtgcctgtagtcccagctgttcgggatgccgaagcagaagaatcacttgaacctgggaggcagaggttgcagtgaaccgagatcacaccactgcactccagcctgggcaacaagagtgaaactccatctcaaaaaaaataaaaataataaataataaaaaatttttaaaaatatatcattttggaggaaaagataatccaacgcaaaagcaaggggtgacattgaaaagcaaggaagcttgagtaaaaacaggaatgttgtttgactcatcatctgtgtatgattctatcctagcctcctgacccattgtctcttcttgtccaggggttgctgtggcactgaagcaagctatgactctggaatttaaagtttatcaacaccaggtggtggccaactgcagggctctgtctgaggccctgacggagctgggctacaaaatagtcacaggtagagacacagatggtgttcagcaggcctgttcttgtggttgtattaaggcttgcttctcagtttgtgcaaccaggatgtggcccaggctctgctgctgcagctgcaatgatgggcccaccttgggaggaggtcagcctcgcctccaactggaaagcctccccctgcctcagaccagccagccgcccccttgggtgagccacagatgatgggaatagtggttgccattggtcaccagcataaggactgcttgtcctcagaacagctttgcaggaggatgacctgaggctcaactgagaggttgggctgtagtggtcacacacctggtaggtggcaccaggactgtgtggtgatgccttgcactgtgccaggggagtgtcttctctcaccccgctgagctgggggtgcaggggctctcccctcccagtttcctgcatattcctggggagttggcttgctttaggcatgtttgcttggatctgtacattctggagctgatgggctgtgaatgagatggacttcccaggtcagggccccactctggggtgccatccacctcacagtcactgcagctttccacggagaacgcatttttttggcaggcagcatactcagtcctccggaggaagggcgactttatacctagtcccacaagactgccgattgtgctagcagtggtgtggtccaggaatatgggtcctgctgtgtgtagacctgagtgcccactctctgcaccgtgtcctttgccctttacagggattacaggccctctgatctaaggattggggagggattacaggcctcctgg

SEQ ID NO: 85578 - DNA, 1050 bp, Homo sapiens
cccaagtagctgggactacaggtgcacaccaccacgcccggctaatttttgtatttttagtagagacggggtttcaccatgttggccagactagtcccaaactcctgacctcgtgatccgcccgccttggcctcccaaagtgctgggattacaggtgtgagccaccgcgtccagcctgtcctttcatttttaaggccttgttctagttgtgttaagaagagatgccatcagaggaggcaggtggacaggtgaggtgctgaaaccagtattccagccagagtcatccatgatgtgttggtttccaaaaaataaagatactggtctgccctcaggaggcaagggtcccctctgctccgctgtgttacaaatcagttctccatgccaggataaaggccaggcttgtgcttgattcttccctggccagtctgggtttgagcctaaaaagaaaaagaggggacagcccctatgatcccactgtgatgtttttcttcctccaggagtgaaaagtgtggatcccaagactggcaaagagattctgtacaacctggagtctcttatcaattctgctgtgttccctggcctgcagggaggtccccacaaccacgccattgctggtaaaacatcatctgcctctgctcatcctgtagcccctaattcccatcccacctgtcctccaaaatcgtgtgccaggacttccacgctggggaaaaagctggagggctgtctctgtgcaggagatgctaacacagagtagggcatggttgagactggcctaaggtagggacagtagggaatggcatccactccacgtgtacggccacccagaggcaaacctgtgggtcaggccgagttttgtaaagtacatggcaccctcttagggaaggaatctgacagttaggagagggcaaagcacaggtgagagagattggggtccagaccctgcaggatgagtccccttgcccttgatgggcctggcctgtggcagtggaggaccctgtgtctgatcctcacaccctgcaccagtgccacgccagtgactcctgagtcaga

SEQ ID NO: 85579 - DNA, 1129 bp, Homo sapiens
atttctaaaaagaagacatacgaatgtccacaaatgtatggaaaagtactcaacatcactaacaggaaaatgaaaacaaaatcctaaataagatatcgtctcaccacagaatggctaccatcaaaaaaatcaaaaaacaaaaaacaaaaaaaccagaagtaaaaaatcctggcgaggttggaaagaaaaagaaaactcttatgcactcgtggagggaatgtaaactagtaaaaccatggaagtttcttaaaaagctaaaaatagctctccgccagatcgccgccgcgccgccatcttggacaccagccgtgtgcagcctatcaagctggccagggtcaccaaggtcctgggcaggaccggctctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtggggttcgaccacttggccgatgggaatggtctgtcacagtctgctccttttttttggtccgccacacggaattgagatgctcctttaaataaagcgtttgtgtttcaagttaaaaaaaaaaaaaaaagctaaaaatagaagtgtcatatgatccaacaatcccactactaagtatttatccaaaagaaagaaaatcagcatatcaaagggataccagtattcccatgttgattgcagcactattcacaacaaccaagatacagaatcaacctaaatgttcatcaacagatcaatgtggttgatgagtaaagaaaatgtggtatatgtccacagtggaatactattcagccataaaaaaagaataaaatcatgtcatttacagcatggatgaggacattaagtgacactaagtgaaataattcaagcacagaaaaataactactgtatgttttcactcatgtgggagctaaaatttaaaaaaacgttcacggaagtagagagtagaactgtgggtattagaggctgagactgagaaaggtaaaggggagtagaagatggggagaggctggttaatggatacaagattacagttaca

SEQ ID NO: 85580 - DNA, 1039 bp, Homo sapiens
ccggcgctttcttccttctgcagctgaggctgcggcggggccggggctggggtcggggccaggtaggcgggcgggagccagtggcgagcggcagcgagggctggctggctccggcattgcggggcgcaggtgcaaggggcggggagcccgcggcgccggcaggcggacgggtcggggtccctgggtggtggctgcttgggggctcactggggcgatctcgcgcccgcggcccttccatttttccctcccttcttcctctcccgccaggggtcggcgggggcgggggacgggcgtccggtgcctgggctctctcctctccctgaggcgccgctggggagtcgaaccctgatgatgggacctgtggtgagcagccctgaaagcaagcccagacccagccattctccgtccctaagctgacacggagcccctgattttaatttacctggctttgctagttacgaatatatctctcacctcctaaaggatgattttatccaactcagaactcaccccagcagagattgagggggaaccgtgatgaaatttttaagtattctgcttgatgataataatttttctcttatgttaatgttggctccgtttgggtgtttagcttttgaaaggagtatgaaaatgcggaatggggctttggggcttgaggtgtgatctctagtgtttaaaaaatttaattgcacaaatagaaataattcacccacattattgaaccccactaaagcatatcctttttgtccatattcctttcctgctgccctcgtgtgtaccattattactcagttgtgatttgagctcgttccacttaaagtcattcatagatacttttgcgtcgtgttgaatatttattgaatttctattctgtgttttacttaattactttattatggaacctttacacaggtctggtgtacttgttctttgaaaagtcttatgttgaccaccatcactgagcatatagctttttccttatttccttgggataattacccgaagtggaaataccgaatcaaacttctgttttctt

SEQ ID NO: 85581 - DNA, 1446 bp, Homo sapiens
gcttgggagtttgagaccagcctgaccaacatggagaaaccctgtctctactaaaaatacaaaattagacgggtgtggtggcgcatgcctgtaatcccagctactcaggaggctgaggcaggagaatcgcttgaaccggggaggcggaggttatagtgagccgcaatcgcgccattgctctccagcctgggcaacaagagtgaaactccatcttaaaaaaaaaaaaaagaaaaaaaagaaaaataaacagcccttatgtttgaataacttgtgaagtgaatagtcacaaaacatgactatgttgatagtcatttccaagtggatgctccccagtccactccaccatgtcattttgagggtggtcttaggttaggattctatatagaagcctatatctgaagtctagaacgtcagagaccacatgcagggtgttgcaggccattttaaaccatgagagataaggaaagacttcaggaaatatcctggaaaaaatatacaaaggcaggagagctatcttgaaatagtttggaggccatcctgtggaaaaggaatttgatgtttcccataaatctctaaggagagtacaagaaccagtgggcagaagctgcaggaagaggaatctcagcatgttcttttgtttgtttgtttgtttgttttgagacagtcttgctctgtcacccaggctggcgtgcagtggtgcagtctctactcactgcaacctccgcctcccaggttcaagcgattcacctgcctcagcctcgtgagtagctgggactacaggtgtgtgccaccaggcctagctaatttttgcatttttagtagaaatgaggtttcaccatgttggccagactggtcttgaacttctgacctcaggtaatccgcctgcctcgctctcccaatttgctgggattataggcatgagccacggcgcctggccacagcatgttctaaggaagaatttggaatgatgggccctcagcggatgtgggcatcagaccctggggctgttcaagcttctgttgagtggttccttggcaggattcctacagatgggctttgaacaaaagatttaggagggatgggctgaactacctctaagatctcttcctacctctaaaatactttcattctaagtgttccaactcctatcaggaatcctgctgtactttaaggagcttcttatttgaaggttagggggtgtaaaaaaaatgcccctccccccatggctgttactgtacttatatggtagataatcaagatgttagaagtcagttcataggtagcatgtccgatatgcagggcactgtgttaagtgccttgcagaaattttacagtcacctgtggggtcagttttcacagttgtatggatggcagaactgaggctaagagattttgagtattagataacttatgcaagtcctcactgtgagtttaggggaagtattt

SEQ ID NO: 85582 - DNA, 2358 bp, Homo sapiens
cttatcgatttacgagtctccttaaatagtaaagatactgggtttcttctattactttttcagctttttccccctttctcttctctaggcggctaggggtggagatgggcaaagtgcaggtttaccaggaacctaacagaggtgagctatcttgggcatgtggaacattgacctttttgtgaaatgtggcatattggctccgtccttcatcctttactattgaaacgatttgattcagttgtacatttccattagcaagaagtcaggcaggcaaggtagaacagagtggttttttagctctcactaataccagctagatatctaaccctggtgcaagtcatttctggggcttgaactgcagttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagttagtctttatttgcacctaagctgccttgggttagacttcataaaatattgttaagaaatactttttgctaattgatacatgtcattacataattctcccaagttgtaaaaagaagtgttatttaacctttgtaggtccaggtgtgctggctcatgcatctaatgccagcactttgggaggctgaggcaggcagattccttgagctcaggagttgagaccagcctgggcaacacggcaaaaccctgtctctactaaaaatacaaaaattagccaggagtggtggtttgcacttgtagtcccagctactagggaggctgaggtggaaggatcgcttgagcccaggaggtggaggctgcagtgaagtgtgatcataccacagagtgagaccctgtctcaaaaataaataaataaataaatagaaagtgatctttgtaatttctttagcaatggtggatatttgaaattattttaggccaggcgtggtggctcacgcctgtaatcccagcactttgggaggccgaggtgggcggatcacctgaggtcaggagttcgtagaccagcctggccaacatgatgaaaccctgtctctactaaaaatacaaaaatttgctgggcttggtggcaggcgcctataatcccagctcctgggaaggctgaggcaggagaatcgcttgaacccgggcggtggaggttgcagtgagccaagattgtgccattgcactccagcctgggggggaacaagagcgagactttgtctcaggggaaaaaaaaaaaaaaagaaattattttagcaggagcgatggacagcttgcatgggcttgagagttacacaccttatccttgacaagttatttaacctttctaaactataaataaactgtaaattagggctgttttgaggattaagtgggataacttgtgtgcctaccagtttttggcacacagtaggtgctcaatatatacttattcctgttccttttccactagaagatttaaaaaaacattttttttttttttggtagaacaagggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggagaagattcttcctctagaggggattgaatgatgttctttgtctggagtctaggagggaaggtgaaagggagaagcagtggcataagactccaggagactggtccactctccaagtttctgaataaagggagagaaaatacttggtgtttattgggaaggaaggaagtaatatttgtgaatttcttactgttaccagatactgaaaaactgagttcaggagttcagggattgatgttaggtacgaggtccagtttgaatccagatctccctgactctaaagctcattttcttttcttttcttttcttttttttttttttgagacagggtctttctgtgtcactcaggctggggtgtagtggcatgatcagggctcactgcagcctctgcctcctgggctcatgtgcttctcccaccttagcctccccagtagctggtactacaggtgggcaccatgctgccaggctattttttttttttttttaaatatggagtcttgctctgtcacccaggctg

SEQ ID NO: 85583 - DNA, 1004 bp, Homo sapiens
agagagaggcagacagggtaggcctcattgtggaggtgacatttgaacagagactagagaaggtgagggagagtcaggtgactaggtggggagaaaagcattgcaggcagtgggaacgcctagagcaagccccttagcggtgtgagctgctgtgggaggactgaacagggtcaggtgtggccaggcaggaggggaggggcagatcctcaagtttggactggagttgtaaatttgagagttgccaccatctatgaagctgtgaaattagatgagaagcccaaaggacgagagggaacagaaagagaggacacatgagcaagtcctgggacgtgaggctggggagaagaggaaccagcaaaagaaaccaagggtggaaggaggacaccagagaggggcattctggaagccaagtgaccgtggacatggccgcatggaggccactgatgacctttatgaaaacaaagcttcactggactatttgggagagactgagagtagataaattggagatagtgtaagatgtacagcaaaggggagcagaggggagagtggttatgagtcgtgttaatggaagtaacagaatgtttgtggccgatgggttatcagtggtggaggcaggagaggagagagaattccttacataggtgtgccatttggagggattaattttagggccactggcatggaaatttcctctgactgatgactgagggcaggccgactcctggggcacagatgcacatagtgggagcttgtggacacgctcctctgagagtacttaagtagggtggtcagttgagagcagatgatgggggatcttatggaggcctgagaaaagaggaatttattggttggtttttttctgccttgcaccttaggttgtataaaggcatgagtaacacactgctgacactttttggaacagggaatactgtgttgtagatcccttgatgagatttgctgtgtctttgttacagggacgtgaacaccaccatcatggagct

SEQ ID NO: 85584 - DNA, 1050 bp, Homo sapiens
atcatagtaattctttctggagacattttaaatgggttcaaacaattctcctgggttcaaacaattctccggcctcaacctcctgagtaactggattacaggtgtgcaccaccacgcctggctaattttgttttgcatttttagcagcgagggggtttcaccatgctggccaggctggtcttggctcagatgttctgcccaccttggcctcccaaagtgctgggattatgggcatgagccaccgtgcctggccatctttgggaattttttttaatctgttaagtatttcatcccttctatttcttttattattttcctttgggaactattaggtcctgaaaattttggatctagtctctataacttttaaaaacttattttactttttgcatacttatatatagcattctggggaaattccttgtcttgatcttccctggtttgttcttaaagttgtgtttattctgctgttaagccagccagctactgggtttctttagaccataataacttcttccccctagatttatttttggttctttttcataataacttgttctttcttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagtatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgcc

SEQ ID NO: 85585 - DNA, 1162 bp, Homo sapiens
gggccgattatcctttaacaaattggttgcttcaacatgttatgactgcgatatgttaaatagccatttgtttggactgcagtaatttggaatttgacagtcagcttgtattcagattgaattggatatccttgtactttgaaattacatgtaattaggattcttgttgacgagatatatagaaacatctttacactgcatcattagtatttgctggcagagataagagctaatcaccaattatccctacttttttcctaaaagaagtctgtgtggctcacaagttagtaatattttttcataggcaggttcctttcttcattttccaaaggagaattttactttgaactttttctttttttggaaaactttcaactagccaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctacttctaaggattgtatccgtgatgagttccaggcattctaatttgaacttcagtggttcccagcgatatctcttatttttcttccatggactggtattttaagattgttctgtcaactccatttattaagtaaacattttaatttcctctcttttttttccaatcccactctatgattgccagacatacttccttttttaagttatcttccacttacactttcttttatttttattattattattatttattttattttatttctttattttttgagatggagtttcgctcttgttgcccaagctggagtgcagtggcgcgatctcggctcaccacaacctccacctcctgggttcaagcgattctcctgcctcagcctcccaagtagctgggattacaggcgtgcaccaccatgcctggctaatttttgtatttttagtagagatgaagtttcaccatgttggtcaggctggtctcaaactcctgacttcaggtgatccacctgccttggcctcccaaggtgctgggattacaggcgtgagccaccacactgggccttatttttatttttaatagtagaaacagagttttgccatgttgtccaggcaggtcttgaa

SEQ ID NO: 85586 - DNA, 1264 bp, Homo sapiens
catttcaggtcaggagttcgagaccagtctggctaacatggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacttagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttcactcagtcaggctctcccggccagtggcttgcagaccaggccaggctgctgcccttctttggtgctgctgcagagggaagtgtttggcatgtggggtctctacagttagtcctggtttctaagagtctaaggctgttttattctctcttttctttagtcctttgggagacaacattctacttatgttctcttaatgttttgtcccctaggcattagcagaaccaagggctgcatgagttttgagcttgtgtctggtgttttccctcagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccagtaagtgtgctgctgcctctttcccactttcctctgattttaaggctgactacactgttgtctgtgtggtttttttcctcattcttcgtttttttttagttggcaaaaactcattaacacctttcttggccagatagtagcgaatgcatttctgattaccttgtaaattgtaaggccgtttagaagcagtctgtccttctttgcaagacct

SEQ ID NO: 85587 - DNA, 1037 bp, Homo sapiens
aagttttgttttactttttaatataaaaattttggtgtgtgtgttttattccaaccagtgctgattcctaaagaaaagcccccaatcacggttgtgggtgatgttggaggaaggattgccatcatcgtggtatgtagacctcttttattattaattctagtatttgccattgttattctgttgattgattgattgattgattttattacagagactcactgtcgcccaggctggagtgcagtggcacaatctcggctcactgcaacttctgcctcccaggttcaaacgattctcctgcctcagcctcccaagtagctggaattacaggtgcctgctaccacgcctggctaatttttgtatttttagtagagatggggtttcaccatgttggccaggctggtctcaagctcctgaacttaagtgatccacctgcctcggcctcccaaagtgttgggattacaggcgtgagccactgcacctggccaatttatttgttaattctgggcatataaaggcctaaggatagtagtatggccagataattcttattaaatttgtgccttgtgctaaatgtttgctttggcccagaaattggaaaatgctattgtttattttaaaattgctcactactggctgggcgcgttggctcatgcctgtaatcccagcactttgggacgccaaggcaggccaatcgcttgggctcaggagttcaagaccagcttggacaacatggtgaaaccctgtctctacaaaaaatacaaaaattagctgaacttggtggcacatacctgcagtcccagctacttgagaggctgaggcgggaggatcacttgagcctggggctcagaggttgcagtgagccgagatcatgccactgcactccagcctgggtgacagggtgaggctgtgtctcaaaaaaaaaaaaaaaaaaagtcatcctgtcataacatgagatattgttctgtgatcaaagtaaagtacaagctgggcacagtggctcatgcctataatcccagcactttgggaggccaaggcag

SEQ ID NO: 85588 - DNA, 1027 bp, Homo sapiens
ggtggggtgtggccaggccgtgccttcgcaagcctatgggggtcactctgagagccgtccttagggatggggccagctctgtgggcaccaccacatggggcatggggtgggcgctgcccatggttacatgggggttggtggcagcatagacgcatggcagcagcggccaccacatgcagaaccccccacagtgtccagggccttcctgagctgcttagtgaatcctgtaccagcctgagaggagcacagtgccctgtcatttgcagaggtgggaatgggcttggtgcaaccaacttgcttgacatccgactcagtctgaccccacagtatgcacctgctctctgcccccattcacttcttgatcccagggccctgtggccacagtctgaggcccagcggctatgggtgcacgggggctgggcggaggaagcagggtcatgtgcctgaccagcgccccctccctctgttgcagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaacccccagcccagccagatgaaccgcatcaagatccgtgacacctcccaggccagcgc

SEQ ID NO: 85589 - DNA, 1041 bp, Homo sapiens
gctaggggaaaggacccggggccacctcaggtggtggccgtcccagcctggcatggtcccaggggctcccgtctcactaccacctggaaccagcctgtctcacggtgggacctggagtcagataaggtgcaagtgggagaggccccactgacccagctccacatggggtctggggagtcccatctggcagtggaatatggggttaatttaagggtgtgggctctgaaccaggccactttctcactgtgtgacctcatgcaagtctctcaacttctctgaacctcagttttctcataatgataacatctccgttatggataagtgcacagtgactggcatattggcaacgtgaaatgggtacctctgagtgtgtcgtgatcagagagcatctccttcacatctctttgttgttcccctcagcttggacctactccctgctcccctgctcctcccatgccccagagtcccttggggagcaagtcctagactcatcctgactcagaccaaagcctactgctatgagaggagctcagacctgttgaatgtctcacgtcctccccctcccatgaaccttccgtggcttctcccttggcctcagggtaaactcttaacacttcagactcaagatctggctccacttacatgtccagcttcatttactttatatcctctccgatgaagcaagcaggcccctttctctcatttcccgtctgtgccctgccttccagccagcccactaccgccaaatcgccccgagtaccttctagcccagcggaggagagagcctgctctttcttttttcttttcttttctttttttttttttttgaggcggagtctcgctctgtcacccaggctagagtgcaatggcgctatctcggctcactgcaagctccgcctcccaggttcatgccattctcctgcctcagcctcctgagtagctgggattacaggtgcccgccaccacgcccggctaattttttggtatttttagtagagacggggtttcaccatcttggccaggatggtctcaaactcctga

SEQ ID NO: 85590 - DNA, 1390 bp, Homo sapiens
atcattagggttcagatgagggaaactgaggcccagaactgcagtaatttgcccaaggtcacgcagtgatactgtgtcagtgcagaactagaagctaggtctccaggctctgtttaccacatttaataacttttttatcttttagggagatgttcaggaccctaccttcccctttatttttaatatttatgcaagaaagtgggcaggaaaatatgagaagtaatgagttattccttttcacctccagaaaatatcctgtgaaagaagggattggaacagggtgttaaaatgatgggaaaaggtgaattttaagaatccaagcttcctctcattatgtaatataacgaagatttggcagaaaacgtgcctcttgtagctctagatacagaattttaggtgctgacaaaatcttatgctgaatctggcacagcagtgattgagttagcattgataattaagttttcatctgtatttaaatgaacatcaaaagggactacaatttgcttctgaatggtacttgttcggtgcttgtttttgggacaagtgattgtgttggggaagcgcacctaaacttttaaattttttatttatttatttttttgagacggagtctctgtcacccaggctagagtgcagtggcacgatctcggctcaccgaaacctccgcctcctgggttcaagcgattctcctgcctcagcctccggagtagctgggattacaggcgcacgccatccaccacgcccggctaatctttgtatttttagtagagacgggatttcgccacgttggccaggctggtctcgaactcctgacctcatgtgatccgcccacctcggcctcccaaagtgctgggattacaggcgtgagccaacactcccggcctaaatcttttatttatctgtatttttacttttacattttaaaagcttatttatttccctggttttaaaattgggctagtcatctttaccagtctcactgggctattcttttgtaagcagggaatgagatactggttattaaagattttggtaaagtgtaagttactgtaaggcatgattcaggactgcgtcccacaagtccccggaccaggagccagttcggattgtcttgtgggatgtaccaagtttccctggtttacagaggctttttgcctctctgaagcctgagctggccagatggagagctctgtggaaaacttccagcagtgtgtgttgggccaagcactcgaggtgtgaagaaatgtaaaactttcaagtgataatatctagcatcgtgtatgcagccttgaaaaatgacccaacctttgtagaaattctctgttatcactaaccctcttccataatgagcggaggatttcccaagaattgggattctgataagagtcct

SEQ ID NO: 85591 - DNA, 1119 bp, Homo sapiens
tatacctggtgaccctgagccttggagaagtcaaagggcttggatttggggaatttttttttttttgagatggcgtctcacgctgtcacccaggctggagtgcagtggcgcaatcttggctcactgcaaacctctgcctcctgggttcaagtgattctcctgcctaacctcccgagtagctgggactacaggcgtgtgccaccatgcccggctaatttttgtatttttagtagagatagggttttgccatgctggccaggctgatctcgaactcctgacttcaagtgatccacctatcttggcctcccaaagtgctgggattacaggtgtgagccaccatggccggccttggattcggggaagttgaggctggaaaagatgtgaggaattacgtagtttgtatcccttttttgtctgctggacttttaactcatgtattcggtgtaaacagacctcttctgtcaatactttgccgtctagctcgtccgatgtttggcccctttttctctgctatcctaccttcaccaacccacacagtctgctggtgcacttacgacattgtccgtgtatctggggctcttgtgacactgtgacgtctttgaggccagtggtcagcttgtctttacttctccagtaccaggctcggtctctgatagatggtagatgctcagtaaaggtttgtcaccagtattcctcgaggcaggggagcacatttttatggctccctactgttctgtcgcactgttgctgaaatcactactgttggttcagcaattgtgtgtcagttgcataggtttatccacctcatctgcaggtgaggaaactgaggcctagggagcttaagttacatgctcgaggtcgcgcagccagtaagtgatttgaacagatctgttggactccaaaatgttattatacctgttacctacttcgaggaccaagtctcatggggatgaagagacacactgcaagttaacagtggactgagggaggtggggtgatatgattaaggtggttgaggatgggaagagcacatttgttttttgtcagatgcattgtgaaatgaatgtttatgtccatctgttgagtttttgaaaattgacaaacttgccgggcatggtg

SEQ ID NO: 85592 - DNA, 1098 bp, Homo sapiens
tgggaattgtgaataacgagatttctggctctttcctaaccttagaacctttgaaaacactgtggtttgaatgtcaataattaatggatcattttagctgagagacactagatttggtgtttgatctgaaaaaaaaaaaaaaaaagcctaggccagccacggtggctcatgcctgtaatcccagcattttgggaggctgaggtgggcggatcacttgaggcctagagtttttgagacgagtctggccagtatggcaaaaccctgtcttgaccaaaaaaatacaaaaattagccgggcatagtggcatacacctgtagtcccagctactcaggaggctgaggcaggaaaatcacttgaacctgggaaggggaggttgcagtgagtctccagcctgggtgacagagcaagactcttgtctcaaaaaacaaaaacaaaaaacctgtcttcttttgaaccagatccgcaacattgttaaaatgctccctatccatgcattggattctttctgtgactcattcccctagtacctaggtgctggagcctgcttcgttcctgggcatagaaagtccttttcctgattctgtttcctgttggtcctggtctaggcagagtgtgcttcactttcaagccctctagagacaggacaggtaacttaattctctttctgttcaaagcaatacaaggaattggacatgcaaagggctgtaaataaagggactccccatcttctcttcatggtaaccctgctgatatatagaacagggaaaagtaggctcatcctgggggacggctgattgtttagggctaatgcatgatgtggatttaaaagcatttataattaatcacttctgagtgcaggcttcatttttcctcttggtcccacccctcttaggtagttgcacgttgcagcagctcgatagctgagaacaccaagtggtacagttaatttggcttcaaaggccatgtggcagatagctttggaatgaggtgtgggtactaatgggcctcctggctgggtggctttgggcactttaatcactgagctttggtgtcctcatctctaaaggggggctcgtaatcactacttcatgaaataga

SEQ ID NO: 85593 - DNA, 1865 bp, Homo sapiens
ttaaagcttgagatgggatggggtaggtgcttgagtgtgtgctggctcctgcagctggtgacgggtggatgcctgctgggagcagtgagctcccaggtggccagatggccactggctctgatgagacagcagccttggggtttggttttctgggtagtagggagcagggtaggtcttgagtgggtgccacctcaagtgtttgagaagggggccctgcggagtaatctctgtgggtgggggcctggcccagactggcttcctgagactggctagatagcagttctagagatggagaatgaagagaagccagagttgagttgtgtttagggagtaaagggggcctcagtgctggctgggaagtttggatttgactccctgggagcctgcaaatcatgtggcctggaaagctagaaaaatgcccatgatggggccctaccccagaccaatcaagggggagccagtaatttttagaagtgcccccagttaattctcatagtctgtgtgggttgagaagctgagctgtgtgcttggaggagcctctgggagtgtcagggattggaaggggaaaattgaagccagaagaagcctttgaagtaatgtggtgcggggactgggttcctgagctattgtagaatgactgtggattggctggtggaatcagggctggagaggaactggcagaaatgatcaccctggctgaaatacgcctctaagctaccttggtaaataaagaaggacagcttagtagaaagtttaaacaagggatgggcagaagagactgtgatccacctatttggcaagcctcctttcaacctgcattttagccacagagcaggcacagcaggttcttatctgttctctcaagcttgctagccaagttcctccccacaccctaaattgtaatgactgcagcagatggtacatgtaaaattttaaattacatttctttaattttattaaagatagttgtaatgtggagttactaatttagatagattcagtttattagtcaaagtctagaagtgggattttacatggtacagttaatgcatgtcacagtgtcattgtaatatatggtatttcagtcaaaaaatgagtttatagtccacttcatttattctttacttaatgcttattgagcacatatgtattatgtgctgttggctgggaacgcctgagtgaataaaatttaagttcctcttacatttcaaaatagtttttggtctgcagatggtggctcttgcctcagtaacaagtaatattagctttgggagatagctgggggagggaagtttagaaagtggtgtcagacactagaatggaacctgggaaccagagaaggcttcgaggaaatagtatgtgagtcgagtcttgaaggaaaagtgggagttctcagggacagagatgagaggatccctggccgagggagctgcattatgcagaggcctgagctgagcaaggagggcgcagaggaggaagagctggacatgtggcagaggcccagctgcctgctgaccagactctccaggcaggacaggcgagcttggtgaggtttgactcatgggctgtggttttcacgtagccttttggcggtgagtgggcaggactgtgggccttccaccccacctctaatcagagcatctctgtgctggtgaaagtggggagctaaaaagagcccacttgagaagtgttcctctgctgttgaagaacaaccgaagttatctggagctgcagtgagcaagctggcaccctgagggtggctgggagggagaggttggaggtttcttccagaggacctgaagagccctcacttttttctgtttgcagtgagatggatgttccctcctctactccaggccagtttc

SEQ ID NO: 85594 - DNA, 1048 bp, Homo sapiens
atttgttggtcatagttgccaatattaaaaacaggagatcttacatagcctcctagtcttgcagcttcattgacaaatcagaacacttggcagcctggggcctgtactgttgcctggtaacagtgggtcagagccagtgtcggcgccatctctagttggggcttgcgggtgccagttctccacagacttccaccctccacatggtgcctgcttatttcccctggttgtctggtccctgctctggggacacaggggcttacacagagtccagtcagggcagaatccccaacgcagggtggctgagtttgtctacctttctgttcataccctgctacttgcccccctgcacctcccccctcacttactgcctctataccctttccctgaagcctcttctgcctctgcctggcacacactgtccctcctcctctctgtgcccttctctctctgacccagggctctacattctgcagcatctctggtgctattttaggtgggattgtttgtgccatgattccttgtctcttgtcccctccttttctggcacccaacactagtacattctgatgccttcccttttatgtcttgcattggtgtttgtgaaaagcaagtctttatagtgtacctttagagcaatatccattaaaaaccaggatcacacaacaagcatgtagttgaacatctgtgtgccttgcactctcctagacattgggaatgccatggggactcctgccctacctctagttctagaagagggataggggaaacaaatggataggcaatcacagtgtcagcttcttactgcatctggagaggcaggatcttgcttccttcagctcccaagcctggaggtgagctctctttgcactgtgtgttgggtggggttgtttgtggggctctgttaaaagcgtttcagtggaagatccctgagtttgcagacatcgcctggacccccagcttgtagttgaattttttttttttgagaagtgcagttgtgtaatctcagctcactgcaacctctgcctcccaggttcaagcgatcctcttg

SEQ ID NO: 85595 - DNA, 1023 bp, Homo sapiens
caccttggcttcccaaagtgttgggattacaggcgtgagccactgcacccggccaggtagttgagtgttgagcaggcaacttggaagcttggatatcatacaggttgagtatcccttgtctgaactgcttgggactagaaatcttttagatagtagacttttttggatttttcagtgtttgcatatgcataatgagatatcttggggatggaacccaagtctaaacgtgaaattcatttatgttttgtgtataccttacacccatagcttgaagataattttatataatattttaaataagtttgtgtacaaaacaaagatttgactgcattttgattgtgaccccgttgcatgaagtcaggtgtggagttttccacttgtggtatcatgttgctgctgctcaagaagtttctgattttggaacattttggattttggattttcacattagggatacctaatgtgagagagactaggccgcacagctccctgcactgctgcctggtggtctgaactggggctctgattgttttctgaggggccttttgtgtgccttctgtgaaggggcctgcattgagtgagtctacactgttgggctcagtgtggagcatacctggttgagccaccagagtttgacagcttaagggcagcctgtcattttatctacagagtatattaatgataaagatctttggaaacttacttaaaaacaaaatgaaacatttcatgatggaggatttcaaacagaaaaatagaataatttagtgaactcccatcacttagctttaacagttaattctaggctccccctacctcagatgattttaaagcaaatcccagtattcactttattggaaaatgcttcaatacatatctctaacagataatggactctttataaacttatttttaagtgaagactgaccaccagccttcctaattctgattttcatatttctgtgtttgaagctgattttttaaaattgtggaataatgattatatttacacaaaatcttgattga

SEQ ID NO: 85596 - DNA, 1084 bp, Homo sapiens
cgtgtggacagcgcggtttgtgagaccctgtgagcagggttcccacacagggaaaggtctctggttccctgcccactggtgttaggcccacctgactggtcacagagccaaccccagccttcccacaagagtgcagccacaggggtgagaccgctgtgtcaatgagtctagccgacggcccaccacgtgtgtggcccatacacattggaagtctatgtgtgtgccacatcatattaccaactggtggatatttaagaaatccatttgatagaattaaaaggctactgtgaaggaatcttttttccatttggaagaaaaaatcagtttataatttggaatggggaaacaaatattatctgccttcaaagaaaaaaattcattatataacatagcggctgctgaatcaagtcttggaaatttgtgattttttgaaaaccgccctataaggcttatggaaatacaatttggaatccattagcttcaggtgtttctccttttggtgatagggaaacatggttttgctgctgtttttgtcaaatgtgagagtcgtaggttattgatctggcatcttttgagtgttgggtcttttttttttttttttttttttgagatggagtctcattctgtcacccaggctggagtgcagtggcacgatctcggctcactgcaagctccacctcccgggttcacaccattttcctgcctcagcctcctgagtagctggcactacaggcgcctgccaccacgcctggctaactttttgtatttttagtagagacggggtttcaccgtgttagccaggatggtctcaatctcctgaccttgtgatctgcccgcctcggcctcccaaagtgctgggtttacaggcatgagccacagcgcccggctgagtattgggtctttaggggtcaaaacttttgatctttgcttgcagtttttgtttttttctcttttacactctccctgttccctgattaaatgaaggccaggcttgcctagttccagggaaaaggccaagggtgcctagagcaaggtggatgggactttgttcgcagatgggccttgagagagcgacccctcgctc

SEQ ID NO: 85597 - DNA, 1627 bp, Homo sapiens
agaagagaagtggggcccatccctggggcccatgagagtggttttgtttggacaagtcattccggaaagcgttcactagtaaggagggagttccaggatagaaattacgtgggttggccttgaaagctggttggtggaaaaacctcacatcttccaaggagcgtcttagatgggtatgatgatattggaacagagaagggcaaccacatagaagtaatataagtagaatggaggtttaggattgagcacttctgagtttcacaggaggcattgtggctgagagcttcatcccagttctgtgatttgctgtatgttatcctctctcttgtgtaatgcctgccttgcaaaagtgcagcaagatcagtgccatgaaacccctgggtcagtgcctggcacatggtaggcattcagtaaattatagctgtcaccttggtgcatttgaccagcagcagctgagtctgcagtcactgagtcaccagacctggccttcctgaggccttgggcttatgttttccttgtgaggcataaatatgctgaagaacatccctgttttcttggcctggtcctccctgtggtggctgaaggaaagaggggggctggagcgagaaggggggttaggggcatggatgtagccagtgtatatttggagggcaagtaaacagttcttccttggcctctcggcacaagtttctaaagtagagcgatttctgagtttaggagcagctgggcagatctgcacacgcacccagttgtcagtgctggaaacgcgcccctttattattatttttctaaacaaagcaggacaatggcagtgtaaacattgtttgaacaaaaagcatttggccaatggagataaaaccaaaaggaaaataacaactttgatttccttttggttttgtgttttgacatttggtagcatacttctaatcttttaggaattataaaaattatatggtttgcgaactccagtttgtttatgctgttaaatttagtgcgaagtaaactaaaaaattcccctcctgttgggatgtcagcttgctcccatttttgtttttctttgagaggcatggtcaaaggaccagtgggacctgaagagggcccgtcaaaagcatgtgaggcatgtggggaaacctgtagtgaagcagaaagtgcagccttatttcctacagctctctcatgttccttatcttgctgattctcgctggctgccatttccattttacaaatgaggaaactaaactgagattcagtgaggtgactaaaaggtgctgggtagagcagtgatcttttcattctgccaggtagttattttaaaacttaccaatattcataggccatgttttatgttcagtgagggcatttgtggtttggtaagggtgtagagaggatcagagagcttggaggaagggagagagaaaggggggagtgtgtgagcaggtggggctggactcggtgccctgtagagtcattcattcttgcagcagatgtgtgccaggcactgtgccaggcccagcatgcagcatcaaggagacagtcggggtctctgtcccttgagagcctgcagtccagaggtcgtgggaggaaggaaggagggtggagggaaagccggaagcccaggcgagctcca

SEQ ID NO: 85598 - DNA, 1053 bp, Homo sapiens
atggcatgatagccaaaaaaattagtaacaacccaaatgtccatcaactgatgaatgggtaaacaaaatgtggtccatctttacaaaggaacattatttagccataaaaagtaatagaatactggtacataatgcaacacggatgaaccttgaaaacactgaacctgccgggcacggtggctcaggcctgtaatcccagcactttgggaggctgaggcagacggatcacgaggtcaggagatcgagatagccaccacgcctggctaattttttgtatttttagtagagacggggtttccccgtgttagccaggatggtctcgatctcctgaccttgtgatccgcctgcctcggcctcccaaagtgctgggatgacaggcgtgagccactgcgcccggcctaaatgttcacatattatttcatttgtgtgaaatgtccagaatagggaaatccatagggagtagatttgtcattgccaggggctgggagtgaggacgtgtgtggtgaccactaatggatgttgggcttaattttggagtgttgaaaatgttttggaataatagtgaaatagtgatgattgcacaacattgtgaatatactaaaaaaaaaccccgttgaatcgtatactttaaaatagtgaatttaatgctatgtgaattatatctcaatagaaacaaaacaaaaagatccccccatatgccatagcagtaatacctgacttcgtatatgttacttaaagtgagtatttgaatttaaaagtaagttgatgtgaagaaaaatatgaagcaagcagtagagcagctttttttttttttttaaaaaaagacagagttccactctgtcgcccaggctggaatgcaatggcacaatctcagctcactgcaacctctgcctcccgggttcaagcgattctcctgccttagcctcctgagtagctgggattacaggtgcgcattaccacacccggctaatttttgtatttttaatagagatggggtttcaccatgttggtcaggctggtctcgaactcctgacctcgtgatccacccacctc

SEQ ID NO: 85599 - DNA, 1206 bp, Homo sapiens
agccaccgcgtccggccaatcagcttttatagtaaggatttgaatgggctaattcccgggacagtgcttgcacatagtgggtgctctgtaagtgttagtcattgttactattgagaagagatggcaaaaatcttgaaggtgaacaactcaatttggcaagtgcagatttcttgtgtgcctagtgaggccctgttggtgcagcctcagcctgccgcagcctctgcattcccagctaccttagtggcaggtgtgtctccctgagggttctcactctgcccgcagaggcctcctcttccatactcaggcactcatccctctcattcttcattgcagtgcccttgatggccccaagtcttgtccttgtcttctcaggagctgcctggagcacccagttgcagtgttttgttgctcccccagtctagacagggtgccacatctgtgcttgttcagatcccctgtagctgctggcatggggatctggtcacacagtgagtgtgtgaaaaatacttggcaaacctgtgtcaactaaactatgaatacatctttttttttgaggcagggtcttgctctgtcgtccaggctgaagtatagtggcatgatcatggctcactgcagcctcaaactcctgggctcaggcgatcctccatctcagtctcgcactcccagaagtgttgggattataggcgtgagccaccacacctggccttagtacatctttataatgacaaaacgatgttataaatcaggcaaaaatattttaaaaatatattgcagagtttgtatatcttatgaatgagctgttctaggaacagactctagaaaaagctgacccacgtgtcccaggagacatgcatggctatagaagcacttttcacagtagcaaaaatctggaaataacccagatatccatggacaggaacacgggtaggcacatggttaaatattggcatgatcacatggtacacagcggtgacagtgggtgagtgtcagctagctgtgcataacaacagagagaacctcagaagcagtatagaatgccacaggcaggctggggaagactgcatactgttcagttttactagtgtgtgatacaattatgttcttttttaaaaagtgagggactgaaaacccaataccagggctgtttgccttagaggtcaaggaggtggggagagggaagtgaggggagccaggtggctggacatg

SEQ ID NO: 85600 - DNA, 1054 bp, Homo sapiens
actggcttcttggtgctacagagcggtcgcagcattggccctgatccctggattcccatctcctctcactaccacatcatgttatttgcattttggcatgatttttaaaagaatgctgttcataatttggtcatttgtaagactgctttgaggaataggagaggtaggggagcattcaacaattctcatttgcctttatggagtgttgctgcctgcactttgtgctgtcacagtgtttgatcctctacactgagggggaggtgcagctccttgccatacccctgttttcctggattggcaggaacagccaaaaccaggtctccagaccccatcttttcttcacacagtctttaaaaagactgcatttcctcacctgcccatgtattctacacccacaggctgctcctcccagagactaaatgataagggcatgttgataacaagaaattaaattccttgtgtatgttttggtacttgctttctgcttttagaaaattgagtacatatcaagttctaggaggccaagtgacatctaatttgagctctgctgtgtctgttccagtggctctcagatcctgggagaagctgcctaggtggcttcttgagggtggacctcctactccccttcaggagcctctgcctggtcatctcgtcctgcaaataaagtggccattctgtgggtctgctcagccttttttttagaggttggttcttcctatgcagtcagcccttcctggctcccctttggcagtaggttaactgacacctgcagggatctttcttccttagaagaaagtcccaggggagacaagtaagcacatgggcagtttaccttttcctgctctactgtctagaagtcaagtctgaaatgtttgtttttcttcaaaattctttaagtatatgagtataaaggttttttagcccagtttttggagactgataaattttttattaaaaaaaaaactattcatttttatagacagggtcttgctaggttgtccaggctagatttgaactcctgggctcaagtgatcctcctgcctcagccttctga

SEQ ID NO: 85601 - DNA, 1082 bp, Homo sapiens
atttgatttctctaaccaacaagaagtcatcagaatatagatgcccactttcagttagtgaagatgtttattttttggctgaatctcactgtttttctggtatgagggaaataaaggatttttttcttttcatttctctacgggatgagcaacagttattaggctttaagttattgctagcgtggctgaaacagagtcataatagtcttttctcttttggctgaaatgatgactgttgaaaagaatgtagcactgtccatattgtcctaactggcctgttgtcttctggagagcccgtgtggtttggtcatgtggtctgtggtctcagctaccccaactgggcctccttgtaatgatcgttgtacccttttctccggtaggaagatggagatgtttcctcactcgtggactgcacctcaggaaagataaagccagtgaattgaggattgcggagtattgcacacattcaggtgtcctgcagtggacaccatgacactgactccagcatgcctagaaatcaccatgggggcttaagagagtggcaccccctcagctctgcccccagaatgactggatttttgaacagactcccaggaagttctgatgtatctggttgatggaccacactggtggaacactgtgggaaaggtggggtgtacccctttcccaagcattctctgtcatctgcttttagaaaaataaagtacatgtagaaacataggaggctgccagacatacataggtggagctaccatctgaggtgaagatgttcaggtcaattaattcacccgtatttattgattgggactgggttttcacaatgttgattgacctgtgattgttaggtttggggaggggagtggaaagacagctccctgacagccgagcgtgatcttcaatgatggctgctccccatagtttccttagggacttgatgtagaccccagctgaaaggtgaacatcctcctctcagcacacgatcagccacaccttggtggcacagaggcacggggtgtagagatgtgtgccttcaccacaggcccacctgcactgcttggaactgtgaaaagcctctgtctccc

SEQ ID NO: 85602 - DNA, 2004 bp, Homo sapiens
ggcaaattgtccttggtctggattgagttttggttataaagggacttttagtcccttggctgctctggttcagggatctctaacgccctttgctgctctgggcctcattctgtacatctgggcagacggtgggcagaggcaggtcttttctgcttccttgtcagaatgggtctggcagcaaaggagttgtcctgctgcacatacaatggggagttgactctggtagccaggaggaaacaaatgctctttcttgataatcttgtttctttaatctcatattaagtgtttttctgctgactgagcttcaggtctcttgaatggctcagtattattctacttcagcaaaaaaacttgtacaggttgctagtgtgaacaaggcctccctgccaaacatgcaaatgagagttgctagtgatctggttgcatggctgggtctgcattgagttctggttttgcatgttggattaatttgggtctttgccttatggtcagaagaggtttcagggaacagagtggagttcagggcctgatggaagctggtctctgtgagtcacattggcatcctggctgttcattggaagtggtcccccaacaggtgtttctccattttcacagtgctattccagccacagtgtggaccccacactcagagagacaggtggccctagtggcctttgggggacagggtgaggatggaggtggggattgtagaaattatatcttctggctgctaaaacaaaagtgcagatccctagtaacactatgtcagcatagcagaaaacttctttttaaaggaagttgtctgtagtttgacagacctcagtcaacccttacttagtcagtgttctgttaccagaccatttactaacatttcctgcttttgcaggtttcgatttgacattgtaccgccaccactagcattttgagaaatgtgttaaatgagagatttgcatattaaagtcagatttcctgcttctaggaattctgaattattaccgagcttggagcaggttaacatattcttgtcccatatgtagttgtcatttttcttcttagtttgaactgttttgcttaagcaaaggttgtgaccttggttaaaccacttgaaaacaatttaaccttaatctccagaagcctcaatgcagggttaaattgcaccaaaacaaatgaagattgccctttaagaagtgaaattgttttatttctctcaaggatcctcttaccaacccccagagaggctctctttggattgagttggtcccaacctgccttgacttcctctgtccctgtgactgtggctgtggctttgatgcaggccaaggggagctgccattctctttatgtgcttttcatggtcattattctcaagaagccagaggatgctaagcaaggagctgaaacagcttcatgttccatgaacaatttgtggaactttgcagatgcaggggttggaacagtggggatgcaggagcctggtttgatccacccctcctcctcataccgagtccagggcctgtagccataggtcctgctgggctaaatgatactgctgcagttccagctgtgatgtttttggttccctcagaccttacgcttgagctgcatgttcagggtcagaatgtggtcagtgggcttttcacagcttccaccgcagtgggctgcggggttgaccccgagtggccttggcccgtacctcctgcaggggctgctgcgcaccctctaatggcgtgtctctctgtgtgtgtgtgtgtgtccctgccccacagcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgaggtgggacggcggtttgcttttttccttactagaaatgctgggcagcttgctgggggtgtgcttgcca

SEQ ID NO: 85603 - DNA, 2088 bp, Homo sapiens
acagagagttagctgtactgtcaattctaggtcacggtgtttgaagatacctaattcaatgggtaactaaaaatggggcttctctttctactaattaataatgtatcctgatcagagccttacaactgtagcaggttaaactgaaaacagattttcactgtttcctacaagaaaatgctctcagtctaccattggtcccaagtgggttctctgctacagggaagaaaggtgtctgttctcttctactcttcttacaagaaggggcacgacagagagcttttgtgcgacttccctgataaggtgaccagcctttattcagccctggaaacagttacagttcattcatgcctcattaatattacagcttgtttgacttgggtatttgtgtaataactatatttaactctaggatattttccttcatgtccctgttttcccctaacagtttatacaggattttggcttcttctaaactgacattagaaaacgtaaggaaggccagctctgcactgtaaagaatgtaaatgataaaagcattcgttaaagggtcacccagaggcattggagttacatgcccatttcacccccccagatagtcagaggctgctgttctcagcaggtcccgcggaactctccatggagttccctttttgtttttcccatgttctacccatttggtaactgacaaggtctgttttgagccttggtggccaattttgtgttaccctggccctctagctctcccgctggcaaactggctttcctgggacgtttgcatgttaaatacagcctggcaggcctgcaggctggccatcttcccccactgcggctgtctttggccctgcctctgcaccttcgcctgtgccattccgttctctctgcttggatatcgctcccaccacctgccccctgttcccccaacctggcaagttgcttaaggtatccaccccgtgtggatttatgttgtccttcagccctgataggagttgaagataaaaatgagtatttttttctttgaagatttctcatgccccagatgagttttgagcaaacaagtgttatatggattgcatttcatcctttaactgttgggtgtggcatcctctccacatctcactccctccccgtcagagggtagggggctgtcggagtccagggcaaagattctggccatgtttcttctctgttctttcttgatgcttcacaaagggttgagtataaggtaagtgcttaatctatgcacaccagtggatttgtttggagcacaccttcttggaaatcagcagtgggaaggtcagaatgatgccggccattcagaaaactgtcaggtgagatgcaggctgtgattcaggagagatgtttgtgaggggtgcatttgggactgcagaccccacagaggcagaggaggcagactgctcagaagccctcttcacatgagagcagccacagccgggaaggcctcttgtgtgactggcgataatcatgaggatgtctgaggagagctttctttcatgtgccatatgtcatctcatcctccctgtgcccctccctctctctcacctcccacatagatctgtagatctgaccttggaagtctcttgaattgtccatcttgttccatggcctcaattcagtgccagccttctgaccaatttcctgctgtcattatctcccagtctcacctaccctccatcttcataaaggatgccctggtcctgagtctcagcccctttagatgccaggccctgcagggccatcccagagcctttgacgttgcagacctcagttgcttccaccagctgtgtcccctgccctcagtctgggggtcctcctgttccggcggaagcattccagaccttcccaggcctgctgacgtctgcctgcaggcacagctctgggctttccttttgaagcctggtctacctgccctctgctctgtatttattgagttcccatggggcaccaggcactgagcacagaacagagccccttgccctcgtggagcttatatggtaatgggaaagaaaaacacaatataaattattcagcatgttatgtaatgagcgctctggaaaacagcaaaacaaa

SEQ ID NO: 85604 - DNA, 1083 bp, Homo sapiens
cgacctgtgcatgcacctgtctgtgcatgcatgtaagcctccacccaacaggtgtttgtcagccaggggtgagtgctacaagggagaggtgcagaggtgcagagtctgacacagcatcaggatggaggggaaggaccaggtccgggaagccgagctctgactacaaaagaggaggtgggtgcgctgagggaacagcctgcacggagacccgggaggaggacagggcaaggaaccatctaaagcagtagctccaaatctctcagagggcaggtcttgttctgagagttttagagaagctatggacccttcctgaaacgggggcagaggtgggcacatacttctaaaactacaataatttctaaaagcatttagattccctgatcgtgaaacatcctgatggctgtgtaagccccagcacccagcaccatggtttatgttgtgaatgttaagactcccgtggggtttgttacatcagctaggagttcacatctcattcattcaataaaaactgtctttccaggagctgcttagaagtatttaaactagctaagtgcacagcaaaagtgtctgcatttttatctgcatttctttctaatcagtgtacaaagctgcttacagaacgaaaatgtttggggtcactgcagaaatgggcgggcttcattttccatgatctcgtagtaacactacgagagacaaaggtcaactctttttttttttttttttttgagacggagtctcgctctgtcactaggctggagtgcagtggcgagatcttggctcactgcaacctccatatcccgggtctctaagtgattctcctgctagctgggattataggcacacgccaccatgcccagctaatttttgtatttttagtagagatggcgtttcaccatgttggccaggatggtctcgatctcttgaccttgtgatccgcccgcctcggcctcccaaagtgtgaggattataggcgtgagccaccgcgcctggcctcaaaagtcagctcttgaatgttggtgtgcctggagtggagtctttggtctccagatgccctccacctgtttgaaggatgctctttggttc

SEQ ID NO: 85605 - DNA, 1044 bp, Homo sapiens
tcgtgcctcagcgtcccgagtagctgggatttcaggcgcgtgccaccatgcccggctaatttttgtatttttagtagagacagggtttcaccatgttggtcgggctggtctcaaacttctgacctcaagtgatctgcccacctcggcctcccaaagtgctgagagtacagtcttgggccaccgtgcctggcccccatttttctttagtaagcatgcattactttacaacagcgagaagggaaaggagcaattagagtggccttacaaattgtcaagcctttggttgcagttatcagggctgtctccaatgacctttggttaaaaaaggtagatgggaccaggggcagcacagggattcctctcctctattagaagttggtgttcagagaggaatactggggatagttagatttgagtactgacaagttcatcccggcattgtttgtgtgtctataactggcaacattctaaagctcagtgacagtgggcaatctcagttgtggcctctctgtccctgcagtgggaaacaggccaccagtaactgcccaggtggatgcatgtggcttcatggccagcagcccaggaagaaggtgcgtggtagcatccactgagaaacatagggacagacggacggtttgagcccattttagttaatatttataataaaatataagggagcaagttcaaactcccgtgctgatcagtagtggcattgtccctgtgaatagctactgtgtagcagcctgggtaataccatgagaccctatctcttaaaaacaagaaaagaaaaaatacaaggaatatattatttatatttaattattatattatataaaagcttaggacaaccctgtcttttgcatatggtgactttgccttaaataaagatagtgaatcatttctgttaggaatcatagaaatatgcagccattttccggaagcatacacagtggaggtggaatgatacgtgatttttatcttctttctaattcctttttgggttgtcagatttgtgttttataaggacacacattgcttctataa

SEQ ID NO: 85606 - DNA, 1053 bp, Homo sapiens
ttgcctgctggatgggtgaggggcagggcagtgcttcttgctgtctctcacccacttgggtctggtcgattgtggtgggtgtccaggctcctccagccctcagcagtgatatccaactggcccttgccctcctccttgaggatggtggcatggtgttccctctttgttttgagtggttttctgctttgggagaaggaaagtcaacctcccctcaacctcccatttgcatcagaaatggcttgtgccttctctgggacatgtttcaactcttgcagcctcagcgttacacccagcgtcccagctgaaggaaccaaaatacacagcatggaacatccaaatcaagctgctgtaattagatggaaattatgatgtgcttaccaccactgctgatgaaaaggggatacatttgctataattctgcttgttacttaaagcaatagaaaatccgtttaataggctaaatgaatattttaaagttttgcttaatgtgagatgtaagaggaattgtggtgggaagttcaaaatgtgagcatgacacaactggtttgatttgggtgatgatcttgggcccacgagtttcttaatcactgggcaggagcatggcccagcaggctttatgaaggcttcctggcctggtgccctgggaggcccctcctggtgtgctaaaccctactgggcgtggctgacctgtgggctgtttgggaactttgtatatcttgtggcatcttgcctgtatctcctggagtctctgtttctctcagaaccgtctcttgtgtttaactcggttccctagatgtttgctaaaatgtaccaagtgacaggctgtgttctgctgtgcatgacccctgagacaacaggtgattattgtccctgttgtctgttgtcaaggccctgctcaggagcgggcagggcaggaacacagcgtaatagcagtactgtgtagtccaggactcgatggaggttatttgagagcatcctgggatgagatgagactcagtacaggagtccaggagtgtgaggtaagcattttggaggaaggccacttccgttgag

SEQ ID NO: 85607 - DNA, 1007 bp, Homo sapiens
ttaagaatatggtttgagctaattaaaagctatctgaggatgggcacatgtggcttgttgactgccagttggccatctcttgccacttgcccagcctaggaccttcttggttctgatgcacttggcattattaccagtgacttggggaggagataggccaccaaagcccatagacattgttaataggtttgggacaggctcagtgcttatggcaccatgtcctgtagttgtcacaccatcctggactgctgcaaggcccttctgtggccctggcatgtcctggaaaagtcaccacaaattccaatatggagagatagccactgttaaaatgttagcttgtctgcttcctgtcttttttctgggcattatgtttttactcagttgaagctatattgtatatataattacgtgtgtatgtatgtgtatatttcaatttgtagtgtcatgagcatttctaggcatcattagaaattctaaacaataccacgctgtaccatcatttactaagcagcctagtgatgttcataggggtgtttttgcagttctggcactctgctttcaatagaaaaatacattaaaatcacagtgatttcttttaattctgagattcttttctcagtggtggtgttgaccagctctgcaggagaatggccctctgctagctcctgcattcactgaagcgtgttagcacaccctctgcttccacattccatcagcgtagcctcagagcaagagtgtggtattggatttattgtttagcatctagttaaatccaatagtgcaaattttcagggtcacccctccatcctgagactcattcataaattagaaagattggagtcccttcccctaacagtgttagctgtgccctctggatgaaagaaacactgttttgaaagccaccatttgtagtgagccccatcattaccagttttttccaagcagcactaggagcaacttggccaagtggccttgggaggaaatgctcagggttgaaaggagggaga

SEQ ID NO: 85608 - DNA, 1089 bp, Homo sapiens
gatggctgcctgtgacccgcatgctggctgtagtggctgtctgtttctctatctcagagggaggggccatcctggggccaggcctggggactgctgaccaaatgttgcttggatagaacaaggtgaccgtgggagaccagagcttgtctccaccacgcatctgcccactcaggcttgtaagtctgagctgggtgctcacatggggcctcatttttgaggagggcttggtgagaggtctgggtgcacccagagctcagtgtttcttatgcatcctgtctgcccatttgagtcatctcagtagcttctaaaaatccaaatgctcaggcccaccccagaatctgtgtgtatgcagaggacagcatcagtattttactaaaatccctaagagcttcccaagaagaaccatggttgagaaccactagtctggtgccccctggcccagggtgcatgaataccactcagtctaagacacttgaaagctccatgtcttagataatcaggatggagattatgggccactctaatctggttgtgtttctgagcccctgaattggacatttatccagaacctgttagaagtggtcactgaactccagtgtgcagagatgcagataaactgcaaagtccctgccagcctgaggtcctgtgggtcccttgatccttgtgacctctcttcaatccctagttagtgatggagcacaccctctgtgtgtcaggcttggatctcggggatgggcagcaaagcagacccagccgatgttctcatggagcacatgctttggcaagggggacagatgcagtctcacatgcacacaagcggcatgagtgccctgagaagggttttgagctgggtttagagtgggaactgcatggcgggctggcatagaggctgcagagtgggggctgggccttcccagcaagtgccccacatacagtatgtcaggggagccagtttgttcgagatgtgatgctgccctcagcttgacccagtggctaggaggtgaccaccaacactcagaccccctttgctgtgttgttcacctcagaagctcaaccctttgctctggcacgcacagtggctgcctctgg

SEQ ID NO: 85609 - DNA, 1057 bp, Homo sapiens
aaaaatatttaatttttgtttcttcacttttgttttttaacttgacaagatgattttgagatgactacagaagagcagagggccaagaatagccaaaacaagattgtgatttgctgtatcagatatcaagaattctcataacactgtttgtgaggataattaagaaggtgcaagtggccaggcgtggtggctcacgcctgtaatcccagcactttgggaggccaaggcgggcagatcacaaggtcaggagatcgagaccatcctggctaacacggtgaaaccccgtctctcctaaaaaatacaaaaaataagctgggtgtggtggtgggtgcctgtagtcccagctactcgggaggctgaggcaggagaatggcatgaatctgggaggtggagcttgcagttagcgatgattgcgccactgcactccagcctgggtgacagagcgagactccgtctcaaaaaaaaaaaaaaaaaaaagtgcaaggacggaaataggtaaatgtagagagcccagtaataagcccacaaagacttgacttacgacagaggaggccctgcataccatgctgcgaggagtggatggactctagtccatgctgctgggatgagtcaagaagaaggtaaccataagggacgatcggtaaaagactcaaattggcaccttataggagaggaatcatgagtgacccatgagtatatgaaaagatgcacagcctcattaaagaacagggaaatgcacatcaaaaccacaatcaaataacttttcagcccaccagattggcacacatgggaaagtaagctaatactaagcatcagagaggttatgaggcaactcctggggcggcaagactggcacccactgctggatggaacataaactcgtgccaccatgtggaaatagttgtagcattccttggtgaaggcagaggtacccatgacccagcaactcgtgtatacatgtgaacaagaacaagcagcaaaaccaaacgagtatccttcaacagaggaatcatgacttttttttcatagaatggaacaaaacaaattccagctccac

SEQ ID NO: 85610 - DNA, 1114 bp, Homo sapiens
ctacagagcctgggccgaggtgggagggctgcctggggccccttgtctgaggagggagcctggattctgtggggagataggtttgtttcagatagtccatcgaagtggggttgagctcaggagccctttgcaagccccctgtatggtggggagcttggagagaacctctttcagctgcttcctctggtcattactagaggacagggagaggttatcctgggacatcctggcctagcatgcttccttaccagggttgttggccctgggccccagctgtgtccctctttgctggcgtgggacagtacccttttgatggctgtctcacctggcacagggcatagaccctggtgtggctggcagtatccttttcccttctcaccccagctgcccagaccctctgaaggcatttctgagccctgaccctgccttccaacaggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctggtgagcccctcactcacccactttcctgcctggcctctgagcgcccacgggccctgcagccgctcctggctcctaggcatcagccctgttgctttgcttgcatttgctcccctcctcccccttagcctttgttcctgatccccagatcccaggtgccccagtgtgagagtgagtgagtgcgagttcccaggctttgtgcgctggtacctccctccaaattgagggggcttccacctgggtgttgagagagaagactgccctgggcccacagcctgtgggtcctgtcctcacccctggggggctgggcaggctggcctccaggcactccttctggtgacttcctacagaccctcatccaagcaaccagacccagcttgatgcacctccaccactgccagcacccctttgccttttggggtgagggtgttagaagcagtagcaggtgggcatcccacaccctgtcctgggaggccaggctccctgtctcccctcccagcgtgc

SEQ ID NO: 85611 - DNA, 2054 bp, Homo sapiens
tcctgtaccgtgaagcatcccgtcgtggcaatcacattcctaccggcctggctcagcacagcctgtgttgcctctatgggctgaattttaaaagacacaatttgctttctttttactatcaagaagttcatgtttattgtggaaaatttagtaaatggaaaatgtaagaaaaaaaaaaaaaagtaaattgcccatgcctagcttccaacccaaaatgacatcttggtattctggaggaatgagctatacacactcttttataacctgctttagtattttgataaagctttctttgcttatcattaggtattcttctgttcctgcatgctggtgtttcgttatgtggacacttgatttatctaacccagcccatgactggctgtgtgtcgtcacgtggcgctgtcaggcaggcatgtccccaggaggccatgttttgtgttaagtacacagtcttaggctctccctgccacactcaccctgccatatgtgtccttgtcttgtagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtaggctctcatcccaggcttcatccattgcctgctgtgcctgggaatgggtgtgcagcaggcctcttgggggctcttcccactgtgtgacggggaaggggtgggactagctggaatctctagatgattacgtatgccctcgccagtgctgcatggggtggggtgtggaagccgttgtcagttatgtggggagtgtatgggtaggaaatagctcctctcctctcagttgagactaccaagcagaaactgtccctgacttggtgcccccccagttgtgagaccctcgagggaatgtcagttctaagacaggtggagtagggtgggctgctgggggtgaggaagagccagggtttggcgtgtagcattcctctctcgggaaaaatgtaacttagcccttgggtacaagccttcctccaggtcccttgcttccactcctggtgccagagtctgccccctgccctcagggctcaatgttggctgccggccaagcccccagctgttcaattgggtatccagggccattatggcctggtcccaccctcctcttcccttcctgtgtgcatgaaacccttgtgacatccagccccttggcgcccctcagcctgtagagcccttccttaagcccaggctgttacacactcagtttcccctgcctggaatgtcctccctcctcttccctaatgaaagcatcttcctcatcctttgacacctagctcagatgactcccttctaggaagtccacccagcccccttcctcacggggtttccccaaagccttgggcttcccccagggcaggaatgtgtcaccctcaggtgttcagccccaggctggccccaccatgtagggatctgaggatcttgggccaccgtccctgacagtaccttgcagaggagaattaccactgaacttacagaggctgaggttggggacccttgggcagaggtgaggtgtgtggagttactgggtcctggccaaccctgaggtcctgagatgggtgaggacatggctgcccccaggggaggtggttccctgggtggaactagattagtttccagcctcctcagccagccaggagtctgtgtctgccccaggaggccttatgcctcttctgcccagagagcccttgaaggccctgcaggagctccagtggtcatctgtgtctgtcagctcttggtgggcacctggctggaggcctgaggcagctttgttggctgcacaccagtcatggttcctgggggctgcagccaagatggaggaggtttgggcaactctgctggacatacagggccattctccaggccacacagggtagggccaggctgcatgggagagtt

SEQ ID NO: 85612 - DNA, 1614 bp, Homo sapiens
tgacggctcagcctctgcccctccttctgtctccccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtg

SEQ ID NO: 85613 - DNA, 1512 bp, Homo sapiens
tggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatgatgcggtttctggctgtgtccttctcccaccccatcttcatcagtcctgtgccactggagaggtgggagatgagggagccgattcttgtggagcttggtctgcagttattgaggccaccagcctggtcctagtgcccgcgtgagctgggcatttggttgcccctgaacctcagggaaagggggtgggaggcgtgccttttgtgaggtgctgagactggtggcctgcacgggtgtgctgggggaagtgctagccactgccctttacccttctgtgtccgccctcttaatgcggccttgtcactggtggaggctgctttggatgaggtggaagtgacagtgtgccgggtccccagaggcttcctgtgctctgcctcctcttgtgtccatgctgcagaagagctgctctgggaagccactgcctgtcagctgaggcaacagagggagggagtgcgtggagctgcccagccaactgcgtgttcctgaga

SEQ ID NO: 85614 - DNA, 1784 bp, Homo sapiens
cagtggacaagcctggtcaattttcatcatagttcttcaagctgccactaccaaacaatggagatagccccaaaaggaaacctattggccagccctggtgtagtccaaccccatcttttatctgatggggaaactaggtctggagacaaaagtgatttaaccaagttcatggaaaagtcgtagagaatctaaaacgtgatgctcttcttccataccatgccgtcagcccctatggggtcccagggtaaggctgttacctgtctggaatcggaagggtgtggtgaggatggggcttgtccctggagtgtgatcaggccaacccatgcttctctccttccttccccttccagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagaggtgccttgtgggcaggtcgggtgggcagaggggagacttggacttggacaaggcttcaggcttttaccttctcccctgcccaacttccccgcagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcag

SEQ ID NO: 85615 - DNA, 1118 bp, Homo sapiens
accgcgcccagctgaggtaggttaatgcacataagcctcacaataatcctgggaagtagtgaggaactaaagcccagagaggtgaagtaacttgcccagatcccacagctaggcactcgaactctagaacgcctccctcttagcctctttcctgcctctatacgaaactgggtatgaagagcccaggtgggtgctggcaactgctccacagggggcctggtgccaatgtggacgttgttttagcaaccccactcccaccaccctccccacccccaacccagtcctttaacaaactggccacagcatcacagggtccatgcttgaggtgggcagggcaggaccagaaccttgcccattggacccttgatgatccagtctcatcttctctgctccaggttttccagaagagattcaatggctcagtaagtttcttccgcggctggaatgactacaagctgggcttcggccgtgctgatggagagtactggctgggtaaggcagggaccaggtgggctgaggggctgccccagggccaggtccttgttgaccagctgcccctcctccccagggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtataacccgctgttagctttgggaggggctgtgaggggaaagaaggcagggctggccctgcccagtcagccccaacctccttcaggcccctccttcaacccttctggatctggaagggccacagctggctccaaacaagctcaaaccagcttgggcctcagccctggggagcagccatcctggccctgctccaggcaactctgtggtggagcagctgtttctcttcattgcagaagcacatcaacccaacatctggctcagggagggtgcccccatcccgccaggctgccacgtgatatctctcacagtcgtcattgtcaccctctcccggccagctcggggctcagttccctgcctcagcagccc

SEQ ID NO: 85616 - DNA, 1050 bp, Homo sapiens
tttgaagattatgccagtgcagaagcagacccgtgccggccagcgcaccaggttcaaggcatttgttgctatcggggactacaacggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggctgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcaccaaggccacctttgatgccatttctaagacctacagctacctaacccccgacctctggaaggagactgtatttaccaagtctccctatcaggaattcactgaccacctcgtcaagacccacaccagagtctccgtgcagcggactcaggctccagctgtggctacaacatagggtttttatacaagaaaaataaagtgaattaagcgtgaaaacaaaacaaaaaaaagaaacacagtgaccttcaagaggacacagataattaaatgaaatttttaaaaatgcaacaacaagatgagaaaatcaacaaagagatagaatgataaaaaaaagaaagaagcggaaatttttgagctgaagaatatagcaactgaattgaaaaattcactaaaagagttcaaaagcagacctgatcaaacaaaacagtggactaaacaacaggtcatttgaatctttgagtcagggagcaaaaagaagaaaaaatgaagaaaagtgaggatagcctaagagattaatgggacatcatcaagcagatcaacatacacattaaaggcattccagaaagagaagaaagagaacttatttaaagaaataatggctgaaaacgtcccaaatctgacaaaggaagtggacatccaaattcaacaatctcaaaacaa

SEQ ID NO: 85617 - DNA, 1033 bp, Homo sapiens
ccactgtggtggccctaacctcagggtctgatgtgacctgctgaggacaatgagtgtgaaagtcttctttcctgttctctggggcacagggaaaggcatggaagtaggagccacgagctgagaggggttgggagctttgaacttggttacagaggacacgtggagtttccaaggttgggaaggaaggcaggggatcctagacagaggtgcagcagagcctgttcctaggggctggggcccgcagagtctctttacgccactgcggtgggaggggatgcagtgagatgatggcatcgagaggcgggctggcccagggtcagcgtgcgcagggccttgtgttctctgctggggcatttagttttgggaaattaactaattgggagaggaagaggggagagttatggacatgatccaaacaaataatggtgaaggtctgtgatgaagagtttgcgttgtgggagcagtgggagatacgatgatgggtgggttctgtagaaatggcaggggttgttgggcccccagggtggaaggagtttctgtcctggggcccttccctaggaagacagggcaaccattagctgagtgtagaaccaaagagaagcagctgggagtttggagaaagtgaatgccctcggagagggtggagggtgggaacagagccagatggtatcgggggaagggagactttcaagtaggagagtcaagagggctttggaggagaaggtgactccactggacatggagacgcatgcgtgttgcaggcttggccacctcttctcgttctcccacgagcctgctcctctgccttccattccatcgcaatgggtggaattccgtggcctcagccatttttgctcccagtaacctgtcctttttgtccctgtcacatcctcgactccatctttccttccctcccacatctggtcagtcacctggtcctatagcttctgcctcctcccaatcctccatgccaccacctgaattcatttctttcttccttttttttttttttttttgagatggagtctctgtt

SEQ ID NO: 85618 - DNA, 1050 bp, Homo sapiens
gctaagttttgtattttttaatagagatggggtttcaccatgttggccaggctggtctcaaactcctgaccgcaagtgatccacctgcctcggcctcccaaagtgctgggattacaggcatgagccaccacgcctgacctctgtccctatttaaaaacaaaaacaaaaaaaaaacagacaaaacctgggctcctggtgagtcagtccatcccccgacacccagaggaggaacatggttgtgcagcaccctcatgtcgcagaggttggaagctctgcagcaaagcccagtttgtgctaagcatcgtaacctggggctcagtttccacagtagcgtgggagttcccggctagacaaaggggatgttgcaaatcagtcttttcaaaacttttaggaccaagttttcccaccaggtgtgaggcatgaggctgcttctctgcacgtgttctcgctctgcagtttctcactcattgttgcaggtttcctttttattttaggtccctgcaggcttcagtgtggctgccagtgtccgggtaggaaacgctctgggtgctggagacatggagcaggcacggaagtcctctaccgtttccctgctgattacaggtgctgagacccctttacccgaggctcttggtgcagtctctgcatgcaaaacccaggctcctccacttcctgtggatcttcttgttcactgtgttgtttcttctgccgtttttaccttcagtgctctttgctgtagccttcagtgtcctgctgttaagctgtaaggatcacgtggggtacatttttactaccgaccggtgagtgctaggattttcttgaaatgtgaaatctgtgataaagaaatggttcattgagaaaatttgttctctaaaatcaggctgttcagaaacattgctgtttgaaatcatatcagtaaaaagaaaacatctcactcacacctgtaatcccagcactttgggatcacctgaggtcaggagttcaaggccagcctgaccaacatggtgaaaccctatctctactaaaaatacaaaaattagctgggtgtgg

SEQ ID NO: 85619 - DNA, 1057 bp, Homo sapiens
tggccagtgcccttctcatcaccctcatcgcactccgcagcctccacctccctccttgtgcagccttagctctgtgcccccacagagctccccacaaggccatacacgtggtcggtgtgaacagcacagaaggaagggggcggacttgagcaccttcccacatttggaagaaaaaacttaatccacagcatctgaaattaccagagctaatctttttaaaaagtacggaaataaatgactgcccagctttgatttctaaaataataatttggaacatattggcagttaataaatgatgatatgaaaacctggacatttatctttggggtgagtagtgactgacttaaagcgtggcttgttttgattcatctgtacttggcaggctcagaggtggtgagaagtcaactgatacctacagggaacttccagttcagtatgttcctttatgtggcacatttttctcaagttcaataatattttaattaaaaatacaggagttgttcaaagaatagtattgccaatgcaaagttcattgggcttgcatgatagtgcagaaaattatttagctgagtttctggtgcgattcatagtttggatttgccaattgcctagctaatgcaaatattatagaaatctaatttatttttatttttaaagtaatgtattttatgtaacacaatatgtctaaaattattgcaacgtgcaatcagtataaaatattaaggaaataatttaaattctctatattatatcttttaaactttaaattgacaaattatagttgtatacatttatggggtacagtgtggtgttttgatatatgtataaaatgtggaatgattaaattaagctaattaacatacttatcaccacttattttttatggtgagacatttgaaatttacttagttaattcaaaatgtgcagtacattgactacagtcaccctggtgtgcaattgatctcaaaacttattcttcctgtctatcagaaatttgtaccttaacaactccccattcccatgccctcccctccttgccaccagtccctgctaacca

SEQ ID NO: 85620 - DNA, 1525 bp, Homo sapiens
tgccaccatgtccggctaattttgtatttttagtagagacggggtttctccatattggtcaggctggtctctaactcccaacctcaggtgatctgcctgcctcagcctcccaaagtgctgggattacaggcatgagccaccgcgcccggcttccctgtgaattttaatggagagggctaccttatttctctagctcctgggagagtgctccctggagcacccaagccagcgctggtaggatcatcggtgttcgtgaaggagtgagtggaggggcactctgcgataagatttcttttatttattcactgtagcaatagtgtcctgaattaactttctctccactattagcacatattccttttatacatagccctttataaaaatgaaaaaaaaaatcccttttaagctgctaagttcctttttcctcccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaatt

SEQ ID NO: 85621 - DNA, 1593 bp, Homo sapiens
tagtatattcaatgtctgaggtacgaaaactgaaacagtgtagccagagttgctcagtttgcaagatcctgctctcttgctcaataaaacttgtctcagccctagtaattggtgagatcacctgtgggttctcctatgaaatatttttaaatgtaatttcacatatactaactgataactgagggttattgtttataacgtattcttaggtaaacttcataatatgcctttacttgacataatatgcctttactggacataagtgaataccccactattctctgcaaacagatctacctatcttgggaagagaagtaactgatggaatcattttgcctgatatcatcagaccagagagccagacccctcgactgatgagaccagaagaaaacacccagtatgcaatgtccaccgctggagaggtcctgacagtgaggcagctgatattctatcatggaatggctttagctcttgctgtcactttcctttcagcaggaattttcattaagagttttcaatgaccatggctaaaatggtagaattaccaccattctacaaactagaaatgataattatatgccatatgttaagtatgaaaggtgaccttgttatttggacagtttttactcttaactgtggatggaaagaatatcagggatgtttccttggttattccaaggaattgcactatcctattggagatcaagaaaggggctataattttaagtaaagttttccctgttaattttatcatggtttctaaatatacaaattagattttccttgatgtaaaggttacttactctttcttatttcaaacatctttcttctcctggggagtggttcatagtcctgtaaaatattattgctgatctattttctttgtatttctctatgaatgtacttaatcttgtcagtgagtgtatattaagtgcttgttcaagtcctatctcaggtattgccatataagcttttataaaatggaacctcttaaaatttacaatgtatgctgacaatatttggagctatacagtcaatacaaaagattaacttttagcatttttgccttttaattaattttgtggcaactttcatttaaagtagaaaataaagtagaaaataaagagctgtgttctcttctgctactcagctcccagaatgctggcagctatggtggcctcatcctcaaagcaaaagagttttagtcttttataggaaattagaccagcccaaaaagaaaatccttaaaaaaatctgaatattgggtattctctcacacaaagcccaccagattcccaggagaggagcccacagtggaaagcacccaatgtcaccagtgcttcccttagcttatttgtctccctctcttgagtgttaacaagcaacccagtattatcagattatttgtgaaaatccaattataggagaaagcaaccagaaaaaaaataggcattatagggagaaaacttacatcttcaaagaggtaacgcaaaatatttcaactatgatatagaataggatgctatagaataaaacattcagtcaggtatggtggtacacacttctaatcccggcactttgggaggctgaggc

SEQ ID NO: 85622 - DNA, 1641 bp, Homo sapiens
ctcctgaccttgtgatccgcccgcctcagcctcccaaagtgctgggattatagacgtgagccaccgtgcctggcctatcatcttgtttttactttttatctgcattacatgtgtagcaaggctttgctctgggtttgtgatttttcccttccccacaatcccctcaatcaaagattattttaataagtcgtaatagtggtagtactagtagcaactatgaaatttcttttagagtacttttggtggaaaggggctgtgatattaaataaacaagatggggtaattaagattccaaaaagtctgtgtcatttaatcatacttgaagaactaaatgtttgtgtgagtatgtgtgtatataggatgactcaagaaatacaataagttccctgtcctcaagagttttaaacttgactgggaaacagaacatacacagatgaaatgtgagtgatagttataaaccagtgtgttaaggatgaatattaagatgcaggtcaaaagcatgattgctgtaatatataaagtgtgttcagagcagacctttattgctcaaggaaatcttcctgaaagaggtaatatttaagcctggcttttaaagggtgtggattactaaagaaggatttactaatggtattcgactagtgttactactccctgaaataatctttgatttttttaaaagaaatatattagagaattagcaagcccttaccaggggcgtgaagggtgcaaaaggagtctgaatggcaaacagctagtctgataatgccagttgttgtcactacaggtgtacctggtgtgagtgttctgacattcagggccaagtgtatcatacttactctgcaagattaactgtgattctcttataacagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggtctggtgccaccttatgtctatatacctttttagggaggcttattttctcatattaattggaaattaaggatagtggctaattaaatacatttacttggtgatttgcctttgtttacaccaccagtgtactgagaattcatacataccatacatatttttaaatgggctgctgaggagatttgtgtggctatgttttgaagcacctggggaatgaacctgtgggagtgtaaagatgtgtgagtcagcaggcccaggagtttggagtcaggcatccatgttctaatatggtttcagttgctggctctggcttcggatgaaccatttgattctgtctgaccagtttcttcattcaaataaagactatgagagtaatgctagcttgggtatatagcaaatgccaggagattaatttctcactttgcaggatccagatagagagatgtatgttgaaatggctcacttgcccaataattccagggcagagaggacaatctaagggcagaagtgggagaaaagcgatagaaagctggaggagtgg

SEQ ID NO: 85623 - DNA, 1042 bp, Homo sapiens
aagacatgcatgacctgtcctgtgggagccactcttcaccagaggcacttctgcacacacccgcgtctcatgcattttccctggtcaaattcaaccatttgttctccttagtgtctttgttgctgagctcatgtaaaaaaacactggagtctccagattagttctatgtgggttcatgcttcccagatgccatcggactgtgtgttctcctcttgtccttggtcagttccctctcccatccctcacagggactggtcttgacactctctgggttttactgaatgttacatgtttatgttgaagagattgctgatgttagacgttaggatttatttggcagtgcaagagtttgtgtttctctttctttgaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcaggtgagtctggctctctgattttctgaggttttcccagcacaatggagacttttcctgacaatgttactctttgtacttgaaccccataccttatggctccaagatacattattaagctttggtggttgatgtcctcaagagtaacaggagtctttcactgtctcttggcgccactgtcaaaaatggtgagctgtaagtcctgacatcatgtggttgtccttaggaattttaaaaaagttatatctgttctcaagattacagctagatctagcaagaaattttaacgttcttctggccagtgatctgtgaagtacataatccaaagtattgtgtgtgcctaataaaatctttaaatgcccatttgagagggtattatgctgatatcttaactgagatcctttgtgggcaaaacaagtgttcctcattttttaactgtgaataacatcttgcatctgaaaattag

SEQ ID NO: 85624 - DNA, 1022 bp, Homo sapiens
agggctccacaaagaggaggatggccttggaggctggctgacatcctgctttatacctgaacatcttgcaggcagagccaaaagccacaaccaggagagtctgtaccgaactctggtcatccaggactttcctttggctggactggaagaggggaaaggacattgggaggctgtttctcctcttttcctgcagcaggcaatggcttcactgtttaccaagtactgtttgccgtgagctggcctgagaacttccctgctatgtaaaatattccacctcatttggaaaatactttctaagttccaaacaactgatttagaaatgagtttttaacttttttataaaaattgccagataaatatatgaatctattttagttgcaagacattcaaacaacacaatgtaacaaatgaatatttgactgaattactgaattatatagctgttctggatgttttcccctcagacgcataacctggggaaaatacatgaattgtggccaaacctgcattgcacccgactatattctctgtgaagcatccctccaaaatcaaattgtatggaagattaaggaaacagtgaaggtttgtattaaaaacatctgattccactgattttaataagataaggagtcaaattaactattcgcaggcagcatccccatttgtttctcccttcaggaaaatttcaaaatcatatgtgactcagtgaacttattgactaatatgaaaatgctatgtgtaccatagaatatatgctgggagcaaggttgcattggtgttaaatctacttaaactgtctagttgatttgttgatgattagttgtggcatatactttttttaaaaaagttaaataatcgtgtgtccgtggttttgagggaatgttgccaaccctttaggtataatcagagagactctttggcatattggccattgctgctgaaggttatcagtttttgtgtatgtagagggcctagggtggccagtagtttggaggagtgacttaattaaataactacttaca

SEQ ID NO: 85625 - DNA, 1049 bp, Homo sapiens
cacagtggctcactcctgtaatcccagcactttggaaggccaaggcagacagatcacttgaggccaggaattcaagaccagctgggcaacgtagcaaaatcttgtcgctacaagaaatacaaaaattcaggtgtaccggcgtgtacgtgtggtcccagctacttggcaggctgaggtaggaggatcgcttgatcctcctgggaggcggaggctgcagtgagccaagaatgtgccactggactccagcctgggtgacagagtgagaccctgtctcaaaaaaaaaaaaaaaagagaaaattatgtaccaggaagttcaggacaatagttcactatgtgttccaggcagagtaacttgggggatgaggtgctagggtcttgacatggaaattggactatcatttttagtcataggactaaaaatggatccagatgagcacatgaagggagagttgcccagattcagggtatgtgggaagagagagtggttaaagatacttgtgagattgaaaatatttgggaattggagaatgcttagttgagtgtggtgatgaattcaatttcaaaggaataagggcctctgcctccctttgaggcatttatactcttaacacagtggttctcaagctacatgttaccctagtgagccatttaaaaacaagtttgcaagccttaccctccaaagattcagctcgtctgaggcctccaggtgattctatgatgcattcagcattgaaaactactgttggtgactctcgagtcagagcccaggcacatgcattttagcaagctgcaccagtgattccgaccacccagacttgagaattgctcttggtagaggttggatgaacaatgttcattttgatttgggatgaaattgggaactctcacaaggctttgaagtgatgcagcaattcagtaattttgtttgttttactaagtaaatattgattgtatgattattgacgttcttttaccttggtaatttaccaaagctgtattttgatccttcgggtggtttcaccatcatgtgtaagtggtggaaataccag

SEQ ID NO: 85626 - DNA, 1108 bp, Homo sapiens
ttggcaaatggtttctgtaaagggctagatggtaaatatttcaggctttgcagatgttagggtctctgctgtaactaccgaacttactgtagggggaaagcaggcacagccaatgtgctaacaaataggcaactctgatgcagagcaagacttctttccccagcctgctcccactgtcagccccaggaggtgaaggcctgtgggtggactctaagagatccataagaacctttggaactatggacaatgacagatctctgtgtgtgtgcatgctttattttctggtcctcgacctgccaaaaagctgaaacttgctactatcatactactgttaaattacttgaggggtggggtgttagattctgtgaggatataaaaccagattgattttggggcatggctggattttgtacttactgaaattgaattgtgggtctttgtgacatttatatactcctgttgttttaaataggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgctgacactacttattaacactagataaactattaaatatatagcatttaattgttaaagtactaaatcctgctttctggtatactgtacctgtagcttttgttataaactatttaaaatgtctgtgtttctgtgtattgaatgatgccaccagcgttgctccagttgttcatatttacacataactccttttttcctcctaacaatcctgagaagcagaatagaacttgatgtaattatctgtagtttgtggatgggaaaacagcacaaagaaggaaatagcttggccactattccacaattaaccagtgacggtaccattccagaaataatgttttggtccatcatgcttgaccttattatttgtgtaccttctttgtgctttttcttctttgccttgaatatgtattactttgaatgttaagcacatttttctacagtaa

SEQ ID NO: 85627 - DNA, 1013 bp, Homo sapiens
tcctgggtattgtagccgctgtgcttgtcaaggtgagtccctataacccatgagtgccattcagtctggtcctggcctgatggctgccagatgcatattctagcaggactctacattaacttgtagagtctaagacagggtcagtgaaccacagcctgctggccagctacccgtttttgtcactgaagttattggaacacagccacacccacttgtttaatcatccacagctgctttcatgggacagtgacagagctgagtagttgcaacagaggctgaatggccctcagagcctaaattattacagaaaagtttgctgatctctggtctaagagattaaaacagcgtagaacttgattgcagaattctgagctgtctgatcaaagggttagccctttgatccttttggtattggactttccttgtcacttacagctttgttcttgaatgtgcatgaaatcagcttaccacagaggtgaaggcaagaactctggtacaacagctttggtgagggatattttattaggcttgagtttttttcctccaaagttcactacctgataaagtttatctttggtgattagtcattatagggatgggcttgcaaagaggccctcatgatagctgccttctcaaagcagtttgcgtattttgagatgaaagaggaaatccgtaattaaagttaagatggaatgaggaaggcaattgtgtctgtggtgccctcagccgttcaactgaggatataacattgaaaatattgaccatatcagtgaagaatgggcttggaaaaggcaatggtaatagttgtgtttatgttttgtttaaaatttgaaagggggccggcgcagtggctcacacctgtaatcctagcacttcgggaggctgaggcaggggaatcacgaggtcaggagttcaagaccagcctgaccaatatggtgaaaccctgtctctactaaaaatacaaaaattagccaggcatggtggcacgcacctgtagtcccagctactcggga

SEQ ID NO: 85628 - DNA, 1071 bp, Homo sapiens
aaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaacta

SEQ ID NO: 85629 - DNA, 1846 bp, Homo sapiens
taccaggatgttattacttatcacatacaagcccaataatctggttttttaggcagaggtggtggactggttggagtgtatgtggtcctgctacattttgagtagccacaggaggatggcagttctaagagtatttgcagttatgagcaagctagttatgtagcaagctagctgatgtgcttacctaaattttaccactttgcagcactaagctagaagtcatatctaaactattaccaagcagaaagaagaaaacatattcagaactgttaactttggggcaaagatagaatagagatgacaatatagtgatttttttcattagttcttcatttttgttattttatttctagataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacattttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattacttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttttcctttactttgacaaagtaatgtaatttttaccttatttatctgtatgaaattccagtagttaatttgaacatttattt

SEQ ID NO: 85630 - DNA, 1032 bp, Homo sapiens
tatgcacgtaatcagggattctgacataaggagaatcactgtgccccacagtaccctcagagagacctaaatctcagagcacccaatagagtggagggaggaaatagcactttgacttctggtaactaattctacatatatgtatgtcatggacatagtctacatatacaggcctctcctgtgtatgaaattgcatttacacaaagttgttaactgttacgataccaaaggatgaaaaataagccaagtggccactggtaatgaactaatttattaggatccatctctgataatggaatattacacaccttccattccacaaagagtgaaggagttccctctgtgccaagatagaaagatttccaagttatattataaaatgaaaaaagtaaagtgattaacagtatattgtacagtggttctcaaagtttagtctgtggatcccttcagagggtccatgaggtcaaaactattttcataataaaaattagacgttatttgcttttttcattacattgatacatgcactgatagtacaaaatgcaaagatggataaagctattggtacctttgcctgaatcagggtggtggtacccaaacagtactattagtctttgtattcttctccactacacacttgcagtacaaaagaatgtccttaatgaggcagtaaaaattaatatttttctttgaaaaaatctttgagtgagatgtacacataaagcacttttgccacatattagagtagttatcttaggaaaagcattgtatgattgttctagttccaagttgagctagctgctttgtcatagaataccctttttaccttaaaaaatggctgataaactatggttatgggtatcaagcagctattttgtcaaaaatggtaagtctttccactttgaagaaaacaagtgatgataaaacttgagcttttaagcaaaaattggaatgttggaaaaattcagtggtgaatacaagtttgacagcttctgttataccttgacaggtgtttcttttaaaattgagggt

SEQ ID NO: 85631 - DNA, 1098 bp, Homo sapiens
atttggctcctttgtatttctttaatatctttttcttttcttttctttcttttttttttttttttgagacagagtcttgttctgttgccaggctggagtgtaatggcacgatcttggctcactgcaacatccacctcccagtttcaagccattctcctgcctcagcctctcaggtagctaggactacaggcaggctaccacaccggccaatttttgtatttttagtggagacgggatttcaccatgttgttcaggctggtcttgaactcctgacctcaagtgatccacctgccttggcctcccaaagtgctgggattacaggtgtgagacaccgtgcccagcctgtttaatatctttttgtaattcttattctttgaattgtgtactgctattaattcattttcctgttgcttgttgttttcatatcggatgttaggaagttgtattagttctcacttgtatttaagtgctgcccttttccagacagaaatggaggtggctactttgtaatagagaacattataacaactattagtgcaagattgaagctatgctaaaagtcaacattgggcttttgaggtgccttactcctgcagatactcaaaacaacagcaagcacaatacaggaatcttctcaatttgatgctgtttctcaaaggcaatttagtgctttttttccttctttttttttttttcagatggagtcttgctctgtcgcccagcctggagtgcagtggcatgatctcggctcactgcaagctccacctcccgggtttatgccattctcctgcctcagcctcccaagtagctgggactacaggtgcccgccaccacgcccagctaattttttttttctatttttagtagagatggggtttcaccgtgttagtcaggatggtctcgatctcctgacctcatgatccacctgtctcggcctcccaaagtgctgggattacaggcgtgaaccacagcacccggcttttttcccttctttagatgactcttacatggtcttcgtggtataaatgtattggtatttgtgaaaccgcatacacgttttagtttactatatggaaggcaaaagttaatgtttatgta

SEQ ID NO: 85632 - DNA, 1103 bp, Homo sapiens
gaaaccctgtctctactaaaaatacaaaacattagccgggtgtggtggtgggcacctgtagtcccagctactagggaggctgaggcagaggaaggatgtgaacccaggaggcggagcttgcagtaagccaagatcgtgccactgcactacagtctgggcgacagagtgagactccgtctcaaaaaaaaaaagaattttggccgggtgcggtggcacatgcctgtagtcccagcactttgggagaccaaagtgggcggattacctgaggtcaggagttcaagaccagtccggccaatatggcgaaaccctgtctcttactaaaaaaaatacaaaaattagccaggtgtggtggcgggcacctggggaggctgaggcagggagaaatgcttgaaccggggaggcagaggttgcagtaagccaagatcgtgccactgcactccagagcaagactctttctcaaaaaaaaaaaaaaaagaattttgcatggggaaggagagatactgttcaccatctggaatggtgcttggatgtggcacttacaaaatcaggagccagcactgcatggacaaacagaagcatgtgggcctgagatagcaggtaccttgataaccctgaagacatccttggtttctgcatctattcctgcatccttgcattggactacattaatctgtcagttatccttataatgatttttgattttttttttttgagatggagtttcgctcttgttgcccaggctggagtgcaatggcacgatctcggctcaccacaacctccacctcccaggttcaagtgattctgctgcctcagcctcctgagtaactgggattacaggcatgcgccaccacacctggctaattttgtatttttagtagagacggggtttctccatgttggtcaggctggtctcgaactcccaacctcaggtgatcaccctgtctcggcctcccaaagtgctgggattacaggcgtaagccatggtacccggtctgttttttgattttttgaaaccagtctgaagtgagtttttttaattacgtgaaaggagtttggctaaaatactgccatactgccctaatgcctaatgattatgtattctc

SEQ ID NO: 85633 - DNA, 1024 bp, Homo sapiens
actttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaaaatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaa

SEQ ID NO: 85634 - DNA, 1016 bp, Homo sapiens
agtgaatgtctgcatgtgtgtctttaccatccctcttgaatatgctctagggttaattcctagaagtagaattactctattgaaaattggcaatatttttcattctaatatctattgccaacatgggaaagcaagtctggatgccagtccttgttatatgccccttgggtaagttacgtaacctctttaagcttctgttcactcatattttaacaaggaaaattacaatattttacctcacaaaattgtagtcagcttctggctgtcttaaactctggtatatagtaaacactaagtgttggtgtccatccttaatttgtaataataggtcacttgttagagaaatgcaccttaccattttcttttcttttcttttttcagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagtt

SEQ ID NO: 85635 - DNA, 1032 bp, Homo sapiens
atattggacaatgggcaatacagggaaaccatggaaaccaaacagagcccagtagtcttgctgaacgaaagagttaaatatcaaagttcaggccaggtgcagtggctcacgcctgtaatcccagcactttgggaggccaaggcgggtgaatcacttgaggtcaggagttcaagaccagcctggccaacatggtgaaaccctgtcttagccgggtgtggtggcaggcacctgtaatcccaactatttgggaggctgaggcaggagaatcgcttgaaccagggaggcggaggttgcagtgagccgagatcacaccactgcactccagcctgggcgacgagcgaaaccccatttcaaaaaaaaaatcaaagttcagagagctcaatttgagtagaagttgtaggataaggtagcagaaaagaggaagctgcccagaaagaaagccgtagagatatttagagagattcccatggatccttggcctaggagtgatctgtatatgtgtggggtgaaaacgcatgtgtccaggtagagaaccccccagaaattagtaggctgaatgattgctggaacatagggctaagaaaagttcatggccagaaggatctggccagagtagagagacttagtaatacacaaggcattgggtagtgtcttcacagaggttatgccttactactgaagataaattagtcctagagtacaagcacctgaaccaagtttcaaagcaaatttttaaagggtcaaattacctaacaactgcatgccaaaacaaaggcctaaccctctttacagtaacacaacaaaattcagcacttcacagtgtaaagttagaatgtctgacgtccaggctgggcgcagtggctcatgcctgtaatcccagcactttgggaggccgaggcaggtagatgacctgaggtcaggagttcaagaccagcctggctaacatggtgcaaccccgtctctattaaaaatacaaaaacttagccaggcatggtggccggcacctgtgatcccggctacttgggaggctga

SEQ ID NO: 85636 - DNA, 1093 bp, Homo sapiens
agaaggtgagtgagttgggaggtcaccagagaccatggcaaggacttgaaagtgtcagggacacattggaagttggagcagggaaatgatgggatttatgttttgtttttgttttatgtttagtgtttttaagggattgctctatcagctatttggaaaatttagtgtagggcttcaagaagagaagcagagaaacaacattcttgccatagtcatagtctaagtaagggatgatggtggtgtggattaggctggtagtggaagaccagtccagttcgggttgtatttgaaggtagaggcaaaaagattatatttctaccagcaagcccatctatgaagttacttgtattattaatttaattgagacatgcccacataaactaataaataggaatttctgcagtttggttaaacacccctgtatatcctggttcttcttttagttgtccagatgtctctttaagtcaagtattttttggtggtgtaggagcctagagattgaatttattcacccaaaaggcatttgagtgattactatgtgccaggcactatgctgaatgccaaggatgtaaataagagggcgtagtctcagtctgttttactccagcttggttcctttttaatgaccctgacttgttaagcatatcagttatcctacagaatgtttaatcttctgtactttcctggttgtgttatttagcttatttctctttccttgacatttcttgtaaactggaagttacacctatagtcttgatgattcgtgttacacattttagattagaacacatcatgtgttgtatatggtgtttttgaaagcctctctgtatattggtctgtacattaaaatgttgcctgaatggatacacataaaatttaacagtgattacattagagatgagaagaaagaggtgccttttacttttcaatataccttttcctctgctttttgaactttcttgccctatgcatacgttattgcttaatcatccacctcatctcttcccctgtggctttctgttgcatttggaatgaaatctagcctctttgctgttacctgtggatgtcccttgctggcctctatcaccttact

SEQ ID NO: 85637 - DNA, 1053 bp, Homo sapiens
tggatgaagctggaaaccatcattctgagcaaactgtctcaaggatagaaaaccaaacaccgcatgctctcactcataggtgggaattgaacaatgagaacacttggacacagggtggggaacatcacacgctggggcctgtcgtggggtggggggctgggggaggaatagcattaggagatatacctaatataaatgacgagttaatgggtgcagcacaccaacatggtacatgtatacatatgtaacaaagctgcacgttgtgcacatgtaccctagaacttaaagtataataaatttaaaaaaaataaatatatgtggaaaatattaataggtcaaaattcaaattgttcatttaatcagaagagtagtttagtcaaatccaagggttagacaacagaaatcttttttgtcaagtgcattctttgtgactgatttcattttcttcctggtttacacaggaagatttcagaaacaaatgtggatccgtgacagatggtatctagaagtttttagtttggttgaattgacagtattttattgagtaaaagatactaatttttgtaagaagaaaaattcaattttgataagtatgtttaagattaagagctattggccaggcgctgtggctcatgcctgtaatcctagcactttgggaagctggagcaggtgggtcacgaggtcaagagattgagaccatcctggccaacatggtgaaaccctgtctctactaaattagccaggcgtggtggcacatgcctgtgcacccgcctccgggtttaagcgatcctactgcctcaggctcctgagtagctgggattacaggcgccatggctaatttttgcatttttagtagagacagggtttcactacattggccaggctggtctggtctcaaactcctgacctcaggtgatctgcccgccttagcctcccaaagtgctgggattacaggcatgattcaccatgtctggccatttatcttattttcttttttttttttttttttgtttgagacggagtcttgctgtgtcgcccagagctggagtgcaa

SEQ ID NO: 85638 - DNA, 1044 bp, Homo sapiens
agagcaaggcctaccttttgggtgcttcttttacaaaattgtcttggctattcttgtgccttttttcttatttgtgaattttagaattgtgaattacctgttgactcaccatgttttgtaaactgaggattttgaatggaattgcactcaattaaagattatcttgctttctgtgcagcaatgttttatttcaaataatccctactttaaattacttaggatagctataaattgtgtttctggctttctagatttagatgaaacgctttaaattgattgttttctcctaaatttaaaactgattgttagaagttaaagtcttctgttcattcttatttaggaagatgacatttggaagagtcagtgacttggggcaattcatccgagaatctgagcctgaacctgatgtaaggaaatcaaaaggtttgtggtgtttttatacttcatattaagcctttactcacattagtgattgactgtaagtcaaagaccacttaaggtttaaactgtttattttgtaaagtaaccactgtatctttcaccttgtgtttatagtcagaagtaagtacaagggcttcctgtagtcacatctttatgcaatctcctctgaatcaaaagttagtgaacttgctttgccactccagaaggcacatgaatatgaaaaagcattgtctattttcttatttaatggcaaaatacccgacctaagttggacttaatgtttgagaccgtttattttattaaattatattttttctcttttcttttttttttttgagacagttcttgctctgtcacccagaccggagtgcagtggtctgaccgcacctcactgcaacctctgcttcctaggttcaagcgattttcctgcctcatcctcctgagtagctgggactacaagtgcgcaccaccacacctggctaatttttgtatttttagcagagatgaggtttcaccacgttggctaggctggtctcatactcctgacctcaagcaatccatccgccttggcttcccaaagtgctgggattacaagtgtgagcc

SEQ ID NO: 85639 - DNA, 1001 bp, Homo sapiens
actcttggcctcaagtgatcggcctgcctcagcctcccaaagtgctgggatccttgtattgggtaaaagatgaatattgagggctgcatggtggctcatacctgtaatcccagcactttctgagactgaggtgggaggagtcctggagcccaggagggtgaggctgcagtgagttgtgatcgcgccattgcacttcaacctaggaattataggcttcagtcactgtgcccggcatgtacattttaatattgtgctttcctcttttagctatagtatgaggttacatttcagagtcattgttgttaagcatcttaatagtgatgaggttgagtgaaagttacttctatttcaaacactgaagaaaattttgtacaaatctgtcacattccaagcccaggactgattgtttcatatacttctaattttacaatttctattgtagtccagtgtgaaaaaagccagtattaaaatactgaaaaattttgatgaagcgataattgtggatgcggcaagtctggatccagaatctttatatcaacggacatatgccgggtaagcttagctcatgcctagaatttttacaagtgtaaataactttgcatcttttaaattttttaattaaattttacatttttttctaatctattattatatgcccagaactttcacttagagtgtgcagtataatgtggtggttaagtataaaggctctggagtgacttcctgggttttaatcttggctctgccatttattggcagccgctaacctcttggtatctcagtttcttcatctgtaaaatgagaataataaagtgaaaagatgccaacatcatttactctgggctgcataactgatacttggaaaaagtattcctttgagtttaagaattaagttggttattcattttagcttgtaataaaaagatagtgattcataggatatgccacttactgaaatttaccacagatccaatcataaaatcactttctcttccctaaag

SEQ ID NO: 85640 - DNA, 1006 bp, Homo sapiens
gtcaagaactaaggatggttggcaggcagatagaaaggtagcaagttgacccaactatctctggggaagtgggaacaaagaaaggttacatcagcactgtcatcacatagctctatagttctaggcctgcaggctcaatcaagtagccttgtataagattctctggaggaggtgctgaaagttgcttatacttgctatggaatttgattttacttcggatatctttttaccataggtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagtaaaaaagaaaaaagaaaaactaaaaagataaaagaataaccaagaacaaaacaaaaaaaattataatggagctgaaaaatctctgttgcctcatatttactgtactatacttttaatcattattttagagtgctccttctacttactaagaaaacagttaactgtaaaacagcttcagacaggtccttcaggaggtttccagaaggaggcattgttatcaaaggagatgacggctccatgcgtgttactgcccctgaagaccttccagtgggacaagatgtggaggtgaaagaaagtgttattgatgatcctgaccctgtgtaggcttaggctaatgtgggt

SEQ ID NO: 85641 - DNA, 1056 bp, Homo sapiens
aattttgagaaacctaattaaactactgcatgtaagagagtgcatgtttttaattatttggagctattttaaaaccacagaatttgaaacttgcttccagtgcataaattgcagaccagacttcagaagagaaaaaaagtagtaaattttttcttatgctcatcatttttactttagtcacttgataggattgcccagtgaagaagcatttgcaacagacaatgagtatattaatctttttgaggcatacagtttagtataatgctctttgttaggcttcaacaagtgaaattattttgttggaaagcaaatgactattaagtagaaagaggattcccagtctcacaaagcagtaatttagacactcgattctgcctctttacaagaatacaggtactcagttgatttgttttctcactccctttctttgctataagtttaaatcaacaatttgtttaggttaatatgtcctcatggaatggtggaaatgatcagatataaaatatttggtttggttagtttactctttatatgtttgctggcaaggaaccacaaatccagtttagtataatttttactctagttcactaaaagtttgcatccagctgtgtaggtagtgtttgtttcttgttaacttttttttcgtctaaaagaatactttaaaacttttcaatctcaaatgactgtaacttgctgacaggtgttaacagaagaagtagatctttttgttttttgcttatgacctgtattttaatatttgagcttatagattagagattgtgagagaaatctgtttatagtcttattttcccttgtgtattttttcttcctagtacatggaaaaagaggatgcagtgaatatcttacaattctggttggcagcagataacttccagtctcagcttgctgccaaaaagggccaatatgatggacaggaggcacagaatgatgccatgattttatatgacaagtgagttatattgatagatggattcagcagatacttattgaacatttgatatgttttgtggaaataaagatgaataaactcagtct

SEQ ID NO: 85642 - DNA, 1039 bp, Homo sapiens
tcatgttgctccaataggggctgtcttcaaactgatgttttctccttcttagtgcctcagagtagatcctgttcagatacgttataacaggttaatatgagtttattttggtgtaaaagtactttgaaattcatgcatagttttttcatcatatgcattttccatagctttgaacacccccatgtaactctcctcttccacaaaccaaacaatgaaaaagcacctttgtgatggaagtttattttgcaataggaactcacagtgatctaagccctgctattcatgaatataattcattactggagtccaagttgctttttggtttttgaagttctcttcttcccttgcaggtatagaacaagatgcagtgaatacttttaccaaatatatatctccagatgctgctaaaccaataccaattacagaagcaatgagaaatgacatcataggtaagcagtgcttgaaactatggcaaaaaaaaaatgacaaaaaatgcacagaactgacaattttcgttattgactaagataattttttcttaacatggaatttagcagttcccttcctaatttgttttctgagtattttttatatcggattatagctcactttaaaagtttctcggctgcattcggtgcgagggtctttgcctgggccagatgggctgcagtgtagcgggtgctcaggcctgcccgctgctgagcagccgggccggcgggcggctacgctaaccggcacagaccaccggatggactggccggcagccccgcaccagtgcacgaagtgggcgggacagaaacttctggggttggaagtccagtgaggctaaaagccggtaccaaagtctctaggcatcagggctgcagcccaagagtctcacgaccagtgggcaactggatggccagacaggtgtctcagtggtggcctctccgtctcagggcttcatcccacttctcagtgggcctgacgtccctgggcaccctggatgtctacctgcattagccagagccatcacatggcctgtgacttgccttttttt

SEQ ID NO: 85643 - DNA, 2527 bp, Homo sapiens
agaccatcctgaccaacatggtgaaaccgaatctctactaaaagtacaaaaactagctcagcgtggtggcgggtgcctgtaatcccagctacttaggaggctgagtcaagagaatcgcttgaacccgggaggtggaggttggttgcattgagccgagatcgcgccattgctctccagcctaggcaacaagagtgaaaagtctcaaaaaaaaaaaaaaaaaaaaaaaaaagaatttacatggtctgaattgccattaaaagagatatgagaattattgagtaacaaataactttttaataatttaggcaagttttggacgattgtactttgtttagaaaccaaaagcatagtatttgtagtttttttatttactttagttgctaggaagtaaactttattcaaggtctctggtaccagttgttgctaaaagtgattgactaatctgtcaatctgaaattatttgttgctgaactgctaattcttttgcttctatcttttaggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtgagtatgtgattttcttgtgtgtacatatgtgtctcactttctttttttaatttactaagcagaacttcagatgaggaataaaatgattggaatattttttttctcctctaactacttgtaaatttgggagaatttggagagtgtagtagagtcagatcagtgtatggaaaaggagcaggagtgactggaccttctaagaagtgtgttatcagaattagtaaatgaagggtcaaatgtcctacttttcccctccactgattttgacatcaaaccattatccacatagccttatttcctccctcggtcttaattttattaatattttactgcactttgcagataaaatttttaaaaaatttttaaaaattgccaataagtgacatttattaagttcagtgcttagtgtatatttggattttatttattagtcacaagacctttgtgcaggtagtaggcatgattatctttttttttttgagatggagtcttgctctgtcgcccaggctggagtgcaatggcgcggtctcggctcactgcaacctccgggttcatgccattctcctgcctcagcctcccaaatagctgggactacaggcgcctgccaccacacccggctaatttttttgtatttttagtagagacggggtttcaccatgttcgccaggatggtctcgatctcctgactttgtgatccgcctgcctcggcctcccaaagtgctgggattacaggcatgagccaccgcgcccggactgattatcttatttacacatgagaaaaccagggcttagaaaggttaggtaacttcctctaggttgtacagtaaatgtggacctagaagcattttgacaagagcacctgtttttttttcttctctattagtttagaaattatatactcttaattatcacctgggattttgattagacagccttcatgttctttttcatcttaaatgttctttgtgtcttaaagggctaagtgatttcttcagatcttttagttcactcattctcagtgaactaaaatgaggtctaatctgctactgaatcaagttttcagcatgttatttccttcctccctccctccctccttccttccctcaaccaggctcccgaggagctgggattacaggcgcccgccaccactcctggctaatttttatattttagtagagacggggtttcaccatgttggtcaggctgatcttgaactcctgacctcaagtgacccacctgcctcggcctcccaaagtgctgggattacaggcatgaatcaccacacctgacggcatgttattttcatcgcaaagttactgtaagctgggagaagtggcacacacttgtactcccagctactcaggaagcttaaggtgagaagattgcttgagcccaggagttttgagaccaacctgggcaacacagcaagaccccagctcaaacaaagaaaaaaagttattgaatttttt

SEQ ID NO: 85644 - DNA, 1046 bp, Homo sapiens
tttctggctgggtgtggtggctcatgcctgtaatcctggctacttgggaggctgaggcaggagaatcacttgaacatgggaggcagaggttgcagtgagccgaggtcatgccactgcactccagcctgggtgacagagcaagactctgtctgggaaaaaaaaaaaaaaaaaaaagagtgttttctttcctattttccaccacttgattaagttacttttcctcttaagtattttttgctgagtatgctgacttaagagtaatgttacaaaatttaatttttaaagttctctgaaagcccctttatgagagttttaggctatcaaattgtgtttaattcttaacaattttttgaaaaattatagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggtaagtaactatcattttttattaacttgtattagaaggatttgagtacaatatgtgaaacttctgtcataggatacagaactatataattggaaagtgctttggaaaaaatgtatttaaaataacagctacaagtataatgggtagctgtgttgtgttcctgtaaatatagaatataaagcatgcccagtagaaaaacaagcatttccagaagaaatatatctgatcactaaatataaatatatgaaaaagatgtctcactttattactgagggaagtgcaaattaaaataatcagttaatgttctcctaacacattagcatattttttaaagtttgacaatttgaatgtcagtgaagatgcagggaaatacccctcctatttagtgataatataatctggtgaagactctttggaaagcaatttggaaatcagtataaaatatgcatgtcatttaggccactctttctaagacctagccctcagatatgctcattcat

SEQ ID NO: 85645 - DNA, 1052 bp, Homo sapiens
gagctgttgcaaacagtccatgtggagggtgtgagtaagatgtttcccttgaatttgccagaattacttttttgttgttgttgttgttttttctgagacagattctcgctctgttgcccaggctggagggcagtggcgagatcgcgcagctcactgcaacctctgcctctcgggttcgagtgattctcctgcctcagcctcccaagtagctgggattacaggcttgtgccaccaagcccagctaatttcttttgtatttttagtagagatggggtttcaccatgttggccagactggtctcgaactcctggcctcgtgatctgcctgcctcagcctccaaaagttctgggattacaggcgtgaaccactgcacccggtcccttgttaagtttattttggtgggaagcaaaggaggtttcagcttttaaaaagtttgaaaattattgctctggtaataattaaagatttgagagtaaatatgctttctagcagaaagaataaaagaagaacagatagcctcaagaaggggagccaaagaagcaggctatatctgacacactgggtgttgataaatgggtattaaaagaatgagagcaatgagcagatagaagaggaaattaggagagtataataccatggagaccaagaaagatagactatcaggaaggagtggtaaaaataagttactagttctaagagagatgttaagagggaccggggaaagccttgtacaaatgagttagtagcattttacattatatacatctaattaagaaacaatgcgagagtctcaccattcctatagactcttacttgtacttgtctgaacacgaaaactggcttttgtttataaataagctaaaaattattttgctccaatttctcatgaaaataaaaataaaccttcttttaacattgaaaaaatagtttgaagacagtcactcttcattttgtaattcccacaactattattgaatgactgaaattatctttattctgaagccaaaggggtgatactgatatttcttcagactactaaaaatatattttat

SEQ ID NO: 85646 - DNA, 1050 bp, Homo sapiens
acatattgtctatggcttcaaggataaaggagagtgtgacagaaaccatatggtctggaaagcctaaaatatttatgatttggcccttaacagaaaaagtctgttgatctgagatatatgagaggaggcaggaaattattttttgccagatgatggataactagcatcatttacagatcagtctatcttttcccaactaggaactctatatccgaaattcccaatatacctgggtctgtttctgtgcatttgttttgaatatataccataagtatcaagaatggaatggaaaccaaatggaagcctatggcaaaataatgctgcctcctcaatctttataaaaccagctccctcttgacatttaagctaagatttgaatgtcatctccttagaggacatccttaaccactcaatcttaacagagatgactgcctagaccagggtgttaattgtcacagatggtgagacgtggtaggatttcgatatgtgtgaggtagacctaacagatttgctgatggatcagatatagagtaggaggaaagaagaggttcaaagatgtactaaagttttgggctgagcaactaaaaatccaaaaatgcagccgggagcggtggctcatgcctgtaatcccagcctttgggaggccgaggcaggcagatcacctgaggtcaggagtacaaaaccagcctgaccaacatggtgaaaccctgtctccaaaaattagctggtcatggtggcgcatgcctgtaattccagctacttgcgaggctgaggcaggagaatcacttgaacccaggaggcggaggttgcagtgagccaagatccgccactgcactccagcttgaacgataagagcgaaactccatctcaaaaaaaagaaaagaaaaaaagccaaaatactacttcttgagaaaaactgatgagcaggtttaaaatgactaaatctggcataaaattttagatattgtaagttgaaggtatctactggattaagcttgtccatcccgcggcccaggatggctctgaatgtgcccaacacaaattcgtaaa

SEQ ID NO: 85647 - DNA, 1058 bp, Homo sapiens
acccctgacctcaagtgggcctcccacctcggcctcccaaagtgccaggattacaggcatgagccaccgcggccagccagaaatgggttttggaaaaagcactaaacaaaatcgaacttggtttcatatgacagctctgctgctaactgtaacaggggcagaccagttaacctacttttctgtcttctgtcagctgagaattagatgattcccaaaggcccattgaactctgaatgactttaaatacttcttcttaagtgggtacacggttttggtaactgatgccaggtgatgaatgcatgaaagtgcttaatgaatgaaaccggtaaaatagtaggaggaagctttattggtaaggcaggggtatacctaatagctctctaatttattggtattgaagtggttaacttttgtttttttaaggggggaaaacattctaagaataatgaggcaaactgcatattgcacaagagactgttgtctctattcaacaaataccttttgagtgtccagagtctgccaggtgctgtgctaggccctcacgattgagtagtgaaccagagaatgtccctgcacccatggagcttattgtctactggggtagacagataataaataagcaaacaaatcttctctcttctccctttcgctccatgtaagtgtgtgtgtataggtgtatacttacaagttgagtaaagtgttatgaaagattaagaggagaaatgcattttggttagatgttagaggactcagcaggtgaccttgaaacttagagctgaaggatcagtaggaggtaactagagaggccagggaatcgcatgttcaaaggccaggaggcaagaaagagcatggtgcccttcaagagaggaaagaaggctactgtgactggagcatagatgtaggcaagtgttgggtgattgagagctctacgggccatggttaggttttattcctaatgccgagatgccaaacatggtggttcatatctgtaatcccagtattttaggaggccgaggcaggaatatagcttgaacccaggagttcaagaccagcctgag

SEQ ID NO: 85648 - DNA, 1054 bp, Homo sapiens
cccgcccccttcatctgcatcctgccggaccacctcaactgcacaccgcccgccaggcgcggcccgcccccgtcatctgcatactgtccgcccacctcatctgtatttccttcttggctgccagaaggccccgcgccgtgggcgggacgcaccggctgaccggctgcaggcctccgcccgcggatgctgagaaccgcagctgcacaaggtaggctggaaaaaccccactgcggtgaggcggaagcctagtgccgccggaaaggcaaaatcctgctcgtgtgaagctagacctatcaggacaagagaaacctaggactagcgcaggacaggcgcttaataagcatttctttgggtgaatgaatgaatggatgaacaactcgaggaggtggtgaagaaaaataacgctaacaaagacgtactcacccaaaatgaatactatggctaataataaaaatgcataccaatcgtaagtagaaactgttctgccgctgtcggaaattactaaaatggaaattaccctgaacgactttcatccttcatctgacagtgaaaacacttagaacaacgaaatcttgcagtaaaaatatttaggactaaaaaaaccattagtggtatgactggttctatctcgtgcatcacttgaacactacggtccattctcaggtgtcacgcatcaacatcgtaggacaccactgattactcctaacgcctccaaacagtgtgttcacttggttccaggatgctaccctctcctagttttctgctcactcccctagaagcctcttcccagtcccctttgttggttcctcctcatcttgacccaccctgggcactaaagctcagccaacagacctctttcctatatactctcttggtctttgatttaccaacttgtggctttcaaataccatctacatatctccaggctggttccctcttctaactccagactcatttgtccaactaccttcttgacaccttctcttgacacctccacttaggttttttaatagtcctctccatctccataagtggcagttccgttcttccagtg

SEQ ID NO: 85649 - DNA, 1015 bp, Homo sapiens
ttttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttt

SEQ ID NO: 85650 - DNA, 1035 bp, Homo sapiens
tacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccat

SEQ ID NO: 85651 - DNA, 1032 bp, Homo sapiens
gttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaa

SEQ ID NO: 85652 - DNA, 1126 bp, Homo sapiens
gtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttg

SEQ ID NO: 85653 - DNA, 1039 bp, Homo sapiens
tggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatt

SEQ ID NO: 85654 - DNA, 1651 bp, Homo sapiens
gacaggaggtcacatgtgtgaatggcctgtgtctgctttacagggttgagcaggctgagggtgtgtgcctctggggatgctgggctgacagcaaatcccaacagtatttcggctctggactgatttggcctttagtgcttccccaggcctctttcatcggcatgggaaaagcccttaggggtgggcggtgagggcacatttataactaacaaagaagaatgcagttgccccagcatcctactggtcaccttaagtggcagcagagccctccccagcggtgccccagtccctcagaagtgctcagtccggcccgagtgcccatctggtggctctgccgtgttcttctgggcggatctgtgtgcactacacagcgagtgagggcgtggctcacacagttgtttgagggaaatgggtaatgcccatcccttgctgttttaagtgccaaatagcgtgttagcgcccctccaacaaaggatcatccttccagtgagtcaccgagaatgacagtgactgccattactattcaaagtacatctctgattgctgatctgagccactggttcagagccaggttctagaggctgcaggtccagccccttaccattcctggagaggtaggagctcagtcccttcctccaagccagacctttgcagaggtggcaactgggctgcacgggtcagcagatccctgattctcaagccaccttgagacaagaactccgcccccctgttagtgcatcccagctgcagctctgcatcagaacctacagtggacccttttgaaaacactcttggctgccctagttggttaacttcagaatgtctggaatgggaccagagatgcagttcacatgttttgtaagttctttaggcgactgaagcacagctgcttggagaaccactgaggggtggacaccttcccctggcagccacaaggcaggcagcctgcgggagctcctgagcagctgttgggcgatggtcattacatcacccatgcctttgtatttaaatgaaactcgacacatagaaccaattcaacctgaaagttactacttctgctgattcaggcacttgtttgaagcattttttttttattaaccctgtacttcttctttgcccaccattaaagtgggggaaagtaatatcccaagtagttgagttgagctgttggttgttagatttaagctggaattagtccagggttttatgtggggaggcagttgctgtcttgggatacccggagtgggagtgggtgttttctgtgattggttctgttttttatttttacttatttattttgagatggagtttcatccttattgcccaggctggagggcaatagcaccgtctcagctcactgcaacctccgccgcccgtgtttaagcgattctcctgcctcagcctcccatgtggctgggattacaggtgcccatcaccacacccagctaatgtttttgtatttttagtaaagagggggtttcaccatgttggcccggctggtctcgaactcctgatggcaaggtgatctgcctgcctcagcctcccaaagtgctgggattacaggcatgagccactgagcccggctgtttttttgtgttttttttgttgttgtttgtttgtttttttttttgagacagagtcttgctctgtc

SEQ ID NO: 85655 - DNA, 1203 bp, Homo sapiens
aaggtgagaagtcgctgttctctgcattgaacatggattgaattttccttgtctgatggtaacccatggcccccgccctgcggggataacattctcaggagcttctcttgtcctagccccttctcatttcaaaaatattagtcttttattttcctttttcattcagtttttgttttacagcttttgtagagaccaacccaagtagatgcaggtgggtgttagataaaaacacacatccccaggggacaagccatccagcggtgaggaatctctgccatgttctcttccctgctgcccacaaacgttacggagactcccttagcctccccctcctcttccccactgaggggcagcttgtggagatggaggactcgggcccatagatgcagaccccctaccaaatctagcaatagttctcacccttccaaagctcgagtgccattttgagatgacctaccaatgacatgcagtaaaggacataacctcacagcctttttagaagcatttcgaatatctacagttgcctcaattcacggggcatttcactcctctgatccaggttagaattttgctaaatctgtagcatcctgaatagcacactaatttttttttttagcacactaactttaactacattagttgagtgtagttgatacatctgtggcctcgtgtctataaagagcacactagattgtacccagcacttttggatatgacatgctaattagatgtatttaactattcataggaaagtgtatgataaatgactgtaatatttctaataaatatattttgtttctaattatttttttctcactgacatttatcaatattttttcaaagtgccacccttaaactgagtctgttttcagaccagcatcttcatgcatatatccttgtcgggtcacagtctccactgcagctgctcttgcgggtggtgctggaattttccacagaggactgggctcctgctggttcctccgctgcccgtgtgcagctttcttgctcaggccacaggcttacgtgaagatcacccttcaaggcctacccaggacactgctgagctgtgcagatgtgcacacgatatgtgcaatgtgtgactaaatgccaactgagaccccagaaaccactcgcagggggaattatgccaagattgaggaggcagggtgaagatactttttttctttttctggtttttttttt

SEQ ID NO: 85656 - DNA, 1683 bp, Homo sapiens
aaaacaaataagcacgtatataattaataagtaaaaatttaaaaatcaatccctttgcaagctgcaataattaatgaggttgtcactaaccaatcagaccatttacatcaagcattgtggtgagacagtctttcagttagtataagagtaaacagaaatggcgaaaaactaattcttcacaatactaggatttagttaaattgaattcattttataggtgggtaactattcgtagaccttgaagttctgaaatacagagttaaaataagagaaagctttctggaatcaataatattctagttattgcttagttgactcattgtgacatgcttccaacctgggcatcaaacaaggatacacatcaaatcggactcagtctggttggctccttgcgctctgtagccgtggtggcagcagcagcagacgtcggcggctgggctgccaggagcagttccactgggtttcactgtccgagacttcctttggggcactccagcaaaccaaggtggagtacgaatggaaatctgataagcaagggcttcagcaaatcctgcagctattgaaggagtcccagtccccagacaccaccatccagagaactgtgcaacaattctagaaactggaacaacttaatcaatatccagactttagcaactacttgatttttgttcttacaaaattaaaatctgaagatgaacccacaagttcattgcgtggtctcatcttgaagaataatgtgaaagcacactttcagaacttcccaaatggtgcaacaaacttcattaaaagtgaatgtttaaataatattggtgactcctctcttctgattagagccactgttggtatttcgatcacagctatagcctccaagagagaattgcagaattggcctgacctcttaccaaaactctgtagcctgttggattctgacgattacaccacctgtgagggagcatttggcacccttcagaagatttgtgaagattctgttgagattttagatagtgatgttttagattgtcctctcaacatcaggattcccaaatttttacagttcttcaagcacagtagtccaaaaataaggtctcacgctgttgtatgtgtcaatcagtttatcatcaggactcaagctctgatgttgcacattgattcttttattgagaaatctctttgcattggctggtgagccagaggtatggaaaaatgtgtgccgagcacttgtgatgttgttcgaagtttgagtggatcgcctgctccctcacatgcgtaatatagttgagtatatgctacagaggactcaagatcaagatgaaaatgtggctttagaagcctgtgaattttggctaactttagctgaacagcaagtatgcaaagatgtattcgtaaggcatcttcccaggttgattcctgtgttagtgaatggcatgaagtactcagatatagatattatcctacctaagggtgatgttgaagaagacgaaatgattcctgatagtgaacaggatatatggccacgttttcaccgatcaaggacagtggctcagcagcatgatgaagatggaattgaagaggaagatgatgatgataatgaaattgatggtgatgatacaatttctgactggaatctaaggaaatgttctgttgctgccctagatgttcttgcaaacgtgcatcatgatgaac

SEQ ID NO: 85657 - DNA, 1051 bp, Homo sapiens
ccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattc

SEQ ID NO: 85658 - DNA, 1566 bp, Homo sapiens
tagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtc

SEQ ID NO: 85659 - DNA, 1035 bp, Homo sapiens
cgcctccagctgctggtggttccacgtgttccttctgtggctgtcactcccctggcttccgggtcacatggccagctcccctgactctgtgtccagttccctctgcttctctgtcatgaccgtggtcattggctttaggacctaggcagatcatccaggaggatctcatctcaacatctttactttgagtctctgcaaagactggttttacaaatgaggtcccagtctcaggttctgagggttgagacgtggatgttgttatttgcagggtgttattttttggtggccacagtcccagccccagcaccgtggaaagcatgttgctttttggtagttagcggcctcttcctggtgtcctctcatggctgtcccacccctgtggcacacagatgacctcctgaataaaacaagaccagagtcagagctccatatcatcagtctgaccacgatggtcacgtactgagggaggtgacagtactgttctaaggtcagggtctcaaagatcttggtgtttcctgccaaacacagctgtaggaaaatgcagtaaataatgtgcatggcttcctgttcccagcactcctctcccccatctcaccaggggaggtgctggtcatgaaataatgagcagcaatctttgtcccttttgaggaggcacctgcctaggttgtagaatggattcagcgtaccctttcaagctaaccctttacatgtgggaggaagagcaccttcaccatctgctttgtcacaaaccaaactcacattcctccagatccagctcccattaccagccctattcaggacccaccttggaagaaccaggggccacgccaggtggcctcaggacccaggtgtgctctgaggcaggggcctccacagcttgagcgtcagtgtcctcacgaaacatggggagatttctgcctgaagcataaagtgcacctcggtgcagcatctgcatggtcaagcttggataagtgttggtttcacgagagccttgtgtctctgggcctgatgattttaatgatgctgaatcctgcc

SEQ ID NO: 85660 - DNA, 1064 bp, Homo sapiens
ctttgttaggtcaggggaccctctcacccaacctcagtgcatgctacaggttttttgtttttgtttttgtttttttcaggcatggggtcttgtgtatgttgcccaggctggccttgaacccatgggctcaagcgatcctccctccttagcctcccaagtagctgggactacaggcatgggccaccgtgcctggctctgttctttacttcagttgaagtttaaaaaccctggacatgatccaccgaaattatttcagaacccgaaatggactgtcacttctaaactgcataagacgagcaaatatcgggaaaggccagtgctgcctgtgtcacgggggccattttctataaggagcatagaccgtttggggccttgtctctgagtattagaaaccgagtttgctctgagcaatttggacctcctcgctgtcccttaactactgaattccattagtaggagattgtctcaagatttaaatcctgtataaatatcgagagtaaatttcccagtctgcaagttttcattttttatattgttaaataaatttctagcaaggaactggccttgtgaaatgcagcattgactgtccagtgcaggccaccgggcctggcctgggcacgctctgtgaaatgtgcaggggtctccagtgttgcctagggtcacaggccccaagttctagatgcagctgagatagacctgtggattcagagcctctgacagggcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatca

SEQ ID NO: 85661 - DNA, 1001 bp, Homo sapiens
ctgtgagatgcagagccccagctcctgtctggtctgtgagatgtcctcactgtttcaggaggtgagcgccattgacttctgcaggggaacatttctgttactttgttttcaccttcaaaaaaaaaatttaaggtggaccatgataaaggaagatacatttagaaccttttgtagtaagttaatgtttaatatacatgtctattatggaaaacacagttttccaaaaagggaagacctggcgtgatttttggggacgcactgctgactcagaacaaggagaagccctttgagaggcttgtggcagagacttccctggtgggtgacatttgtctctaaagacgggtgattctcccccttcctcttcctccatggtctaccttcctggctcagaaaggcacgcatgtgtcaccctcctgtgtcctcctggtatgcgagtctcctccaccgccaggtctctctaagcatgccccatcagagcctctgtcctcatgagctacgcgctgcacgttggctgttcctgtgggctgcacgtgtggcgttcctgtccacttctgtccccggcatcagagcatggcagcgttcagagcaaggcgttcacggctgccgcctcagccctcaccggctccgtgacctagacatgcttctcagagctgaagcagctcagttacctcaactaataagcaggctggtgcctgttcttcaggtgccttgcacaggagccagccaacagccctggcctgttcccattcgtaacctctgcgagagatgcagccacgccagctcactcatgtctgtctggtcactggtcgcttttgtgggacagccacagagttgagcagttggacagaggctatccaacctgcaaagctgaaattatttactgtccaagcctttcaaaaacagattgccagcctctggtcgagcctaaccgatttcctcaaagtacctgcaatgtgccataactgctggggacacggcccaaataggagaaaggagggtgc

SEQ ID NO: 85662 - DNA, 1196 bp, Homo sapiens
ggcccgacctgcggcgctccagctcatcgccccgcctctttgcggcagagctcaggccggcgcaaaccggttcagtgctaggactgacgtctcgcgccgcccaaccgcagcacgcccccgcctccccagtcctctggaagagacagggaacgtctagccgccagggtcccgggaggcggctctgtaccagacggactatactgagagcctatgacaatagccgaaggtgccggggggggggggggggtggcctactaccaataaaggaaggggaggggcgggccctcgttagcttcccccccctaccacgcttcctcgggcgcgggtctacccagagcctaacgggcgcgcgagtgtgggggaagggcctggcgcgggctggagactgcgcagtgcggtgccggccgggagggggggggggggtgacgtaatctccgtccgcggccgcggcgccccgccccgcgacaccctccgcgaaccgcgagagcgcagcgcaggcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggtgcgcccggcagcccaccgcgcggcgggctcggggccttctgccgctcctgaggccggccggcggaggggcccttttcctgccctcttcccttcccccgttgcctttccctgtccttcctcttcctctctccttctgccctctcttctctttaccccttccccctcctttccttcccccctcaactctctcccttcccttatctcctcatcttcctatccttcccctctccccccttcccccattcttcctttccctccccctcctctctgtcccctccccctcctctctgtcccctccccctcctttctctc

SEQ ID NO: 85663 - DNA, 1045 bp, Homo sapiens
cataacaaacccaggagggaggtcctctcacaacttcagctcagaggcgaggacactgaggcccagggcagtgaggcccctttgccaggctgccaagtgactgggccagggtgtcacccaagccaggctggcttgagggttcatcctcatgacccctgcactgccgctgttgtgctgcagttagtgtttttcaagtggtctctgagttttgagaagcgacaggctgcatacttggctcttgacccccatgacctcggtggcactgtgcctcagccccaggttgtcaatttgaaattgggtggacttcacaggcactggcctccaggggcccacggaggagtgttcggaggggtttccacccaacacgcctagtggggctctgggtcccggccccagaggctgagccctactatccttccctgagctgaggcccccacccctttcatacctcaagctcatcctgggcagtggctgggccctgggccattctggacaaggcagggtggtcctaccctgagacctacctggtacaaagacctgggattgcagtgagaaaaaagcttttaccaaatagccatccagccgggttgaactcttcccaagcccccacccctcaaccagcttattacatgcaagttttaagctatccttgcctggagccttctcttgccttttgtcaattgctgtaattttctggtaaagctatatcaacaaaatggcaaccattcctgcctcccactgtttatccctccttcccctaggaaaccctcccacattccctgttttcaggatcttggtcccgtgcaggactccaggcagcacccacagaaccctggagtggcacaggcctcggtgcctactctacagctttcctgagcacttctcagattccacacaaagggtccttgggacccagcatagcctgcaggcaagaacacctggtcagaacttcctcttggggcagggatggtaccagtagtgcctggtgaaaagcttggtgctttagataccaccttaatccccagttcatacaatggaggcttgg

SEQ ID NO: 85664 - DNA, 1810 bp, Homo sapiens
ttgttcatagtattcttttataatcatttttataatctttataattttttttatcatctcatcatttctgtaaagtcagtggtcccactttcatttctgattttagttatttgtgtcttctgttttttccttgtcattctagttaatgctttctcaattttgttgatcttttcaaagaaccaacttttggcttcattgatttttattgtttttctgtattctgtttgtttatctctgttctaatctttattataatgtttccttcctctgctggttttgggtttagtttgctattctttttctagttccttaaaatataaagttacattattgttttgaggctaagtgatccgtgggacacatagctcagatggcctgccactcagaaagtgaatttgtatctgttgtatttgaccaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaaggtaacagtcttgagaaaagagcagtgataagtgatatgttggcattctttttacttcacttggatccttttcagctaaacgttccccatctccatcctctctgttgccctggagtgggtgttaggtgttattgttacagtttgggtatttgctttatagcttccaatcaagatgttctctttagtgacagccacatttgtgcagcattacctacatgtctttttcatggtgcctgcaaacccctacaaggtggggatatttttatgtcccaccatggatttcagtccaggggagaggctccagcaggaaaagggaactgagctaaccatttgcagtgacctctgtccctgtttccttgcctctctcctctctcctgctggcctgctggcactctgctgggcataggaggctggaagttccaacatagtcctctaccctaaggggttttcaccattctccctcattctgactaaatatcaaaagcaaggtcgccttccatcagcatcgggtgcaatgactggaagtagggcgcttgcctaagcctctgcatctgtcctcagcactcctgccctccatgatcaagaggaggcaaggccacattgtcgccatcagcagcatccagggcaagatgagcattccttttcgatcagcatgtgagtacttctctctcccacaaaatgcttggctttattgttttttcctgattataaaaataacacatttactatctagaatttagacattgtagaaataaactatccagaatgcaaaggcacttgagaatgtgttctccagagccacatgcctgggatcaaatcccagctctactttctgtcccctgtgtgaccttgggcaagtatccccacttctctgtgccctgccctcaagtgtaaatggagacagcctcagtcttagcccggaggactgctgtgagcgctgtgcttggagctgccccagacactaagcactaggcatgtgctagccactcctactgttaagatttttagcttgtcccacagatataaccatgccatcactttggggcatatgcttccacagttttttctacgtataattcaaacatgcaaaaatggaatggcattattcatattgctttgtggcttgttaatctcacttaatgtatctttctacatcagcatgtatggatttacctc

SEQ ID NO: 85665 - DNA, 1012 bp, Homo sapiens
tatataatttataatttttttcctgaaccatttgaaaggaaactggagacatgatgctcatttattcctatttcagtttgtttcctaagaacaagggcacagtacacttctcaaagtcaggaaatgaacattgttataatactgtaatcttaaataataaaaccaggttttaaagctgggcacagtggcccacgcttgcagtcccagctgaggcaggaggatcacttgagctcaggagctggagtccagcctaagcaacatagcaagacgatcacaaataaaaccaggttttcaaaacagagagcgtgaatggtagtgaatagttgggcaccaggccatgcccaccccagcgcactcagtcacctgcctctccgtccacatgtgtagatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggaggtgaggcccggtttctcttttctcctatgaaaatctgtcggtcagccacagtgagacatgctgctcttacttcagtgattctttggtcattttcatttggaagagaacttttaaagtgaaaaaaacttgacagaggtgttggttctagatatggactattgaataatcttcttttaccccaccatggcctacccttagtgtgaacgtcaccattgcagcattcagaacaggacctctgtgggcaggactcaagggctaaaaggaagttgccaagctgaaatgccaacagacttccaactaacccattcgcagatcccgagtccaaggagtattatcggcatcgggattgagtgaattgacctcatggcaagtgtagggtgtttgatggtctgtctctgtcccataggcttgagaaatgactgattcagggccagtcttcaggatgaggccgagtgcagcagtctcagcacct

SEQ ID NO: 85666 - DNA, 1064 bp, Homo sapiens
cagcagtgaggtgggagggagcctggagggccttggcttctcgctgcttccaggctggttgggactcgtggacgcacccacccatccgtcccagcaagcgatggagcctgcagaggggtctgggtggatgtgggtgccagctgggcttgcaggggggccggagggggtgagggggtgggatctgcccactgctgtgtttccagatggggcagtcggttccaggaccggggtttccactggaatttcctctgtgggaccaacagtggttttcactacattcaggatggcgctggcctgctgggcagagaaaggtaccgcactagggtggatttgggtgttggcgagaacattgtgtaaccccagcttgacacctcccttttgctttgagtgttcctgagggaggaagcccgcctctggtgcccgccccaaggtgtccctggcctggctttgacagtcagtaggatgcacagctgacttggaagcaactccatttccgtctcaagattgggacacgatttggtcctccacccctaccttgttatctggcctctctgctcctgttgcctgatggacttgagaccagaagggagttctcttggccaggagtgctcccacctgagagtggaggccccgcccctccccgcacacccagggccacagccagcccattgcgccaccgccactcatttctcatctgagcacgtgggggcactgctcggccttcagctttccagcgccagtgaagaccctgctttgggtgtgcttgtttgctgtaggtagcttctaaaatgctgcatctggctggatgcggtagctcatgcctgttaatcccaggactttgggaggccaaggcgggtggaacacttgagcccaggagttcgagaccagcctgggcaacatggcataaccccatctgtacaacaaaatttttttaattagccaggcagccaggcgtggtggcacatacctgtagtcccagctactcgggaggcagaggtgggaggatctcttgaacccgggaggtcgaggctgccatcagcagagatcacaccactgcactcctg

SEQ ID NO: 85667 - DNA, 1004 bp, Homo sapiens
cggtttactgcagcttctgcctccggggttcaagcgattctcctgcctcagtctcaagtagctgggaccacaggcatgcaccaccacgcccagctaatttttgtatttttagtagggacacagtttcaccacattggccagcctggtcttgaagtcctgacctcaggtgatctgcccacctcagcctcccaaagtgctgggattacaggcgtgagccaccatgcccagccttatcttagattttttaaagttatatgttaaacacatcaaaagttatgtttacaatatgtgaaaagtaataaacatgccacagcatgatggcccttaaaaacataatgcaaaatgaaagaagccagttgttgaagaccacgttacaggattccatttaaatgaaatacccagaattggcatatccagagagttgggaagccgactggtggttgtggagggctggggagatgtgaagggaccactaattggtacagggtttctttctgagatgatgaaaatgcaccaggatcagttgtgctattggttgcacaactttgggaaagccacttcatcgttcacctccgatgggggagttgctctgtgaattctatctcagtaaagctgtgaattctatctcagtaaagctgccattaaaaaatacaaatcaggccaggcatggtggctcatgcctgtaattccagcattttgggatcacctgagatcaggagttcgagactagcctggccaacatagagaaactctgtctctactaaaaatacaaagttagctgggcgttgtggcacgtgcctgtaatcccagctgcttgggaggctgaggcaagagaattgcttgaacccaggaggtggaggttgcagtgctccgagattgtgccactgcactgcagtctgggtgacaagagtgaaactccgtctccacaaaataaataaacaaataaaaataaagaaaatgagaccaggtacaatggctcttacttgtaatcccagtgctttggg

SEQ ID NO: 85668 - DNA, 1003 bp, Homo sapiens
attcgtgctgactcaaatctcagctccatgttatacgagtgctctctcccgttgctgctcacacctggttagcatctgcttttgctgaagctgagggaaacattatctggtttggggaaggggctagaacagagtgacactttgggcacacttgccagatttgccagcggctaccaactctgaagcatgcattgtacttaaaggtcccacccagtgccagactgcctgcagtattactgccggcgctgtgtgttggatggtccagtttagcacgtgtagcgtgtgggttcttgctttaccttgttgagtctagaaccacagctctagaattagtgctgaattaacacagcagttcagtagtcaccagctacatgtggcaattacatttaaattcattaaaattaagtaaaatgaagaattcagctcctcagtctcactagccacatttcaagtgctcaatagccacttccggcctgtggctaccatattggacagcataggtggaggacatttccatcactgcagaaagttatgatatggacagtgctggtttcgactaagataggaggggtggaaatagcaaaatggtagtgcttgcatgttgatttttctctccactccattaaatctagggaaccaacagtgtttgtaatgaagaacatcagactctgagctgtaacctgaattcttgtccaaaattcagcacactggcaacgagcacatcaaacagattgccacttgtcctgtcggcgtctttgagacacacttgcccatctaggaaagcacagtgcaggtatctgtgttctgccaccgtgtgccagcccggaccagctcacagacagccctgcctgtcttacttgggctgctcggcttcactgtctcagggcccctgaacctcccagagccctccgtgattgttggaatgtgagtatagctgtgtgctcttgagttcctgtttttataatcacgtgaagatgtacttgatctgcttctgagcatgata

SEQ ID NO: 85669 - DNA, 1065 bp, Homo sapiens
gacgttggcaagcagagtgtctccaagatggccgcttggggaaggaggcgtcttggcccgggcagcagtggcggcagcgcccgagagaggtgagatccaagggcttgttgcccccagtgcaggcggctcagcggccggagagcccagcgcggcctccgagggctgcagcagccttccttccctggtttccccgcgctccccctaccctcgccgggcatactgggttccagttccggaggatccgggatccgggtgggagcgaggtcgaaggcctcggcggagagcttaggggaaggggcgttagccgggctgagtaaggtaggcagcggccatgcggggcggggcccgaggccgggccgtgctgaaaggaactggcgcccagcgcaggcctcagggacccgcctagctgcccgcgggccgatcggctgctgaagcacccttcccgcctgggcacgcgcgtggccatctcggccgcggccccagacgtgtagaggaaggcagggcccccggagagagaaagaaggggaagccttcacagagcaggccggccgcggcaggggtagtttgatctgcacgtttactagggagctttagctcccgccagatgtgtctcttccgagcccagagccggccacttcctcgagggaagattctgaagacttttggatggttctgtgcaagcgctcctgccgtagaagtcctttaaagtgacctttcctaatgaatggtgtgtgggcagggagctaggagcgtgtttcttccaacagggacctccatttgaataactgatttctagaagatgagattggagtagtttccgtgtttcatgttcaagttgcagtttttgcatctgggaagcagtttcagctagtggaaaccactagaagctgttcagccactagaaatttgggagaagatgtattggtggagccacctggattaactgtccgctaaagcttgattgttatagcagcggtcagcaaaaaaggaaaagtttttgttttgctggttctccccctccccgtctttttggtgaggattgtctaacagaaaagttatcttcct

SEQ ID NO: 85670 - DNA, 1403 bp, Homo sapiens
gcccagagattcccaggtgctgctgcctcagacctgtggactctttggaggatctcttacagtttgtgaacttctcagttcctctactgctcccacagacaacgttgctaaacatattaattggtcccataaatacttgagcaaaacaaatgcgaaaatctgtcccgaattcagcctagaagaagcccagccctgcgcgtcacacttctgtgtagtggaaccccccttcccaccccgccgcaggccacagcaggagggccagcagacggaaaggcgaccctctccttgttgaggattcctttcgatttccttccagctgacattctaccacagttttagctgcttgcaatcctctcaccgtccctcatcacctacagtgtgtgattcaaattccttagcacaatcaagaagcccctccttagtttggaagttgcctagctctccaaattcaactgcctacctttcccgtctggaacttgccaggctagtaaattcagagggtttgcagatacgtagatgttctatgctttacctaaaatgcttttacctcccagccaacttttttttttttttttgagacagagtcttgctctgtcgcccaggcttgagtgcagtggtgcgatcttggctcactgcaacctccgcctcccaggttcaagcaattctcctacctcagcctcctgagtacctgggattacaggtggtgccaccacacccagctaatttttgtatttttagtagagacggggtttcaccatgttggtcaggctggtgtccaactcctgacctcatgatccatccccctcagcctcccaaagtgctgggatttacaggcatgagccacggtgcccagctctcccagccaacttttgtccttcaagaccttgtacctgtctggtctctaaaaagtacctggccttcctgttgagtcatacagccctgcctccaagtgtcagcgtagttcatgctggagacctcttaacagttccatggtatgacactgcggatatggctgtcttttctttgtatcagtgtggtgattcagagggtatactagggattctagaacgcacttctggctcaggggctgcttgtgtaacttctgtttctcagctgcctggtttgtatcatgggatgatagtatctcccctcagaggattgcggtatttcatgaggtgatacgtgtatggaggccaagtgctgttttatattttaagtgatctacatcttgattttcacaacaactgtataaaagtgatactgttggccaggtgcgttagctcacgcctgtaatcccagcactttgggaggccaaggcgggtggatcacctgaggtcaggagttcaagaccggcctggccagcatggtgacacctcgtctgtactaaaaatacaaaaattagc

SEQ ID NO: 85671 - DNA, 1033 bp, Homo sapiens
tgcagaggccccgggcccaggaactgagactagggctttctcatgaggcctcatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccgtgccctggagcccccagcccatcccatctggtgctaccctgtctgcctggcagcctagcctcacccctcctgtccggtcacctgggggtccttggtaaggatgccgccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggag

SEQ ID NO: 85672 - DNA, 1163 bp, Homo sapiens
gaagggtggccagggagccgggcctggggaggcagcagacaatgctaccttctggtgccggctgcaggccctgaccactctcctctctgcccggctcccaggccgccctggacttcgtggtggaggaggacctgaaggcccatctcacctgctggtacatccagaagtacgtcaaggagaaccccctgccgcagtacctggagcgcctgcagccgtaaccctggcctgcaggcgggagcgctccctgccggactcttccacgtggcctttgcctggccccacgtgctctcaggaacctggtcccactgggaacagactcagagttatttttgtaaggacactcatctgtgccccacgtccagatccctggaggcagctgaccaatgatgggcggtgacccggtaaccgaggcggcaaggaggccaggtagtcccggcacctctcactctgcagagaccagcggcttcgtgggaggcctgtgggtcacacgtaggggctagagccagcctgcatcctgcccaccgggctccacttggagatcagcaggagggccagtgtgggacccctgctgccacctctcctgggcctgtgtcctttctggaaattaagaaggtgtgctccagagccaagaggagcaataagaaacctcgtgtgccagcttctgagggtggcagtgccagaccccacctgccagcggtgctgcccctttctcagacccccatgcccagtgcaggcagggccctggaaagggtcagctctccctgacagagaccagcagagtgaaggactgagcactggccaggctcaaccgtacgtgcggttcacacatgtgaacacacaggatgcagtctacaggcgggctggtggtgggtgccgggggtgttttcctctccttggtacccccatcttttttttggcctctcgtgtaggttctgcaggaaaccaaggccccatccccatgggctgctatcccctatacccctgtctgccaggaggagatccaagggggcctgagcagctgcaggcccgccccttgctggccttggccacctgcctgagccttctccgaggagatgccttggggctggggtgggagtgaagctgactattctccaaaaaccaccctcagcatccaagaggaagaaacatcagccacaggggtt

SEQ ID NO: 85673 - DNA, 1111 bp, Homo sapiens
tttatttcatagccacacaccacagggagaggggaaactgcatttcccatatacagatggggagactgaggcatggggaagtgaaatgacttgcccaaagtcttgcaccacagaggtggaagagctgtgattcaccccgcaagtatttgttgagcacctaccatgtaccaagcactcttttaggtgtcggggtctcctggggctgacagtttagagagggaaatggacaagaaatagagtcagttttaaagtatcctggaaaacaagggctttcatgagaggtgcagggggcagaggggaggctgtgttgggcagggctgctatttacaatcatgtgtctaggaaggcccctccctggagggtggcatttaagtgaagacctgaaggaggcaagaaacagagctgcaacagggaagagtgttccaagtggagggaatagcaagagcaaaggctctgcagtgcctgcgatgccttgtgtgtgcaggatgggtcaagaggtcatggggagcaggtggtgcagggcctggaagccgttgtcctatgggctcggctttgactctgaggctcccaggagggtcctgagcagaagacagatgggatgccccagctccctctagctgctgctctaaggggagcaaactgtggggaccaggacagagcagggaggtggttactttactagtccaggcactgcaaacaggcgtgggagaaacgtctagatcctggacagatgtggaaggaagcatggctgtgacttgcttgtgggtgatgagggaaggcttgagctcaggcttgtctgatgccatatcctggttctgaaatgcaagcttgtcattactttatagatggggaaaccaaggcgcacagcctgtaggcagctaagccagaatcaagcccccggcctccatctgaggacggtttctgaaggttggaggcagctggaagagacccccacctcctgggcagccccttccttagccttccctttccctcacaggcagggctgagtgtcccacttgctgcaaggaaaggaacacttgaggggtgcagaaccctggaactttctgcgtcctccctaacccccattttgcagccaggaagactgaggccc

SEQ ID NO: 85674 - DNA, 1004 bp, Homo sapiens
catcccactgaagggacacagaccatggattcagtttggcccagcagtcaggcactcaggctgaggaaatagtgtgcccaggttcaaatcctgctctgccactaatttattgagtgagtcactaggtctctttaagcctcagtttcctggtctgtaaaaggggacaataacacaataacagccacctccctggagtgagatcatttatgcagtctcgtgcttcatacctgctgggtgctcaacagtccctgcttgcctctggctgctctcccgcttgggcaggcagcaggagaggtggatgagggtttgctgagtgagaatgtgagcaagtgatgacatgagagccagagaccctgcaatcgtatctcaatgcgaaccttctgggccgtgggactctcagcaaccgcaaccagatggcctctttgagcctctgttgtctcatctggcaaatgggaatcagaacctagacccgggtgctatggtgtggctctaatgaatgggagatgtctgcaggcacccagcacactgggctgtgggtgcaggccaggtgatggggagggctatgatgttgtctctccgacaggtccaggagggggaggccacctcccacgcctcccctcccatgagcagtgcggccaagcagcctaagccagctggctggttttgataaatgagtattataaacaccaaacaacacacaaagggcatcccagtgctctggtggaagctggggctcctgcggggggtcctgctggaggggacccaactggtaggtatggggcaccaaagaagctccgtgagcaggtgctcctggcagttctgggctgggagacacatcatcgtatccacaatgacaaaatgaagtgataaataatagtagtaatcataataatgataagagcacccactattgggtgttgatgatgtcatttaatgctccaaacaaccctgagagaagatcttggcagaatacttctcagaggcttgcacccagagcatgcaaa

SEQ ID NO: 85675 - DNA, 1048 bp, Homo sapiens
gagttccccaatctgactgtgccacttacagacagaaagaaatcaagagatgtcactatagcaagccagcaagagacctttgtctctgatggttcttgatggtacttcttgagctccagtggtgcagctgtgcatcccagtctggccctcacctggtcctcatgtgtggccctttttacatctccaacccattgcctctgctgttcctttccagggatgctcttcttgcttctctgcctggtaagctcctactggtccttaaaagtccagtctcaaaatcacctcctctgagaggccttccttgtccccacccagatggagatggctgcatcacccaggcaccctcctgggacttttgctcatgcatctatttatagcactcacatggagttttgtgattcctgagctgtttatcgggctcctgactaatccccaaactccttgtatgcgagggcctgtctgagtcatctggccgccaaggaggttggcacgggactggagtcgcttcaccctggtctgtggatgctttcctccttccttttttcattcctcaaatatttatcaggcacctactatgtgcctggttctgggctatgcattgggaacacagcagggaatgaggctcggatggtctggagggagagctgtgttaaaaactgagtcagtaacaaagacatcagcagcataagtgttgtgcctcagtctggggaccatgatgagaaggcctcttaggggtgttcatttaggaagcggtctgagggatgagagggaaccagccccaggaggcttgagtggaagaatgttctgggcaggagcagcaagggtgaagctgctgcggcaggaccatccctggcacatttgaggggcaatactgagactcttgaacatcccaagaagcagagtgcacaaggcggagtgtggccttgtgcagaagtcaaggctgttggccagtgcctgaacccagaaaactcgctggactagccttgcagttctggtagaaaggaagctgctcctggatgcccattttacagacggataagcacaggtc

SEQ ID NO: 85676 - DNA, 1039 bp, Homo sapiens
cccctatgcgggtgctctggctacaccccagctcggaactccccgtccttctctcccccagctcttcttatccttataggccctatgttgccccttccctggctggcctgcaccctgtcctgcagccctgggctcccaggaaccttccttgtcctcccacccctccctaaggtacagccccctctctaccggcctctctctgtcttgagttgcaagcttctccctgcactgggggttctcaccccatcttattcttgtcctggctgcctgggatctgggccagccgccaggccagggtgctggctgtgcaagggatttgctcttctccaagtagctggccttcctggaaatttttgtgaggtggcagcagcaggatttgtcatgcggagggggaaggatgaaactcggagggcaaaaggggaattttttttttttcaggaagaggaaaggatgtttttggtgcgtcggagtttcagtaggctgggttgtgcgagagatttccaaaccggacatagccgtaatgaatgggctgcctcctggctttctgaacctgcagctgcttcaccccagcaagctccctggtgtctctgggcctcagtttccttttctgtaaattggaagtaatcgcacctgcttctgtggacgtgggagtgtggtgtggggtggtgaatagtaaagagctctgaggcgttctctcagcgtagcacctggcgcagagccggtgctcaccagggtacactggctgcacacatctcgctattgtttccattcttcttgctggaaaggcctccactgctggaagtgcagcctcagagtgagcaggaggaagcacctagcagcgggcacctagtgggcacttcatcaggggtcagccgctcttctgttctggagggtgcaggccaatgggagccctatgtgggcctggggagggcatgggctcttcctggcccctgctgctggctgctatggtggctggagccgggtgggctggataattatgccttacataagtgggaggccggatccctgaccattgccc

SEQ ID NO: 85677 - DNA, 1035 bp, Homo sapiens
agcccctagccgatggggcccctgcagcctgcgggtgccccctgcgcatctcccaaccttcctgtcaggagggtcctcaggagttcactggggaagagggagcaggtccttgcaggcagggagccatctgccagggtcagctggcatgagggtgtctgtcggtcagcagggccggctgttgccatggagctggtgcaggtgcatcctgaagctctggtggagggacccagcgaggctgtgtgctaatcctcttcctccctggagacacctggaattagggatcagatagaggaggctggcgcccgaacctggcagtgcaggcagagttggagggtgggggaagcgggcaagtgggtggtgggtgggagcccggtgaactgtggctgagtgggtgggcacacgtcggagagggggctggggctggggctggtgctggggcaggcagtgcaggtggtgcagacacgggcagcccggcagcctggctgagctctgggtgtcacccacagggagacgtgtggatctgcatggagctcatggacacatccttggacaagttctaccggaaggtgctggataaaaacatgacaattccagaggacatccttggggagattgctgtgtctgtgagtggcctgggtgggctggcggggggtcctaggtgcataggcagaggcccagccctgccagcaggcatggagcctgcctattgatggtgtcttgggcagagctgggcatcaatgtgccccctgaacctgggcagctgccctgcataggcccttctcctccaccccagaccagagcctttgtgcttaggagacctccgctcctggggctcctggagccccacagatttggcagatccaggtgtctgagccattgattccaactcttgagttccagatcattttttaaaaaaggaatttagtatttacaacagcgtcatactaaaaatgccccggggcagctcacagaggtacaagctaagttgggggaaaggttagcatccaaaatgtgtgctttttgagtctaaaaagt

SEQ ID NO: 85678 - DNA, 1002 bp, Homo sapiens
tctcaaaaaaaaaaaaaaatcatgtttgaggttacagaaggaataaggaagagggcaacttctctgaacttaattaaatagagcaagaattgggtaaggaagaagcggccgggtgcggtggctcacacccatggtccccgcacttttattgttgaccataatcagcaacagaggagcccagcagagtccctgggcagtctgacccctttaattgtggactaacttctcccagaacccatgataaggagtttctctcctgattgaggataccaagtgtgtgactgttaggcagagcattgcagccccattttggtgttgatatggaaattcctaggtcactatgcagacaagaaaaccaggaccccaggagccagagaaacttgctgcaagtctctagtttgctcctatgaatgcccctccaccctggaagaagccctagacagtcctgtcccttcttccctgggtgcacgtgtcccctgctgctaggcctggggcaatcctggggtggtttggctggcccttgggggctgggcttcctccctgccagcctggccacagctgcactattctctcctagcctgaggaagaaccccgcagagcgtatgagctacctggagctgatggtgagtatgggcgggaggtgcctgccctgctcttcagggctggctggggctgggtggggctctggggagagggctgcatcctgcacacagatgggtagctcctctggctggccctgtgttctctcctttaggtgctcggtcatttgtttgctcctgcatacctggctccctcctccctccttcctgcatgccaggccctgggaagggtacacaggcagtgtgtgacagaatggggcagaggggccaagggtggcatcagggaaggcttcatggaggaggtaccatttgaactgagcctggaaggatgaataagggttatctcctgatggagaggctgtcccaagcagaaggtccagcatgggcagaggcctgacgtgtg

SEQ ID NO: 85679 - DNA, 1016 bp, Homo sapiens
accccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaggactaaaggttgtgtgagattgtgtat

SEQ ID NO: 85680 - DNA, 1035 bp, Homo sapiens
ctgtttcctggtgtgtcctcagtgtcccctaaccccaatcaccaccactggtgctccacagctcactccttcctgcctggctgctgaagtggcagcatgaggctgtggagaccttggggacccccgcccagccctctaattagccttcagccatgcatcattggacatggttccatttgcttggccagataggagtgggaacccctttctcagctgccccagggagcagttccgccttggctgtgcattaatgctgtcctagggtcagtgggcacagcctcctggatcctgcctgactccccctgcccacctggactgagccctccctcctgcttgggcagccaaagcctccctctcctgccctcacctgcagcccaggcctctttgaaggactcaggcttggagaggggccagggaacaaacaataaagcttatggagtggaggcttctaccagagccactctgggccattgttccttgagcactttctatgtgcctggtgcactctgggtgtcagggccctctgtcgattcccaccacactcctccctgggaccctcagggccctgcacagtctggcctcacttccaggactcttgctccctccccggggccacgctcctgcttgccttgctgtgcttccaacagatcaggcccactcctacctcagggcctttgcacatgctgctatctctgcctggaatgttctttcccagatctctgcacggcccctcccttaccgctttcatgtcttgcccagatgccaccctctctccaggacctcccctgattcccctgtgggacactgcagcctccctttcccccatgttccttttcctgctttatttttctctgtagaacttaatgctatctgccacaatatattttatttgctgatcttgtttactgtctatctttcccttggaataggatctcctctttttggacctattctaccacagctgtgtccccagtgcctaagcggtaggcaggagatggcaggcgcccagtaaacacagagagtgaatgggctgct

SEQ ID NO: 85681 - DNA, 1038 bp, Homo sapiens
cacgcaggtggactgcacacacccatgtgtgcccatgcaggagctccctggtcataccccacacttctctggtacccgaggccctgcccagtgcctcctctggccactggagccttctgcatgtgcagccgagggaatgaatgcgtcctcccctgcctggcagcccccgtggccagcagcatcccgaggccaggccagacctctacggcccccactgcccacagcatgctgggccatccctccaatgggcttccttgctggggataactctgaggcgtgttctatgcccaggaggctggagcccaggtatcctcagcggtgacctgctcatctatgcagtcatttttggctgccgtcctgtccccatctcatgtccccactcccttcctggtgcttcccgctgtcacctgcaaagtaaactccctactcccaaatccttgactcaagatctgtttctggggaaaggactagaatagaacacacccttatcctaggtcgtgtatcggtgtacacatgtgacatgttgccagcaaagatgcgtttacagagctgtggtgtgagagcaggcatgtgctagcatgtatcatgtgtgtggtgtgcatagcacatagcactgtatgctggacctgttctgggtactgtgcatagactaacatctgctggaccagggaggcagaatgattaggcccattccacagatgtggaaactgaggcaaggatgaatccataaatgtgtgccttaggggtggagccctggcaggagctgggacccaccctaggaggtgagaatttgtgcaccccctcagcattgctgcactacccaccccaagccctgcagatgctggcaggaggctggaggtggaagcggctgcattcatcttcagaccccatggagcgaagctgccgtcccccatgcctgcttctggccttgcaccccagcgactgtgtgcatgcgcccttcccaggatgcctggcccccagatgctggccgatcatgtggcctttgggctctggattccctctctgagcttatttctt

SEQ ID NO: 85682 - DNA, 1045 bp, Homo sapiens
tgcctctacagtcagcaggaaaggcttctccaggtcacgggcaggcactgggatgtaagtgtccacagcatccagtagcttctgcacagacttcagacctaactcagggtcccgaccctcaagggcagacagtagagcctacaatgactggggtctcctcccctttatagccaaactcagtgaacagctcctgaatctccagttccaccagctccaccatctcagagtcctggacagcatcagccttgttcacatacaccaccacatgctccaccccaatctatttggccagtaataagtgctctcgggtctagggcatggggctgtcattggctgctaccaccaggaggcagccgtcaaggggtgtggtgcccgtgatcatatacttaacataatctgcatgacccgggctgtctgtgtgggcatagtggtgggcgacagtgctatactccacatgagccacactgatggtgatacctggagcttgctcctctgggggcattgtcaatctccttgtacttcttgaacttagccccacctccctcggctagaatctttgtgatagctgcaatcagtttggtcttgccatggtccacatggccgatggtacccacattcacatgtggcttctcacacacgttaagtcttcttggcccccacagccaggccgtggcacaagagaggcaatgccagggctttcagcagcagcagcagaccctgcagcaggaaggtccggccggcagcgagaccgctgaagtgaggcgtcgcgcgcagcaaggtggcagccgccattgtggtcatactctcacccccggaaccaagaaatggggaccaggagcccgagcgtgcagcagaggaagggcgcttgtaggtggaaacaacattcaacttcttaatgacaactatttcctgtttttttttcattcctgtttcatcaattatggatgatgtaatattatcacaatagtaaataccagttacaattaacaaaccggtttgggagcaaggctgactcttggtgagccagcaactcctctggttggag

SEQ ID NO: 85683 - DNA, 1182 bp, Homo sapiens
tgctggctcaggtctgaacaatcgcagctggacaggtggtgcacaacgatgttaattttcatcctgtctttttcatcagtgcatccttcagttccctattacttgtgggctggggagttggccaaattgagtgaaaacctgaaatgtctttttgttcttttggttcagccagtttaagttccatgcaatctttaagctaggaggctaataataatacaattctctgcttgcccttttcaaagccacttcagcttataaactccatattagaccatccaggcccagaagacgccaccggcctacaggcagagtcagcggaaccagcctgggctggatctccccctgcgaggcccccaggcaacgcccgcgccgggccggggagatcacgtcccgtgcgtcgggaggcgggggcctcgggctgtgacgtcacgtggccgcgcccctgccgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggtgaggattgggaccgtgggtgggcgcatgagggccgaggagaggcagggactccccggaggaggtttgggaggaagcgactccaagtctgagggaagagctccagtgcgccagggccagcccactagcgaggaggaggaagccgcctcggtgggagttggctgaggggtaaacggcaccgacgtggatgcagcacctactgtgctccctcgcggttgctgtgtggctggggcgggcaaggaccccggtttcttcgtcggaggtccgcgcagggctcttgtcctgggagttcttggctcagggcatgactgtcgagtggacagggaagggccactcagggactttaggtttacaatggggaaaagtaaacttgtg

SEQ ID NO: 85684 - DNA, 1059 bp, Homo sapiens
gatcgcccacctctgcctcccaaagtgctaggattacgggcgtgagccaccccgcccagatttccggttttgttttctaagagatggatagagatggatagcatacctacataaagtagaaccatccactaagtgttcccccactagccccctgatttctcttttcttttctttctttttttttttcatatttaggtctcagtgttatttcctggatacgttataaaaacttactagctaagtgccagatatctagaagaacttttgctttttctgagctttttttaaccccagtttttttctttgtttctttttttgaattatcatttggatacaaggttgaacatttctctgcgtagctttttaaatctatgaataaggatttactttttttcttttcttgggtgttaattaaaagccaagccaagtttagtttctcaaggacatacggagagtagaggcaagatttccatgaatgattaaataattctgtgatactactgccttgagctactgccctttttcacaaggcactgccacagatcatccctttctggttatgaaattttggggaggaatgtaaagaaggagctaaatctggtttgcttggttcagcagtgactcagatggtatgttactgttttacagatattaataatgtagtgttgtatcttacggctgatttcccatggcagcctttcccttaataaggtcattaaatcatacatttctgttgctaacattaaacagttacagataatgtaataaaggtttaacttaaaaattttttttcaaagcactttattacaaactttgtgctaggtttataaaattgtaccagtatttaatctgagcacttaaatcattttattaaagtgccaaaggcaatttgatatacctgttatccagcaaagaaacacaaggcaattattagtaaattttaacagattaatgcatttatttggtaggttttataatggctctatttcttgagtttgtatatatttgagaattatgttataaatatgttattatttcattgtctttgctatctatttg

SEQ ID NO: 85685 - DNA, 1047 bp, Homo sapiens
gatgagaacgtaatacaatgcaaaagttaggacttttgtaattgttaggtctaattggtcattacattattattgaccagttttttttacggaaactttcttaaaaactcttgcattgggaaattttagggaaatcactttatcaaaacttggagatagtcattatcgttaaggggtcttcatatactgcataccccccgttagaggatggaatgcagaactcactataccctgtctgcatagaagagggaagaaactcaatcccaaagtaatatggaagcagtctcacatgtattgttggttatatatgatatccagtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaacttgtaagactgttacttttctgtattttgtatctgtttgtggaatttaccattttctctcagtgtagggtaataaaaacattttgatatttaagttttactttatagatgatgtcgtgagttttaatcatgggctgaatatatttattggaaattttgtgtaaagaattctttgggccgggcgcggcggctcaggcctataatcccagcactttgggaggccaaggcaggcagatcacttgaggtcaggagtttgatacccgcctggccaacatggtgaaaccccatctctactgaaaatacaagaactagctgggcgtggtgtggcacacctgtagtcccagctactcgggaggctgaggcagaagaattgcttgaacccaggagccggaggttgtagtgagtcgagatagcaccactgcactccagcctgggtgacagagccaaataatgtctcaaaaaaaaaaaaaaaaaaagaattgtctggtgttatttatacattaagtttttctgtatgttaaaagtcagattgtgtctaacaa

SEQ ID NO: 85686 - DNA, 1053 bp, Homo sapiens
tttgaggagcttaacattcctaggccagggaaataacaagcaaagaaataatttgattttatattttaaagttcatgcctgtaattccagcactttgggaggccaaagctgggggatcacttgagcccaggagttttagaccagcctgggcaacatagtgagactccatctctccaaaaaaaaaaaaaaaaaaaaaaaaaaaaaggccagccgtggtgacttgtaactgtagttccaactatttcggaggctgaggtagggggattgcttgaacccaggaggtcgaggctgtagtgagccaagattacgccattgcactccagcctgagtgacagagtgagaccctgtctcaagaaaaataagaacaaaacaaaaatatattaatactgtcttttttttcccttttctatcatatttaggaaaactcctccttaacttggtagatcatactgaagtggtcagagatttaacttttgctccagatggaagcttgatcctggtgtcagcttcaagagacaaaactctcagagtatgggacctgaaagatgatggtatgtcttttttccaagctatgaactaggatttgtttcttgatactactatggagaggtattgggaacatgtggggcatttgactttaaaaatgacatgtgatcaaagttccttttctctgccttaacacttaggttcctttcctgaatagatcaaagaaaaacataaatgtgacccagaataggagccaacagttattcgaagtaaatgatctgatattattcagaaactaaccacataaatctgtatcaactatctgaggaccaaatatggatcaggtttgggattttacaggaaccagtctgtgtttatgtcctcttagggagggttattaacttactgtattggctgagtgaaaatttaggtaggtcttgaagtaacttagtatctaataaaatttaaattgaaacatgacctacataccagaacttataacatgtgaatattagtaaacgttaaattggctaggttaagaagtgcttttataaaaagtgaaagatt

SEQ ID NO: 85687 - DNA, 4236 bp, Homo sapiens
cgctcactgcagcctctgcctcccaggttcaagtaattcttgtgcctcagcctcccaagtagctaggattaccggcatgcgccaccatgcccggctgattttttaatgttttttagtagagatgggtttcaccctgttggccaggattgtctcaaattcctggcctcaagcagtccacctgcctcagcctctcaaagtgctggaattacagacaagagccaccgcgccaggccccagactttttcttgaagggctagatgttgaatatttgaggcttgtgaaccatgctgtctgctgtagagcacaacataaacacatggacaggattgtgttccagtaaaatttaaaacctaagcagctggtgtatatcggtaacccttgttatagataaattgctttcagctataaatgtttgtgatcctttgctttactgctgttttgaaatactgctcatttgaagtggattctagggttaatacagattatttctttttgttcaggaaacatgatgaaagtattgagggggcatcagaattgggtgtacagctgtgcattctctcctgactcttctatgctgtgttcagtcggagccagtaaagcagtacgtgtcaaagttcttgtacattcattatgaattggattatgataatgtgtgcataatcattttaaatctaagtaacctatgaagtctgtgctcggtgtcatgaatattttaaatgttttatttcatgatgggggagaatttgcatgaaggaaattaaatatagttattgattgccaagtgagaagttggattgtttttagagataatagataataatgggcatatcagggttttttttttttgtaagtctagaaaagtttatgtgctgtagaagagatctagtctatatgttaagacattcccttgctaattattttcttctctgttgttctatttttttggtccagtttgctgtttttaaagttttgagtcccagctggtcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggtgggtacagcatgaattattttagtctataattcatctccacctatcaagttatgtgaataattacaatcaccaatatatgcaacctaaaattacagtctattctaatttaaaatgttggtattatttaagcccttgactaatggaaagccttcgatataaattctaaaagtaaatttggctctcttgatacaagtcttgctacttaacagtacccagctctctatagaagtactaattatgtttagagtttttgttggagaaaaacagttaaaaccaaagttggacttaatcttactgtcttaaatcataaaagattttttttttttttgacagagtcttgctctgtcgccaggctggagtgcagtggcgcaatctcagctcactgcaacctccacctcctgggttcaagcagttctcctgcctcagcctcctgagtagctgggcttacaggcacctgcaaccacccctggctaatttttgtatttttagtagagatggggtttcaccatgttggtcaggctggtctcaatctcttgatctcgtgatccacctgccttaacctcccaaagtgctgggattacaggcatgagccactgcgcccgaccataaaagattagttcttttcaggtgactttaatttggatgtatcatctctactgagtcttctcagttatattaattaaggctactttaaacactattcaaagacagatgtactttgtacctgggtaattttgttttcttgaagtgactgatatccactgaaaacatatatttgacctcaggcacctgtttcccccacctactccaatatttgctggaggagcaaatgaccggtgggtacgatctgtatcttttagccatgatggactgcatgttgcaagccttgctgatgataagtaagtatgtgcattatagcttgactgacttactattaccttttacattcttaagccttaaagcctttctgcagttaagagttttaatgtctcttcctcaacacaagcccctgggagattttgttgtgtcttaaagaatatcggcctgaacaattatctgtgtaaactaaagataatgcatgcctctccctgtgttccttgtttaacttgtttaggcatagtgggttgatttttagtcagcttttagcccagcttacagagattttttaaagtaatgtcttaacaaaggttgaagcagaaggaaatttctaaagtgaaacaaatagtaaaaccaaaagaatta

SEQ ID NO: 85688 - DNA, 1962 bp, Homo sapiens
tttaagggggcttttagcagctagtaatttattgtcagtaaaactctaataagtgttcttcatagtagtgttaccttgtcatggaatacatcattggttagttcttcctggttgggttttaatgtgaagtttgtgactccactactcacatgtattgggtgatagttgtttgagctgtagcaacactgaaatacatatacttgggtgactaagcatgtgctttgtttctgtttaggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaacagtatattgcaaatgtttcttaaataggttaggtggagtactttctctctgtctccattgtaaggttgatggtacaccacaggcaaattaagcaaaaaggacaatgaagaaagaatgcaggactcaggcgctgctctagaattcattcagggctccccgagtgcagcagctcttatggtggttttgtttttaggagaactgttgtaataatgcatattttaaaagcatagggaagctctagaacacaggaaggtgactactaagcaagagaaaagtatcttttagtggggaactaccagcctat

SEQ ID NO: 85689 - DNA, 1582 bp, Homo sapiens
aggcacgtagacacatgaaagagaacagggaagggaattacagggcaggtggaaagtgagcttgctagggagagggcaaggtgggggaaccacagttactgacttgccagctctactgggcactgttctgagtggggaaatagttttatcataggtatttgtgcaaggtattatatgaaatctttaaaatggcactggaaggggtaggtattatcccaacctataaatgcacaagtcggggctttaagtgtttaagtaacatacgtgaggtcacatagaaagttgtgagctggaacctggcatggtgactcatggcttgcaatcccagcacttggggagatggagacagcaggatcgcttgagcccagtagtgggcaaaaaagtgagactctgtatctaaaaataaagttgtaagctgggactgatgctaccattaccctgaaatatgtttgtttgttcaaagaatttggatgatcaatagacaagttttgtgtcccagaggaataaggaaatgagaaagttgaaagtgctgaagaaaaaagcccatgcgcttcaccgtgagatttgggctagctaggaaagggaagcaggaagcaagagagcggctgataaattgggaggagatgtgagaagttcaagagtctggacatcttaaatgagatacatgcattagaagaaaaaaagagaaaacaacaacaacaaaaaagagtctggatgtcttgatgagttcctaagtagaaatgacagagaagaggaactgaaaaaggaagtcatgggccaagagtggagtattacaatttcagacttctagtatggagcagcacagttacgggtgtggacaagtgaatgtcttggagtagaaggcaaagaacatttttgcatggaacatggccacaccataccttggtgtgatctcaggtattggataggttggctgtagatactcagtgaatttggaagaagggcctagagatctatcgatgatagaaactgagaaacagaatgtagaatatcagcttgtgaagaggaagggtttggagtgacaggagagcagtcattgagtatgtgaggagctaggagaacatgggaatcttcattctcctagagcaggctctatttgaaaagccatcagggaggtagtttattcagaaaatagttttgcttagctaagataaggatgtgattatggaagaaatgtgagagaatgttttatagtagaaaggaggttccaggggaatgagaggaacctagaaagtttcaacagtagtgtcatgagttaatagaaaacaggaagcaagctgggtatgtgcgtttagaggtggtgtacattttcagcattataaatggatagagatgagtggcaatagttactttggtccataggtttttggtgtcttaactagttatggatctctaccactaaaggaattgcctgttgaacgttgttaggataagagtactgaaggcaaactgcctgggtttgaattttattctgttcctttcgacctttctgggttcaaatcctagctctgcgtattaagttcttttaagctgatgatctttgagcaaatgtcttagcttc

SEQ ID NO: 85690 - DNA, 1100 bp, Homo sapiens
ctcaatttctcctcccccaaaccctccccccgccccttattgctaattgcctctgccagctgtcataaggccctctgtgatcgcggtaattattacaagaccaatccttcctccaggcatgccacaaagccgaatccttgtttgattccaaatgctcgggggtgactctccctcagttttattttcttaaaagctataaaaccacaggacattggaagaatacagtcagtgctgggtattattattttttattacagttggctaaagctgtactgaccaaggctttgcttaaaaaacaaacaaaaccccctacaactggcctttctgcatgcatgctgcagttttccaagtattgagagaaactgattttttgaacacagctgagtgtgtttgctcagcaaagttcagtttttaagctgacaacaatagggggcctgtgaggctcagttccgggaggaggggtcgctgtctggcagagtgtgcgtggttggacttcggtgttgctgggcttggagaatgctctctgtgttggcctctgtgggattgtccccacgttgctctgaagtgctcctggcttccagagtgtgtatataggagaaccacttgctgtgcattctctggaatggccttttgtcctaccctaacttccggagtccctcattttgatggcagtgtggcgttcatgacaccccagagcatccagctatttaagtgttggagctggtttattcagtggcttccctcctgagtgtttgtttagacgatcatccctggcagcagagaacccatccaaaggcccacaggggatctgcagctccctgttcttcccaccgtgatgtggattcgggttcactccacttcctgaaaaggcagggcctgggttgttttgggggatgggaatttagacccctggagtgagttccatggggctgccaccagctagtttagatgagtcacttcatcccggaggcctcagcctcctcacctgcaaaacaaggaggctggagtggatctctgagggctctggaagctcgaaattctctaggttagagaaggagacttggttgggtgaaatcaaatgtttgtgattgtttttatac

SEQ ID NO: 85691 - DNA, 1053 bp, Homo sapiens
cagctgactcatctctgtactgaggtgtgtagggacttgggaaatgtgtcttgatttgcacggaactgtgctctgtgctgtcagccttcaccgtggtaactgaaactcagttctctgatgtaaagcctggcagtcccggcctgcttgggggcacctggacccctgccagggaaggggtcctcagacttgaggttgccagctcagatgtggggctgctgatactaggtatgagtgtctaggctcccagttatgggaaacaagaccaagagacagccatgggaaacccccttcttactgagctgcctgccctgaccctttctcccctgactgcggactctgatttgtggctctggttgggaatgtagatttggggacattgtgctcctcatgggtttcttcccgtaggatggggcaaagaaggggttatgagattgagcagatgcttctgggagtctagagtgtactcacatagcgaggtgtggacctcatgagagtgcctggaaatagcctggtggaagatgttggcaccatttcgtttggaggaggctgaatgactcataagccccggggggctctgatgtcattgaattaggggcctcctttgaccagggttaaccagcaccttgggttccttgcatgtaagcttgttgctattaaataaatgggaagtgggctgggccccgtggctcatgcctgtaatcccagcactttgggaggccgaggtgggccgattacctgaggtcaggtgaccagcctggccaacatggtcaaaccccgtctctactaaaagtacaaaaattagccgggcatggcggtgggtgcctgtaatcccagctactcaggaggctgaggcaggagaattgcttgaacctgggagacggaggttgcagtgagctgagatcatgtcactgcactctagcctaggcaacagagcgagactccatctcaaaatgaaaataaaaaaaaaatggaatggaaggccagaatcctgggaatgtatcagtaataactcagggccctatcccttcctcccacagttatggctaatgtgaa

SEQ ID NO: 85692 - DNA, 1050 bp, Homo sapiens
gtctggcaggatttgttatcttagcacccagcttgtcaaagccgtagtgctacttgttatagcaaacaggcccctgtcaccctgtggctgcaagccaggcaatgcttatgttccaaaagtcagacctgctgttcttactataaagctctgctggaccatgggtggcttctatctttggatgtaaggatgggaggatgagcagcacctcatgctgtgtaagagcacaggttctggtggttgacagcctggattcaggctgcactgcctttctggctagctgtgtgtctttgggcaagttgcttaccctttctgagcaatagtttcctcatctgtgaaatggggattataatggggtcgtttttcatagtaagtaagatgagccatggaaaagcacaatgccttgtgcagaatgagaatatttttatattataatattactatttattttatcgacaagtgtttaattagcacccattagggactgggcactattcttagctctggggaaaatagcagtgaacaaaatggacacaaatgtagaccttgtggaacttacgcttcagtgttgggaggagacattcagatgacaagtaaatatcacctggaatcccagttacttgggaggctggggcagaaggatcacctgagccagagttcaagaccagcctgggcaacatagcaagattcccatccctaaaaataccacacacacactaaggaaaatgtgttatctgttaagtggtaaaagtgctgtggagaaaatgaaagcagggaggggtgcctagatggtggtataatttaaagtgaggggtcaggatgggtttgcagaggaggtgatatttgagtaaagacctcaaaagggtagagaagggctccatggggatacagctggaaaagagctttggaagctgagctcatgtggaagccaaaggggagtgaaccagggttgttggaaaaccctggggccaggggtgaggccacaaggggccctgggcatgacatttagggaggtgcttgctttccagtacccactgcactcacgggtctctg

SEQ ID NO: 85693 - DNA, 1039 bp, Homo sapiens
gtcatcacacacacagatgtcagtgacagaggctgggtaagaacatgagcatattcatactgttacatcgaggaaaaatacacagtatttaagattgcatgtatgtggcatttgtagtcctgtaaatatgtgatgatatgtatgcatatggggaaaactagaggtgaaattgaaatgagttatttgtggtgggactgtttttcttttgcaaaaattcctttattattgctataattgcattccttcatttattaaagtaatgaatatttgagcacctcctagctatcaggctctgagaaggtgcttgggtagagcagtggactggactgcacggctcctgccccggggggaccatgctcagtgagcgattcttgagcccccaccccttctcagcgctcaaggattgaaggctaatgaagtggtgcaaaattcaaactttctggaataaaacggagagttggtcctccaggttctctgcagggcgcttgttgagccagtcccagattctgctgagaaacagggaagtttccagagttgccaccccctcctgagggtagagaactcaggggtagagctggcttggcaccaaaagggctccctgagtcttggctgctgggacttgagcagtgctggggcgctgccggtgagctgtgatcccatcttctcagggagcgcccctgcctgtttgactgtggtgccgttggtatgagaggttgccccaggaaggagaccgcagctgtgggctcatctcctgggtgcccaacactcacagggtccacattgcccgtgatgtgccctgggaagcccatggttgactcagaaggactgaaatgttagacagccacagatggtcccactgcccccactctgagaaaagccctctggctgtttggatgagggtggtggcgatgaggacatttgtaactgcagcacacatgtaaggcctgctgtctatgttctgggctctcagatagcactgggaatactgtaccccaccagtcccctccatgacaggaaaggggtcccgatccagacccca

SEQ ID NO: 85694 - DNA, 1390 bp, Homo sapiens
ataaatgaaataagtggagggaaagtgaaggaaatgcatacagttgttaaaggtgagtggtttgtccaccatcagtggatagtggcctaatacttaacttattttccttttttctttcccaatttttcaataaacctacatgtctcgtgttggggggaaaatcatgtcatccacaaaaaaatattttggctggattttcagtacttcaaaatgtgacagacatttctcccatgttatttttgtgcccactgccaagttttaaccatttcattgcgcaggccttgtccctggcttaatgtggttatctgctcatgtgatgtggtttgagtctacaggtaaaaaaatagattttttttttcaagtgtgtgaactaggaacttgagaatgatgagggagaaaatggaaaattcacatagcaactcatcaacaggttttttgaagtgaaattatgtgctcttaaaaataatctaaaaccaggaaagagcacgttagagcctatcagctcagttgtgaggtagaaatcacagacccagctgggcacagtggctcacgcctgtaatcccagcactttgggaggccaagacgggtggatcacctgaggtcgggagttcgagaccagcctgatcaacgtggagaaaccctgtctctattaaaaatacacaatttgctgggcatggtggcgcatgcctgtaatcccagctactcaggaggctgaggcaggagaatcgcttgaacgtgggaggcggaggttgcagtgagctgagattgcgccattgcactccagcctgggcaacaagagcgaaattctcaaaaaaaaaaaaaaaaaaagaaatcacagacccatgcttttcctctgtgactttatgtgtcatttctttcttaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggtgaccccctccaacgtttagtgtccattgtaataatgcgtctacaaaaatagaccttttgaaggaagagataaggaaagctctattttcttcctgcagctctctttgagggcctctggatgggaattcctagatggagaactccctgtgttgcagtggtggagggtggggagctggggatgtgtctctcttgtatctgcagtgccaggtttagaggaggctgacttggggtgtgagaaatatttgctggaagcagacagagagcagtgaggtgccagtgaccttggtcagtcccagtgttggaggctccagt

SEQ ID NO: 85695 - DNA, 1532 bp, Homo sapiens
aactatatcacatacccagtcccactgcctcccagtgtccctggtcagaggcattcataacagcttttagagattttttgtgcatgtgcacccataaatgtgcacatgtgttccagcctttaaaatttttgaattgtgaaatatcatacattcaaaacatatataaagtttaaagaatgataaactgaacacccatgtacccacaactcaggttaagaagtgaaatattcccagtctctagaccccttctgtgttccacaatccttttactgaagtgagaatatgctatttatgctctttttactttttttacttctgtctggctcacatgtcttgttttttttttaatagctgataacatttcctctatctggatgtaccattattagtagtagttttttttaagcaatttcctcttgatagttacttagggtgtttccaatcttttgctgttaccaacaatgctgcaataatttttctggcttccaagaactgacattaattagaatgtgctatgagaagtcctattagctgagcatggtggctcactttgggagcactttgggaggccaagacaggaggattgcttgagtctaggagttagagaccagcctgggcaacatggtgagtccctgtctctattaaaaaataatattaggccaggcgcagtggctcacgcctgtaatcccagcactttgggaggccgaggcaggtggatcatgaggtcaagagatcgagaccattctggccaacatggtgaaaccctgtctctactaaaaacataaaaattagctgggcgtggtggcgcatgcctgcagtcccagctactcgggaggctgaggcaagagaattgcttgaacccgggaggcggaggttgcagtaagccgagaatgtgccactgcactccagcctggcgacagagcaagactccatctcaaaaaaaatttttttttaaaaaatgtcgtgttgtctcagcatctctgacctgtcagtcctttccagagcaatacagaaacatttgcagcacgaaagccctgcatggctctagtctcctaacatgttgatgtcctgtgccactctccctgtacctgggtggtgccagcattcctgtctgatgccatgcctctctggaagcccctgggggccgggcccgtgggagagtgtaggatcctcattggatcctcagctgggtgtctgccatgggcgtgcccacatgcagggtgtggagaagtatgctgatgggaactcagctgcaggcttggctccaagcagagttccttttcttttgattgtgcaacatccctgcgagggatctgggtctgcccttctgcttttcttcatcttcctgcagtggggaatgaggcagggggcctggtttgggggttcaagcccaggccacttgagcttttgagacgaggctccttgtttttctttgcttgctccatctgccactttcccttttctcttctcttttgttctttctccttttctctttcttcatcccctctttagactacaattcctggtaaccc

SEQ ID NO: 85696 - DNA, 2192 bp, Homo sapiens
ggaaatatattccatgcggggagggaaatgggaatgatcttactttatagatgccacttcatagaaagcattggcactgggattgccagcctttcccaaagcagtgtgtgttccttcatcattctgctgatgatgatcatttatggagcaatttactatgtgaggtacatgataaccccagtctcctttaatcctcgtgaaaccctatgaagcaataagggactattattatccacactttatacatataaatgaagaaagtgaggctttgtgaagttgaatgatgttcccaaggtcacccagttagtaaatgctgaagctggagtcctcagtcttagttattaatgtaagcttgcttttcaggacagagagggctttggaggaccaggaagggctccaattctgaggcaaaggctgtgaaacaccggggtcaggcaggaaatcatgcccttgaattctttaacagggcagattttttaagtcagagacattaacgatcagctccgtataatgtttatggcctgtgtgaccctgccccgtggtgctcggtagaccccactgcccatgtgtgcctgatgattccatttctgtcttgcttattgcaagtgaccttgaattacctaaaacccagggaaatgtgttcttaatctgcccttttaacaatgctgattttacccttccaactcagatttaaataacctttccttctgtgttgtcgtgagtgtaaagaagcagcatcatgaaaaagcccagccctaaactctctgtaattatggggtatggtggagagggaggggcactgaaaaggaaataatggggtcgtgagaccattggaaattgcactggttatattcagtagcagagctggagatttttgcctgctgctgggaaaaatttaaaaagcaaaacaacctctgcctcagccttggaggtttagctgttgaatttactccctttaatttgaggcacctgaggctcccattttgtggtgtgattggctggactttccaccacttcttcctctctctggccagagagaaacttggggacgctgaggtggtttgtagcagctgtcatcaatgtccgcctttcatgtccacagtggtttggagcagaggcccagaaatgcttggggagtctctgtgaattcagaagaagtctccttctcccactccgctgtctgacagcaggttaaaaaaaaaaattacaaagagcttccaggaacaaaaagtggagatgattttttttatggcccttaaagacttgaaatttgcaggagaaatgccgtgtggttgcgtaattctatatgtggagtatctggaattattcctggagaggcgggcaagcacccagattagagatgtgtaaagtgcagttttgtcttgcagtccaagcaggtgagcattcaggcctgtgggaaggaaggaagggaacagcaggtggcagtaactgggaagcttgcctctgagtgagattaactagaatgtatttttccgctgcatttaaagagccagtgaaaggggcagatttacccagggtcacgtgcctggtcagtgccttaaatggacccagggtgtcagccccctctgcctcgacttcaacagagttaatgtttccccagagactaatagagggaccgatattagggattccggggacaagtacgaacaggtctttcgatttacatttaaaagcagtagagagcaggaaggagatttctggcatttgtgcagtttaaaaaccaactagacaaaaaatcttgatggagctgtttcccaatcagcctggcagtcctctcagcattgacgtcgtgagaatgaaagcttctctgagagtgccattgggcggtgtcccttccaagttctccaggaagcaaattttggaccctggccgctgactcagtgtggcctgctgggtggctccctgtgcctgggaggcggccctgtcagtgtccctgggctcagcccataagcaagtgccccaggtgatcctgctcccattcagtgactggagaggcagagggaaggggctcccgggcagtgcgggttccaggtgggcacagctggtaagccgggcggctgggcagggctctgcttcaggtgtgcagagtgggtgtgagttctgcacagcacaggaggtggtttctgcccttacccattgggcagggaaggaagcttgagaaatcagacttg

SEQ ID NO: 85697 - DNA, 1048 bp, Homo sapiens
tattcagccttttgtccagtttggtatcgttaactcctgctcaaatcctgcttgtggtcgttggtgcagttcccatctatttctggttgtctttctactgagcacgtggaagcattgcactctcctaccttcttcagttaggtgtggatgtgtgacttgttttgaccagtgaactatgagcagaaagaaacatgacattaaagtggggaaacttttagtgctcatgtgatttgccacattccttcctcctaccctctcgtgctcctagatggtggaggcgccgtcagcctagtcctggtgtaaggaggtgcgggtcggagctcctagtcaactcacgatgaacacgtagtatgaatgagaggtaacctctgttgtttatactactgggatttgggagttgtttgttaccatggcatagcctatgcaatcctgacagatgtactctaagaagaacaaaacaagaagttggcatttggattaggcaggtgggtatctggatactgtggataaaagcccaagcatccagtattttatgggttgtttcctatagtgaagatgttgtgcttggccccgtgggaagtatagagaccctggcaggttgcttcatagaagaaatggaagggagtttaaaagatgagtctctgaggtctggagaggtttaatgacttacccaaacatctgtgaaggcacctgccgggatccagcagctgtgcccagcctggctctgtgaggctggtccgcagtcagccggccattcttacccacctcagtcagtggtttcaactcagttgcaggtctgtgaatatttccagggcaaagtctgtctttaccttcccagggcctctcgcaggctgtggcacagtcacgtttgttgagtgagttgggatatgggggggagaaggcagacagtgagcagtgccatgatggggtgcagctgtggggtttgagggttccggggaaagagatgacctgaggaggccggcagagaccctggagcctgcttgaagggtgggtacagacggggatggggcctgggcagggagaaggg

SEQ ID NO: 85698 - DNA, 1044 bp, Homo sapiens
aacctccacctcccgggttcaagtgattcttctgccttagcctccccagtagctgggattacaggcatgagccaccacgcctggctaatttgtatttttagtagagaaagggtttctccatgttggtcaggctgatctcgaactcccaacctcaggtgatccacctgcgtcagcgtcccaaagtgctgggattacaggtgtgagctactgtgcctggcctttgtttggcttttaatatggctactagaacataccaagtacatctcttggatagtcttattctagagcgtgtagcctggcagctgctgtcctgccctagaaggggctatcttggcttcagaggggagaaatgaaacccatctgggtacctccctaatctcccacgtgcccccagtctcctgctccccaacctgccaccttgattacaaaggagcaagtgccctgggcagtgttcactgtggcagccaccctgctaatacattactctggggtcttgggtcagcaagttaggttactgagggagcttctgttggggtggagtggcttgttagggtggactttggaggcgtggacatgggtttgaatgtgtctaactggacagaggaagccatgagccctgtgtggaatcctggctctgagcagttagaataatggttatcattgactgggtgcctatggcctgccaagccctatgctgggaacttttatcatccctctgaatcctcccactgacctggaaggtgctgtgatgtccattttgcagatgaggatcatcaagggcctaagttgtaacatactagcctggagtcctgctatttgtaagtggcaggagcttgtagtgaagcccctctctgactcaagatcatgctctttgccccacatcactcctctctgggcttattgcctcttctctccaaccctcagtttcctgatgaaaacaaaggggactggacacttgctcacaggaggtgcaggaagggcagggacaaacacaggcttgagattcagcctgtcttcactgggccctctttcctaggtttgggc

SEQ ID NO: 85699 - DNA, 1065 bp, Homo sapiens
aaaccatccctgattagactgggaaggtggcggtgctgccccaccagggctcttcctgaccgtggttatcccagtgacctctggcacgtcacttcacctcaatgagcctcagtttccctcatctctaaaagggagtgttggtggtgataaaacttattcactgaagagttataaggaccgagtgagtagacgtaaaaaggcttggttgccaataaagcatgaggtaccagcatgagtggtcattttgtgtagtttaatggatggtttttagacacgatgaaattggaaagagtgtgggagctagagagaaatctaagtcctaacaccgaagagctgagtggccttagcttaaggtaatttaggtaacttaacctccccaagcctcagtgccatcgtctgtgaaatagggcatttgagaggatttgagtgaggctgcactgccgtccgttcagagcagatgctctcttgctggttcatttttccaaatgcatgggttgggggtatgatgtgcttggcagaagcctaccaagaatgcttatctaatgtcttttaaaagtgtacagataaccatttcctggctcaattctctgcagcaaatgcactttgatcctcctctgagcatcccgcattgcctgccaggcacccttctgagccagagttatcttggtatggagcgccgtaccacccaggagccatgtagcatgttccccattccttgattctcacaactgtcttgagagcagggagaaagctattatccccatctgagaagacagagtctcagaaggtggggatgagcctgcctgtgcacactgcacacagctcttggaaaaacagtctagaagctctaaaaacaccttttctgtccacttcctctgctgtttacttctttcttaggaaaaaagtgagaagggtgaggagtttcctggctagagattctagtgcatcttgctcctgcagaatgtttggctgtgaagaggtaggccaagaaacgtggggacgcctggctggggctggaacactggcaggcagctgactggactgtcatgacatctcagagccaga

SEQ ID NO: 85700 - DNA, 1028 bp, Homo sapiens
ctggcagggctgggctgtggctccatggctgaggtatctgcatagggagaatgtgtgatttagaggcagcttggtcagcttaggaaatggaggttcctgaggcaaaccttttcagtgcccaagcagggttgcctaggtgagggggctctcagggtcagactcctctgcatcccgtctcaccggcgagaccgttggtgtgatgagctgcaagcatccaggtttgtttgcttcctgccacacgtggcaattcttaaaactagtttttggtgttaggataagcacacccgacaaacatctgctgaagtgtaagcttgctcatcagggagaatactctgattgatgtggactttctaggatagcagagcccaagtggctttgtgcaattgatagtagtcatgtgtatgttaagttagcttgagccgactcttcagggctggagtagaccagatcctgaaccccttatcccctcatcaaggtcctggtgtgtctctagcctttgttttgatgaccccagcaaaattccctgctctttctccctgtagtgacttctttgttgctttctgagctaggttaggtttccatcactaatctgtggagaaaatgtgtatatcccaagccatttcctccttcagaggagcttatgattttggcttggaaaatagagatgaatatactcgaagcatccagggaaggatgaattgctgtacccttgccagtttccagtggaacataaatgtgagcatttcttctctgaagaggaggattccaggcatcctggaggggtgataaagtggcataggattcaggttcaatcaagatgtattgagaatggccaggtgcagtggcttacgcctgtaatcccagcactttgggaggccgaggcaggtggattacctgaggtcacaggagtttgagaccagcctggccaacatagtgaaaccccgtctctactaaaaacaaaaattagctggatgtggtggcgtatgcttgtaatgccagctactcgggaggctgaagcaagagaattg

SEQ ID NO: 85701 - DNA, 1049 bp, Homo sapiens
tgaggctggactcgatggcaggcatgcaggtgagcatccctgagccagtgagtgagcccagtgtgctgtccagcacccacatcccgatgtagctttgtttttctttactcaatgttgaatacacagtacatcccatcagaagtctggaagggtctgtagtattttcagttacacatgattgtattttgtggagggaatgatgtgctttagggacattgccagctttgggtttgtgtgtgaagattgggacatcagtcacccttgtgctatcagggatctactctaattcctagcctctgaaattttcactgacaatccaggtagaggaagtgatatggtaccatacataaggaaaagattgttaacactactaggttgacaaatgagtattgacatgattctgtaactgagggagcctgctactatacatgggaaactggtgtccatgttagcctgtgccttggattcatttactcatttatatgttaacatctgtgacatctgtcacaacagatttaaccccctgccctgcttctgagacatgaagatctgggccactgagagggtcctgtggcagccaacgaccaaagtcagggttagggtgacaacctataataggccttggcatctggctgctaacatagccaagatcatgggtttgagagttgcccacagaagagatctccccatctcaggccctgcaattttagggtggagctgactttgtttgcaaagtcagtcgtctggaaagaggtgttttttgcaaaggtgcaaaaaagcctgggtggggtataatccaaacggcacctgccaaaagtcttcatgctcctccttttcgaggtcattctgcaggctgagcaggagtaacactaacagagttctatttagtgagcactttatatgttctggacattggactaaacactttgcatacatgagtctgcagcaaattctcagcagtgctatggggcatgtattatattttctctgctttacagagaaggagactaagatgatatgatctagatcctgccacacagctgatgtgt

SEQ ID NO: 85702 - DNA, 1023 bp, Homo sapiens
aaagggcctctgatcccaggccctcagctttagcccctgcacatagccctattttgtgcagggcgggactttctcatttgccagtcccctagaagtcaagtgtcacccaaggttaacgcagctttttggctgtggctcaccctcccacgttccatcctgacccacttttccttttgaatgttctttaaacatttaaaaaatttaatgtattcattttgactcaagttctagtgtgggatcttgtggataatactgtttctttttttaaaaagaattaaaattttacaatcacgcattttgtaaaatgttacaaaacatcctgggagtagggaaacccactctgtagaagccttcccatctcctctctacattttgggagtaattgggggacacaccagtgcccaaagctggagtagctgtgtgtgtttctctaatgcaggacacatccggccattttcacacaggagcctggttttagaaatgtgtgttgatgatgcagagaaaggtgacaagatgtgggtgtgcccgcaagcctgtcctgctgactgtgtgctgggggttaggtggggaggtgggaaaggaggaggagccaggcccagggccaccagcaggtggagcccaacagcattgctatgtgtttgggggttgccaaactctggcccttgggccaaatctagcccagcactattttttgtagagccttgtgaactaagaatggtttttacattttgaactggcgggaggaattaaaaacaacagaatatttcgtgacccgtaaaagttacatgaaatttgtttcagtatccatagttaaattttatgggagcacagccacacccatttgtgtacgtgttgtctgtggctctggtggtgccacagcagcagagtggagcagtttcgacagagaccatgtggcccacaaagctgaagagactctgtgtggctttcagaaaaagtttgcctattctcacactatgtattatacctctggatttatagaaggaggaatggggcctttccacg

SEQ ID NO: 85703 - DNA, 1140 bp, Homo sapiens
taaagtgcttgagatcagtgctttttactgtaactgaaggtgatgagcataatggtgtttaaaacaaagactgtagctgttttttttttggattgaacaggactgtcttgaagtcacagtattttggttactccaggcttttctattccctaagccagctccattagggggttgacttggagcatctgtgagtccttagaggaccatccatatggcgttgctcaggtgtgtgcagggcagcagtcagggccctgagaacccgcctcccggaggctccctctgaacagctgagcagcctctgcagtttcacaccggttttttgttgtggttcccctggttactagctctaggatgcacgcagggaattaccccaaaacattgggaagatatggctcttctcccagaagggtccattttcccccgaagatatgtcacagggagggcaaggaaatacatttttattaaagcaaacgtggacacattttggagcagaatgcatgatacactcttaacttttaagcaaaagcatgaggattcagagaggcattttgccttcccatctggggtttggggagaaaccacaccccaactcttactacttccctcatgctttaggtgtgtgtttgcctcctttggaacatttgagcagtgtgggatgggtggaaatgccaggcccctgctggtagtctgcagacacactgtgtccgggggaggccttaccggtagaggcttctaaggttctgatcccccagaaattgtgcacaggatgttgggcacatgtgtgcatttccctgataagaaggcccacggcctctatcagattctccaagtctgtgaggtcccagagatgttgacagcctgtggttcagatgaccttcaaaggcagaagaaagccctagaagaaggtcgagggaggtcttttggctgagcggggagagtctttgtccacacaggcaggagagaggcctttgatagcttcagccactgccacttcctgtctctctttttgcagaaaagagcggggagtgagccgtccatggcggccctggggccaccaatctccctgtagcactttggttccatgctggagtaacctttggttctggtcttcctggacgtgggacttttagcgccaaaact

SEQ ID NO: 85704 - DNA, 1050 bp, Homo sapiens
cccaggtggccctgatgcaccccagtattagagtttattgctaaaaggaacatgccctgtcactcctggtatcctgggagtcatgtttctcttctctctcagttctacttggagcaagagctttcctgggctgcaaatgagaaaacaattcctaggaacccacagcagtactgagcatgctgggagcttgggacttggagatgaatgagccaccgttgctgctccaagtaggactacttggagtgtagctgaggccttggacgcagtatgaccaggggcagctctgccagggctgttggccaatcagtcattttcatttcttgttggaggccaggtcctctgctgaactcatttcctagctagtgttaccctaattctgatgaagatcaatggggctataattcttgtttttgttcctctttgcagcattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactggcactgacggccaggatggcggaaatggccatcccctctgaggaccttgtaggcggtgagggacccatgctgggccagaaggaagacaaacatggtaattgcagctgttcttggggtagggcggggagcccagaaggtctgatctggcctctgctttttggcccaagactccatcagggaaatctatctagggctctccccttgtcctttcaaagggatactgccccttcctcgtc

SEQ ID NO: 85705 - DNA, 1033 bp, Homo sapiens
taaccaccagagccgcagccccctgggtttctgtctaactcgaagtcttgaatcctagctagtttggggttgtgagcagtgtgtagcaaagttgatctctccatgtcaccaaatcaaaacaccctctgtcatcctacggcatttcctcttgaggtcacagagaggaatggcaagccctggaaacctgtgttattctgtgttgatttggtgtggggggagggtggagacgtaaatgtgaagccagttggagtttgtgctatgcagcagtgttagccaggatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggtgttctggggcttgtctttgctttggtcagttccagctgagtcctggggaccatttggatgggtggcatgggaatggataggtctggggtgactgaacccctggtctatagattaaggagctccttccaaaggaagaagttatgccaggacctcagtggcaggtgtttctaaacagatggaggaatggagaaggcacagcgtcaatggcccacaatgcgcagaggaagatcatccaggccccagcagcaacaaagccatgagcaggcccagcatctcctgagctggagatgccttagccttatggaagccttggagggatgaggtggtgttcatctgaatccaatatctaggagcccctcattgccagttatatatacagataggtggagaagaggtactttctaaacaccatctcactttaatcctcacaaggccatgaggtaagaattgtgatgtttcagctgaggaaaatgagaaacggagaggttaa

SEQ ID NO: 85706 - DNA, 1047 bp, Homo sapiens
ggtattcacactggggcagaattatggaggaaacattcagtatgttttggtggaggaagggagtgagtcaggaatgtagactggcgtcttggcccttagatgctggtattagaaggacctagagagttggagtgtgaccatacctccctgtccttctaactcactctccagagtgagttatcactatcctccctccccagccctgtcagcttcctttttcactaaagaagaaagggagtccaggcatgaactagagatttggctgcccagtgcctcctgcttgggtttcaccacctccaagaagcccctgcaggaggcaggtgaggtccagatgatggaggcctgagatttctccagagtcctcctgcccctgttggcttccctcctccacttcgaatctctctgtcttgcagtataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgt

SEQ ID NO: 85707 - DNA, 1044 bp, Homo sapiens
atgaggggcattcagaggtggaatttgataggaattagaaaccagtggcatggggccgggtgtggtggctcacgcctgtaatcctagcactttgggaggccaaggtgggtggatcacctgaggtcgggagtttgagaccagcctgaccaacagggagaaaccccatctctactaaaaatacgaaaattagctgggtgtggtggcatgcacctgtaatcccagctactcaggaggctgaggcaggagaattgcttaaacccaggaggcggaggttgcggtcgagattgcgccattgcactccagcctgggcaacaagagcgaaactctgtctcaaaaaaaaaaaaataaaaaaagaaaagaaaagaaagaaaccagtggcatggggattgaggagaaggaggaacctgggttgactgtgatgattttggtttggttgcctgggaagatggaggagccatcacagaggcagggagccaggatgcagaggccaagatcaagtccaaagggcagggcaagggaggcaagtgttgccaggcccagaggcattgactgcagttttagcaatgatgctgtgaggttcattgccccttaaataatagcaaacctacgctttaaattaaattaaaacatttttagtttagctcttctaagtggacccacacatgtattctctactagttattactgagaatgactaagtattataattgagctgaaaataatctgccgcccatacttgctgggttggttactaagtattgcttgagtttttaagtaatgaaacaaagttgtgctctttccaaatgttaattttgaggactgcagatggtaaccatctgttccgcgactagcattttacaatatttgattactactttatatagtttggggaagcctgccagtggagtctacccatcaggtttgggactttggtggtatgtctcctgtggttgctcctgatggtcttggccacccttgaacgggttcccctctgatttctgggtggtgagtcggactggcatggtcatgattgatagcaggagg

SEQ ID NO: 85708 - DNA, 1474 bp, Homo sapiens
ttgctaggggaggtgagtccggccgcggcggaaccggcggctgaggaggcggcggctgaggagaaggcggccgcggcggctgaggagaaagcggccgcggggacggaagccgggtgggggggagggggggagacggagcagccttgagccctgcggggccgttgcgcgggggacccacccgctctcccccccaaccctcctcagcagaagcagccggcggcgggggcaggagtcagcccgcttccgaccgtaccccgcccgcctcccggggctcctgttctttggccccgggaccctaaccttctcccggggcggttccctccgtctgggcgtccgagcgctgcccacatctttcattcctccctgcacctccttcccttcacttttgccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggc

SEQ ID NO: 85709 - DNA, 4140 bp, Homo sapiens
taatattctgaaacccaaggtaaagatattagtgaggttttttactttttaactgaaacagaatgtatctttttaatttaggaagcaccttatgaattggaaacaacttttttctaaaatgattataatggaacataaaaatgttctcccagtgatgcatcctttgattgaaaccgccatgtaactaactaccggggtattataagattcacttaattcaaacatatattcatttaatgcactttgcaagtattcttctggaatagcatatgacaagaaactgtatttgcccacatttccttggggacatacacccaggggtactaactgatggctaaaaaagtggcatgcaattttgagagagattgttgtttctccatgtagacaaggagagatatttgtagaagtgatgcagcattttaccagatttatcactgaacaatttagtctagctgacttgatttatctttctgttgaatttaactagtggaataacttatcagtattggacagttgtgtaaaagtagtgaattactcattagcttgctggtaaggatggtgctgtgacagttcaattaaggtttcattaacaactgtctgctgtattttatctcaaagtaagagttccagtttacctggtaatgtgattgtgggataacctgagataacatttgttgccactgatagaatgttgtttatgggttatcaagatatcatatacaatttgaccttctttttgagacattacagcctccaaacacccacatggacattttcataatgcaaaaacaaaacacaaagcaacccacaaatagtaacttcagtcatttggtgagtaatataaatctacctttttgtctgcagttcacatttgccagaggaaaatgctgtggttaaagatgtaacaactttgggacaaagagtttcaggggctcataattttgagagatggaggaagttgaccgcatgagagtggtttgaggatcgctgtgcctagaccgtttttgacattggcaacttaacatatcagagatggaattaatggcacatattgccaccttggtaaaagtgagtctgggaaaagacttttttataaaattagcattttggtttgtgacttgcctgattaattaaaagatcaaaaatcctgggattcacttgctctgttgcctttgtgtactccaagtaatgttggaggtctttgaattttattattctaataacttcagcaggttacttttatctgtctttcaaaactgtagtgatagttactagctctgtgatctcgataaattatttgacttctctgttcctcatctataaaatggggataataatagtacttatctcaggattgatgtgaagattaagtgaggtaattcttgtaaaccaatgattacactgtctagcacacagtaagcatcaataaatgttagttgtttttattgtagttattgttggtagaaaaatcaagctgttgtgttaatgtgcatggaagtgtcttcatagattgtcagatttatcaggtgaaatcagcatgcagactatttttggaggcatgactctaaataacgtagcgtgtcccctcagttgtactgtatgtcagggagatttgaaaatggttgaatttaaagccaaggggaaaatactctgtgctgtcctgtcaactaattaaaaacaaataaaaataatacacatttgtatggactttgtaggtgttttagtcagatcatctgcactgttttagaaagtattatggatttatatactgggaaattaattttttcttttcagaatgtaacaaatgaaagacatccttattgtcgaagtagagattcactttgcttatgtttggatgaaaaagtgtgaattgctaaagatcccagtgaggtgggagaaatatagtgatttaacaaaaaaattactcagtataagcccttgtgcatggtagagattgtctagcttgctcatcttgtgaacatgagaggcatctttttttcttatgttttgtctggtcctcttactccacataacaaactaatttggaaaaatgcagaatgcttttgggatatgtttggggaaaatcctggagtaagttgcatcagaaagagtagtatactaaagggtattttgttattaactgtgttttacaggttgagaatctgtagtactgagaagtttctccactatcagccgagattaacagccacagctggattctttgggggctctgctttgtgaaaagagctttgaagaagcagagcctgcaccataaaaaggaaacggttgctcttctagacataacaaagcatccgtatgaaactagaaatgtggaaatctgtattgttaattttaactacaaacgaacttacttttggaaattacaggttcatgatcataaagtagataaagagtagagaataaaagtaacaatctgatgattctgcacccacttcttggtggttgaaactccatagcctataacgttgcaagtcattttgtacttagactcctgaaaagattatccaaattatgttcaaaaaaccacagcacaaaaaataaacttgttttattcttggggagaaatttcatgttatactgtccaatattaatttagaaaaaaagacagtttttttttttaaggcatttcagaaacattgccctttcaagcaagttagaacaatatccctcaacattaaataccatctttttagccatcagtaccactgggcatgtgtcataaaagagaaatgggggcagatatagctccctttcatatgctataccagaacaaaaatttgtaaaatgcataagtgcattaactgaatatgtttgaatttaaattctgggtttttaccttcaaagcacaggcagctgtagatacaaaaagtcctctaatggagtactggaatgtttcattgtcttcacaacttggagtgtcagagttttctctgccttctatattgtaaaactgagtgactattcttggtcgtttttattagatttattgatgtccaagcaatacaagaattaactgttcatatactgtatgtttccttaacatgcttatttggtttctttgatggagattgtcaaggccaaagaaactttttcatttgtcatccaaccaataaatggacagaagctgttagaagctctttaattatgcgtctctttgggttttaattctgagtccctgtgcctctgtgctactccagtgaattatttgttgattgggccatctaatacaggtcaacaataactaaaatagcttgtcagtgtgatcctgatattgcttggaagtaacagagtgtctgaggcaacagttgtaacactgtcagtgagcacataacaagtcatgatagacatagtcagtagttgtaaggtacctagtgcagaaacagaaaaaactggtactctggcattatggaaagatgacttctaagtgaactctactgagattgaactttaactcttagttgtaatggtgtgagtagagggagtatatatggggatgtctgccactcataatgattggtgctctttacctaaacccagttttgaaataatttggctaattgagtcatatctactatgaggcagtgaaagtttttaacacctttggaactcactagtctatatatttttattgtcacttcgctgtggaccagcacttttgcaagcaccaaatggggatatttagtcttataaataattttgcgaacctctattaagctgctgctgctgttgtctgtattgtgcttagtactgaggtatagggatgtttaagtcaccatattgctttggaggagttgacagtcaagtaaacaatatgaacaatgaaacatgcctactctcagggtgtcctcagccttggtggagaggtgaaactaaatttgaaaccattaaataaaaacttaagaatatattattttcaggccaggcatggtgtctcacgcctgtaatcccagcactttgggaggccgaggagcggttcacctgaggtcaggagttcaagaccctcctgaccaacatggtgaaatcccgtctctactaaaaatgcaaaattagctaggtgtggtggcacatgcctataatcccagctacttgggaggctgaggcaggataatcacttgaacg

SEQ ID NO: 85710 - DNA, 1082 bp, Homo sapiens
gatttgtaaatggattattataattcattgccataaatgcagcaatagagatagtccctggacattaagggcgtgtagaggagggatttctatggaaggtcaggatgcttcctaaaataggtaattcttcaatgagttttaagaatgagagtcaaccaatggggaagggcagtctaggtggaagggcctatatgcaggagactacagggctggagatgctgaatgtgcagtgcagtgggtggtaggaagtgtaagctagagctcaatcatgaagaggttggaatgtcatgcttgaggcactaaaaacagctttttattaataaagcatatgtggacatatagcacataaacagttaaatagcatatctgtggtattaagattttacgaggggatgattaggaaaatagcctaaaaaggctccgtaggcgggcaatgatgagaaaaggttaaaactgcgaatggcaactactgaaagtttttaagtaagagagacttcgtcagatttaatttttttttttggatatgtaaaatagaagagtagagagaactgagatctgtctgagtcttagggaatgttctcagttgtaggtggaagaagctactggaagcagaactaaagggcagttaggaaaatgtgttcacaatgattgacaatctaagtatggcagaagattgttaggaaaatgggagtgatctttggtgctgataaaaagtcaaagaaggccggccatggtggttcacacctgtaaacccagcactttgggtagctgaggtgggcatatcacttcagcccaagagttcgagaccagcctggacaacatagtgaaatctcatctccactaaaagtacagaaaaaaaaaattagcctggtgtggtggcacgcacctgtagtcccagctactcaggagtctgaggttgcagtgagctgatatcacaccactgcactccagcccgggcgacagagtcagaacctgtctcaaaaaaaaaaaaaaaaaagtcagaaaattaagatggagaaaaggccaaaaggccattgtatttagcctgatagtaaatagatcattgatggcatttgagagag

SEQ ID NO: 85711 - DNA, 1019 bp, Homo sapiens
tgtcaatgaaggtaagattacttttggagcaatcagatccacttctggacctggagatggagtcagttttaaatgggagggatgaataccagcagtaaatgccaggaatgcagtcattaatgaccaagatactgcatttgtctgacttgtgtcagactcagaagaacttgagtgggtatatttatggaacaaactggaataatgatctctatagagaagtcctgtctgtcctgagttatttggaggcatttttccttttcttttctgaagctttgtttgcctaaagtagcagaaggtaaatttggtacctgatcgttgccatgtttgctttccttcccagttagagcagatatctcctattgatttctctttttatcctctccgtattgtggttttgttatctggataaggttctcagtcttgttttcaatttaagtagtatagagctcagtagtgtcaggcagcagacttcttacaggggaatggacaacacagaaactttttgtttatccattctttgacctaaaattcttgctctgagctacagaaaaaaggtgaaaagagacatttgaacaaatagataaaattagtcatttgacccagattgcagcttttcttcctgtctgcatggataaaaatgatccgtcaatttacataagcaggtgatttttcttacatgctaattttcttaatgtaccatggcagagagttgcagatttgcaaattgtgtaagttaattgaaataagccaggtgactttatttcactgtattatcttaccagtacaaaagtacccaaagggtacaattatcaggtgattgtctcattgcacatctaaattaacatgcagcctggtgcagagggtttttccccactttcttctccacttccctctcttttctaattttttaaaataggaaacttgatttctatatttacttcaatagagctggaaatttagtaatacagatgcggaggaaatttgagctttattaaaagtaatccagaagctataaaaat

SEQ ID NO: 85712 - DNA, 1075 bp, Homo sapiens
ggtttgggtttgaattgcctcagagaattatgtgagcatcttcaaccatgtttaattgattggcttcctctgtgttcattttcccaggttctgcaggttacagtaattggggttatcctgaagttaactgggtgtataccatagccagcgttcaaagtaaatattgacaggcattcttttaaaaacacaagctaattaattataacactgtttaaaacattttaataaaattgaaatttttgaaaggtgcaacagttggttatagggattctttgcagaagatttatgaggacaaataatgtcgaccaacaaagcacctttctttattaagactttcaatattaaacttaataattaatgttacttaatttctcagatgttataatattcacttagtgatatatacagggattaaattatactccttatagctttgaaataatgatttggaaaagaatcataattttaagctagtaaaagttgggccagtcttgtttcagtttaaagaaaaataatttacaggaacttttagaacaaaagcagttaaagaatgacctgaggagaacatttaacatttaaagggatagtatgatttagtagtcaaggctgggcgcattggctcatgcctgttactccagcatttgggaggctgagaccagaggattgcttgagccctgggctttgtagcaagagctcatctctacagaaaataaaaaataaaaattagctgggtgtagtggcacacactttcagtcccagctatttaagaggataactctctttaaatcctagctctgcccctcattatctgtgggtaaattattttatctctatgtacctcatggtcttcatgtatacagcggagatagtaatagtattccagtaattgtagggttgttgtggggatttttttttcttttttttttttttttgagacggattctcgctctgtcaccaggctggagtgcagtggcgtgatcttggctcactgcagcctctgcctctcgggttcaagcaattcttctgcctcatcttcccgagtagctgggactacacgcacacgccaccactccca

SEQ ID NO: 85713 - DNA, 1023 bp, Homo sapiens
aggtgggagcatggcttgaggccaggaggcagaggttgcagtgagctgagattgtgccactgtactctagcttggtcaacagagccagatcctgtctcaaaaaaaaaaaaataaagtactatagttggttcttgccattatgtattaaaagatcccgatttcttcacacactggcggaatttttatgagaggacacttgttattatttattattattattatttagacccaacccgatggtattggttttgttttcttatgtttggattttttatttttttttaagagtgagagctctaatctaaaaatagtatatggtaaccaactatgtccagaaatagtcctttattttgaaaagaaatagtcctttatttatactgttttctataatctacataaagttaagaatgctattgaactgtttagggaaatacccttttctttgcagtactgtgatctatgttagaaaaatagagatccagttaatagaaactgtgtccaaagtcttatctaatatatcaaaacataccaaagtagtctgcgatgctagagtagaaaaaaaagttcaattctaagctctttattctgttttataaacgtatgaataaatggcaatttagtgtatactagagatcctttttcaaattagtgaacaaagaatggtttattccagtggtatggtggcatatgtttaacaacaggctctctgaaaaataaaaaagctgtagtttagggtttgctgatctctgtggtgtaaatactataatggccaatttcaaaccactaatgtgaagtcactaaatgctgaattggagaaagatatgcactagcacgcccttatatggtattttcatcatacagataaaataggtgttagataaccttaagagcataaatcataataaaataactagggagtgatgattcctaagtatttgttacctttgttttaaatatgatttattttattctaagtttatataacatagttttttatggttatgtttcacagtcagcttacaa

SEQ ID NO: 85714 - DNA, 1411 bp, Homo sapiens
tggggttttgttatgttgtccaggctgttctcaaactcttgggatcaagctctccgcccactttggcctcccaaagtgctgggattacaggcataagccatggcgactggcaacatttttagttttaagaagtcatttcttatctttttctctttgttacattgttagtctgataacacagtgagaacatcttaacctcaaataaacactgttgagtactctcaatgttggatacttcagtttatagtttaatatggcatccaagaggaaaaagaatttaaaatcgaggatgatttatatatatacacttttttcatcagtctattcattttctcatctcatttctcggggtttgggtttaaaaaacaatcaattttttgaactgttttgtaaaaagtattcactaaaatttagctctcctgaggggaggtaattttaccatctgatagttcttttatgttttgtctctgtttacataaagttcctaattcctgttctccaaagatactgcttatatagtcaaacttgtagaagttttattccctcaccctcataaaaattcaattagtaatatggaacaccttattcctcactctttattctctggagctttgcgacaaataggaggttagcagaaaagaattgtgacaaaatgagaaaggcttagaagtgcatttggaagctaagaataattaaactgaacgaaatgagacaagagtgttgatttacctgttgaaaaactgcaagccttgacaaaaggtaaaataatgttttatggaaaacctaccaaagtaatgggtctgttctttagccctttgaatagtttaaatagctgtgatttcagttcagtagttgggtgaatgttcaggtttgagatgtcaaaataatctactgaacataaatatacgagtttgcaacacttttagtgataatttttcaggaacatagtaggcttatcaaatttgctgatcagaggaagtcaagaaggatggctaacatagtagttaacaggtattcagagagctgaatttagagtcatctttaagttagcaaactttttttttttttttttttttttttaaagagacaaggtctcactgtcttgaactcctggactcaagtaatcttcccatcttggtctcatgagtaactagggctatgggcatgtaacaccaagcctggctaatttttttattttaaaatattttgtgtagagacgagatctctctgtattgcccaggctgctctcagacttctggcctcaagtgatcctcctgcctcttttcccaaagtgttgggattatataggcttgagccactgcacctggtagttagcagactatttattgaaggcctgtatactaggctttgagtcctgagggtagactgggaacaaaattaatatcatatg

SEQ ID NO: 85715 - DNA, 1851 bp, Homo sapiens
tcctgttgcctgaatttaaatgttttttctatggtgaattacataattatttcgtggccattatatatttgtcctgcagttttttattatttttttacgaaaagagatctaagggcctttaggtgtccattggcaaagctgattttataaatatgtgtttcttttgcctagcatcttttcacatatttgaagatatatagatgggaaaagagcagtaggatgaaaaagggaggtgagaagaattcttcgtagagagcaaaaacaggtgaggaaagcaactagtgtagcggttgggatgacttaacaatagagggaaggcacaggtcagagaagaaggcaagaggaggtgccaacacccgaggttgggaggtggacaccaagctggctcatgatgaaacaagctggcgtatttcacttgtaaatgtttttataatatgcacttttcattttaacatctccaaaattaggatgtttcttacaattgtttgctttttatttttgttagtacataaaataatggcacatttaccattagtggcattttacagttaatgaaatatggtataattttacattgctcacaaggagtattggctgtgttagcctgctagtttacattatgtgatctggcagacaaatcagtttttaaaaacattcagaaacagactcagcattcaggtgatttggacaactgattgatgttattccaaaagaaacctctctctaaggtgattcgtgtgaaactagcaacttctttttgtaaaaggtctgccactggataggctgtgtttgcagttgccacaaattctgaatcaaaggcaagtaatcattaggtggaaatcaaagtaacctttctctacccctgtgatttgaggggctatttccctgaagcatgtgcaaattatttgttaggcaagaacaacttgtatggcaacttcttagcattgcttagacaacatctctgtacagtttgtgcctcaggttcatctctgttttgtattcttgagtctctttggaattttgacacagcaattgagctctcagacttacttattttacaaaattgggcatttgagtaaaaagtgcctcaacttaaaaactgttcttaagttttcttcttttgctttggctactataaagcccagagtcaaatgtgcaccctcctcagttaagggatgtagagtttcttagcttatgttttgggtacagaccactttctcggtcccttcacccccacttcataagcttcctacccattttttcccccttcctcaaacccttattcctcctcttcccgcaccctttaatcttacactgtatgcttctgtcttagctacctcccgtctgttttggaatggggtgggatatagataaaagctaaaaacgtcaacagataaaatctatctttaaaaaacatttacccatacagtgaaaaaagcacattgaaatggtgaagtgaaaagcccagttttgttgtcctttttttgtatatgtcttaaatgaggtgagttgttttgaggaaaggcgaattttgctttgccaacatttgtgatggctttagtgtgttggagctaaaaaggattgtgagctctttcaagttacttctaatttagagacactagatttttaaagaaaaggataattaaaaatttggataactttaaaagatggagttactgtcaaaataccaaagactaggtagcttataaacaacaaaagtttatttctcacaattctggagactaggaagtccaagatcaaagcttctgcagatttggtggctggtgagggcccatttcctggttcatagatgatacattctcaatgtgttctcatctgatggaaagcaga

SEQ ID NO: 85716 - DNA, 1058 bp, Homo sapiens
ctctttctttctttttttttttttttttttttttttggctttgtacttctctttcttagacaaggtacaaacctcctttccctgccttctttccttcccttgtttgccacctgtattagtccgttttcacattgctgataaagacgtgcttgagactgggaagaaaaagaggtttaattggacttgcagttccatgtggcttggaaggcctcagaatcatggtgggaggcgaaaggcacctcttaacatggtggcggcaagagaaaatgaggaagataaaaaagcagaatcccctgataaaaccatcagatctcatgagacttattcactaccacgagaacagtatgggggaaactgccctcatgattcaaattacctcccaccgggtccctcccacaacatgtaggaattatgggagtagaattcaagatgagatttgggtggggacacagccaaaccatatcaccagccctggaggataaaagtcattcctgagaattaattgtcttggaatacttaaattataaacaatttctaaggctattaggcatctgatactatcagttaatgcaaaacattaatctggagataaaattaggcatcttgatcagtttgatgccgagaatgccattatattaaactttgcattaatatggagggaattaataagaaaatgtttggaaactttagcttcttttgccagtggtgtgttataattctttcatactggaaataataaactaactatagattttcatgtttttatagtattaaccttattttaaattcctatcataggtctctctcataagtttcgaagaaagagtaattctttttaacaaatatatagatgcacagaaagttctgcttctttctcaagcatgttatagttataggaaaatatgaaacaattcttaagaggttgttcttccttaaggtatgcatttgttatttcaccaataaaaagaattcataaaaaaaaaagtgctatcgattgaagcttataaatgcctctactcattcaatcagctaaaattatgaaatggtatactgcttta

SEQ ID NO: 85717 - DNA, 1057 bp, Homo sapiens
tcatttgactactttagatacctaaataagtggaatcatgcagtatttgtctttttgtgactagaatatttcacttagcatgacatgctcaatgttcatctatgatgtagcatatgacaggatttccttttttaaggctgaataatattttgttgtatgtatataccgtattttctttatttatccattgatagacagatgtttccatctcttggcttttgtgaatcttgctgtaatgaacagatatgcaaatatctctttgagatcctggcttcaattcttttggatatatgtcaataagtagggttgctgaattatatggtaatcctatttttaagtttttgaagagccttcatactgttttccatagcaactggaccatttatattcgcaccagcagtatacatgggttccattattttcacatttttgccagcacatgttattttattgtattctatttttgatagtggccatcctagcaatacctcattgtggttttcatttgcattttcctgatgattagtgaggttgagcatcttttcatatgcttgttggccatttgtgtatcttctcttttgcccatttttaaaatcaggttattttgttgttgttgagttgtcagagttccttgtatattctaggaagtaaacatatatgatttgcaaatattttttcccattctataggttgccttatcactctgttgattgtttcctttgctgggcaaaagtttttgagtcctgttcatctgtttttgcttttgttgtctgtgcttttggtatcatatccaagaaataattgccaaatccaatatcatgaagcttttccccaatattttcttctaggaactttattgtttcaggtcttatgtttagatcgttaatccattttgagttgatttttgtatgtgatataagctaaggatccaacttcattcttttccatgtggctatctagtttccccaatattattattaacctgcaggtcagcgacttcagatctacaaactgctgaaattatgtgcagtattttgtgcatgtttgtgtgtgtgta

SEQ ID NO: 85718 - DNA, 1545 bp, Homo sapiens
tttgttttgttttgttttgtttccttttgagatagagtctctctctgccacccaggccagagtgcagtggagcgatctcggatcactgtaacctctacctcccaggttcaagtgattctcttgcctcatcctcccgagtagctcggattacaggggcctaccattatgtctggctaatttttttatttttagtagagatggggttttgctatgttggccatgctggccatgctagtctcgaactcctgacctcacatgatccaccctcctcggcctcccaaagtgctgggattacaggcatgagccactgcgcccggcctgaaattcacgttgttttttaagtaactccttaaatagaaatgttccatctgcaacttattaagattggcttcttctgacagacctggccaaagaaaacagctttctgggtaatcttgtgtttcaaaaacattattagctgttaaaaggggggaaaagggagggatgtgtgtgctagcataacataaaactttcatttgagttacctgaattataaggaaatactttggcaaaatgcatctttatatgtcccagcagcctgaatgtgagtttctgctaatatgttcatcccctttttatcagttccctttgtctgaaattggggtgcctccctgcccttgtgaataggaagctgggaaaaagagtaggtggggttaaaagggaagcacagtcccctgtgtttcccgcagattttcttattgcaggatcagtttggattgtgagctgaaactgaagagcagaatttaatgttgacctctaaagttgatgcccaaaagggtttgtcttcactaaagcctgtctttttgaattgagtagagtgcttttggctgtaaaagctttgaaatgtaaacactgaggaaataacatgtttgtaatgtctacgtaatataacatatgcaggtgcacatcttagaattttctcacttatcctaaaagatacctaaatagaaatttaggaggaaatttttagccttaagaattggctatactatgtagtctaatgccaaggtttccactgtggcccttcctaaaaagtattttggttggtcataaaaactgtatgcagaggactgtctatttggaataatagtcacatggtttagaaataagtagagtttaaatttaccttttcccacactgttcttatgataccattccttctgctgcttgacatgtggaaatcagcttgtgcatttgttttcagttatgagcacctgtgaagcagcttgatctgtagaatctaattttatttgtttaattattagatgaaaaattctgggtatcaggatgggtgtctgtcccttttgtatctgtgacagtgcctaacatagcaccttgtaggtgattgataaatatttgttgaatgaataaacatgtatcatccttctttgaaaaatacatgaatttgtggagactttgattactttttaaccaagtatgtttttggaacagagaagagtattatttacattatactgataagatgttgctgttatatcacattca

SEQ ID NO: 85719 - DNA, 1464 bp, Homo sapiens
cccactagatagcagacttccatgagaactgcttgtgcctaccacaaaacaattatgaaaggaatgagccatatcatgatacagctgtgagggctgtgtggaagacccattagcccagtattcaagaagactaaggcccacttgagttaagtatagtgggtttaacgctggactcagaggtagcaacctagcttgcctcctaaattctgcatttaatagttgcgtgactatgaacaccttcttttaactacctatgagtattgtttcctcatctgcaaagtgaaagtaaaagaccctacgttacatggttattgtaaagattaaatgagatagcctttggtgtaaaatggtttaacacatggtaggtagtcaaaaaatgttgcagcacatacttattgataaccttcactggtttattaagatgaaataggtttcttgagttaggaaatactgttttgttaagtgtctaactcaaagtctgaaagctagtgagtgatagaatcaggaacagaaagaacccagcctcctaagtgccaatccaaaaagaggtggtaataggagtaagtcttccaggcttctgaattgcctgggctgtgacttgtcaacggggctgtacattctgtcccactaccttttctttttttttttcgagatggagtcttgctctgtcacccaggctggagtgcggtggcgcaatctcggctcactgcaacctccacctcccaggttcaagtgattctcctgcctcagcctcccgagtagctgagatttcaggcacctgccaccatgcccggctaatttttgtatttttagtagagatggggtttcaccacgttggccaggctggtcttgaactcctaacctcatgatctgcccgctttggccttccaaagtgctgggattacaggcgtgagccaccgcacccagcccctgtccctaccttttctattttttgcagtattgttccatgctgcgcaaaagtttgtgaaaaaacacaaatcagtacatcaaggttcagtatatgactaatctaattttagccattagaatcagctgtacagtgtagtctaatgccaaggtttctattgtggcccttcctaaaaagtgttttggttggtcataaaaactgtatgtagaggactgtttatttgaaataatagtcacatggtttagaaataagcagatggaacagtctatctttatttcaagtgcccaagatttgtgattcatcaggttaggtaaaaattatcacgttttatgccttttgtctccccaccccagcccctggtgacactattctgttagcacatggagtgaataaagtttacatcaaccagcagaaaggaagtttccattatcatcccccaacccagagcattttttggagcattcttcacaaataagtaattaaatttaaacttaaacaagcgaagaaagtacatacagtcatgcactgcataatga

SEQ ID NO: 85720 - DNA, 1050 bp, Homo sapiens
agtgtgagccatttatgtaaattttaaaaacataaaacaaccatatttttatggctacagtcatatgtatcaaaagttaaagtgtgagtatcaaggattcataccagagccagaataatggtaaactgggacagattcagttaaagatgcagtctttggatgcatctgtagtagcattatgtcttaataaaatgtatctgaagcagatgtggtaaacacttttatctgggcaatgagtacacagcgtttaatttctacatttacacacatgtctaaaatatataattatatttatatatatatatatacacacacacatatataaaatcattgatatgaaaaaggtcaatacagttcttatagcttctgttgcttcactttattagatataaaataacccccttccacatagttaacatttcagtaatctaccaaataaaagttattcccagagatgtaagacctgtttctttagaatgtcatgaccagaatttccatagtaatctctaaaacgacactccagtgagacagtctgatctgtgggtcatttcctttcctgttaagagacctttgttaattccattttgcagtatcccagaagaaacattgcaggtgtgcaaccaatccaactgaaacagataatactgggtaatgttcccttcttactcttcctttttattaatgcacttattacccatcttccaaaataaaaagtctttgtcatactggcatctgatttttttttcttttgacaaccagcctgtcttctgtctcctgaattttattttaacatcttttaatatgttgccaggtaggcacccctagttgaacaagaaagacctggaaatcattagagctaacaatatacaggtttttcttaaatgtgctgccaaagggcataacctctttggattggtgacatgtagcacttgcacagcagcttttcttcccatttctaatggtaagaagtaaaatagccttctgtcaggaccaacttttctttggacacatgcttctaatcttaatgcattaagactggtgtgttgctca

SEQ ID NO: 85721 - DNA, 1065 bp, Homo sapiens
aaaaaattctgtgaaatgtgatggtcatcaaagggttccttggaaggtatggtgggaaagctttgtaattgctgcttcacagaacttgagttgagggagagcagtctggtatagtgaaaagaacatacactgtagagtccaaaagactttaatccaatcccagttctgccccttattcttaggacggaagcaatctgacatcaactctcaaactacttgggagttgtacgtaacacgtggcaagttcgttaacttctctgtgcattagtttccctgtttgaaaaatgaagataacaattcttcccatgaaaattgcacaccaaagactcaccatatatttcatttgttcacctcatttatttgtgttttactggactaatggtttctgctattgttaataattaatgaacattgtgtcaggacttattctgttgtcagactgccttaggatatgatctgcattataacattagaatttcaatccaacatctctagaaagagtatgacaaaagattgcaaaaaaatgactattatttaatagggtagcagaaagaagctgtaacatttttactagaatatgattaattcacagatgctgacaaaagccattatattctcatcagatgatacttaataacttgtggacaaataagatgacttgtttttattcatgagagattatattaagctctctagaaaagctgtaattcttcagaacgtcctagaatttactgtatagggaatggttagattcttcaggtttctgagcaaaaacaacccccaaaacaaaaccaaattacccacgtagtttgagagatgatgtcagattgcttttgtcttaagaacctacaagcaagaacacatttcaataaggctgcctttctcttttacacctttgaaattactgccatggatatatttactagtagtgcattattaacccagctatggccacttgccttttgctgaccgagttcaaagcttatgtaccagagaggaaggtagtattgggaggggagttcttgacaaaggagctactgatttgcatttatggtaatacgtaat

SEQ ID NO: 85722 - DNA, 1485 bp, Homo sapiens
ggaggtataagagttggaattcttggattacaaaagttcaacttatattagctaaaaagtgggtatgttgcctcacataaccaggcttcaagatggatagagtagaactagcctttgatagtgcaagacttgaatattgtcaagactcttgtctcctttctctgactttctctgcaaatttgtgtttattttttaaattgttttctccacagggcagaggtagttctcagtccacatatttgcagctcttctttaaccaaagaggaaagggacctgacctagctccagttttcatgatatctaagtcttttttggtggtggagaatgtagtctccttaccagaataaaattagaaggaaaaattgggaagatacaaataattgccacctcaagtggaagtcattactgtgagtgctagaaaaggattgtcctcatggggaaagagaccatgagttatacatggtgctagcaaatgttacatgatactattgttgctgcctttctgtgctagtcctcctgctttatccccatatttcccctctgtagtgcagtaccccctcaagctgggagggtagtcaacttggacagcggcctggaccctagggaagagtttgctgaaaagtctacatggccatgttatcagattcgttccattcctaattcagattaacagcttctacatgtgatggaattgtattactttctaaaaaaaatttcagactgtaactcaacatagttgtggaagaaattcagagcttgtgggaaaagatgcatctctctatccaagtctcacttctagaggcaaggattctactactcaggattgtagtatgattgtacactttaatcttcaaggactttattataaagcaaggtgccaatattattactgatgcagattatcctatgattccagatttctgcaattacaatatatatatttgaaatgattattccattaagcaacccacttgccccttgctgtgacccttgctatggtgtaacttttaatgtttctggttttacaaaagaaaatctgcatcaatccttaaagttacatttaaaatttacattaacagtacaaccagatggcattctgacactcactgtaagtattctaggatttttctaaaatagctggctcaaatagaaaagtcatctttttcccaagtgtgttcctgtccttttctcttgttgtgtgttctaactgttgcacttatattaaaatcataaaaccagaatggagaatttattccaaaagttcccatgcatttctccaatcttacttcctgttgcaaggacccaccatcacaaatgaagtgtaattgtacattcatgatgacgtcttgcttattaaatggtgacattcaagaaattgtcagcacaggcattcttttataggtcaaggatatacttattttgaaaacgttgaaaaataatagtaattatttaactgatttcagaagaatctatttcagtggcatc

SEQ ID NO: 85723 - DNA, 1104 bp, Homo sapiens
ttcttctcaaccaggacagcagcctttgaataacagagctataggctttctctgttcttttctagttgagtttaatgctttgaccccacattgctactgggtgtgggttttttgccctccccttcaaatcatgttagctccctgtgacaacgaagctgctgggttttgtagccagccttgcccaggaactattagatgtactggtgcttgggtagggtgtggcaggggtggggtaagaagctgacccaagctgtgactcccactattcttacacaaatttcagcagttttttgtaaaaacacttaaatttgtcatttgactttggccatttttctggagtcccaaaatggctgtttttgacacttttgtctagttttatagttgttttgaggggaaaggatttgctgacctcttcaatttgccacagctggaagtcctgcctcctgttttgttttgtttttgtaatatttttgggtttgtttatttttaacaggctaattgaaaacctgaagcacatctatatattgtagctgcttcagcattgtgcttcacaacggaagaagttaggagattgtgattagattaggggtggggctgtagtcctaaatttgctgacagcgctttcctgtggaatgcttcctaataatgtattcttgtgtaatgatgaaggaaatgtttgtttttttttaagcaagcagattcctttggaattctacaacataaaaaagacattatagtatactcctctctacagaatgaatttggcacagggagagaagtgacaaagttctttgggctggtatagatgtatatctatatgaaaaataatggaaagactcatccttttaaaaagttactcatccttttaaaaattatacaggtttaagctaaaattttttgtgtgctagaaaattaagctgggcagtttgcctttttaaaaaacctttctaattatttagtaacacacatacacaaaataaaatgtataactcaatggtgtatcacaaagtgcacacctctatgaccaccattcaagtgagatacaggacatcaccagtacccagaagtcccctgtgccctctggatccataccccaagagaagg

SEQ ID NO: 85724 - DNA, 1099 bp, Homo sapiens
ttgccaaatgaccaattggccgtgtatactcaatttattggtatttcttttttctttcttttctttttttttttttttttttttttttgagacagagtctcgttctgttgcccaggctggagtgcagtcaagaaatcttggctaactgcaacctccgcctccaggttcaagcaattcttgtgcctcagcctcccaagtagctgggattacagacatgcaccacgcccggctaaattttgtatttttggtagagacggggtttcaccatgttggccaggctggtctcaaactcctggcctcaggtgatccagtcacctcggcctcccaaagtgctgggattacaggcatgagccactgagcctggcctgacattcttttacctatttagttaatatgtatcaactgggttcagtcagaaaaacagaaaccacactcctatttcaaacatagggaaatataatacaggaaattggttatataggtgttggaaggcaaaaagagaaaaaaaagggagtggggggacacagttattaaaaagatagtaactgcaagaagcaactaccacactaagagctgggaaataaaagggatgaggttatcattactcgggagctacagggatccctaagctggcacccagacttctaaggaggggacagtgttcaactgctgcttatattgaagtccatattactaaaagatgttcatatacataagaaatctaaatatttaaattgtgtttgaacatgtcttccctctcaaatgtagttctgaaaataaagcataaagctaatttgacttttatcaaattaatgatctatgctgcttctgtatgttttttcccatctttaaaatggctttaccactaatacctctcctacctcagatgtataaagtgacctctctgaaagagtaagtgtttatagaaatttagacagggatttttttttttttaaagcatggcagatgagttgggtgaccaaacattctctttaattatagatatgtactcttttatctttctcactgacaccttaagcttcattaagtggacttaatgttgagtgttttaagataaagatattgtcatgatctgaaa

SEQ ID NO: 85725 - DNA, 2923 bp, Homo sapiens
actggatatttgatgatatttttaaacacttacattttagatttgatcattgcaatttttaacctttttttcattagagatactgattatggctgaaataagtttgatatatgcttgagaattatatagggagagtaaagggtagagatgaaataagaatgttcatgtgtgtgaataactgaggccaggtattgattacatgggcattctctatactattctgcccacttttatatgtttgaagttctctgtagtaaaaaaaaaaaaaaaaaaaaaaaaaaaatttaagctacagatcataaaatttgaactagtaccacacaatttatttcctgttaagtagtttcttccatgtcctttgagcttggtatttctcattagcttagcaagacagctgggaggggatttgtttgttatgttttgatggcggaagttacacgggtactatgctgcttttataaaggacttgcgtcgtaaagtcttttttcctcaccctagtgacttcttttcttacaagaatcttggaataaaatcaaaaatgcttagtatgatttaaagagactttgtgtagtgtatttcatgtcttcctcttctactttatgttagtctattttcttcctaccctctatattcaataagcactggcttttctgtctctagaatctgcctcagtgtctttacactgcctgcccatcgatcaaccaactgccactcagccttcaaattctagagtagtgttactttagggaagctttttctctctacccttctttacatttttcctccatagtaatagatgttgtaattacatatctgtaactgtttagtgcttacctcttctgtagtcatgagagcagggatgatgcctattttgttcaacaggataacctaaaagcttagtgcttgccaggtagaatgcacatagtaaagatttgttgaacagaggaataaaggaatgaatgatagatgtggcttctcacgctcttagagtaacattgattgtttaaaatagggtgtttatttcaaaaactctctcctgtgcagggattttggtagcgtgtggtgtaacccaattgcctctctcattttgtaagtcttttggatagtaagtgtacgaatccatcttaatgtttagtactgtgtttcttgacagacgaatttaattttcagtgggcaattgtaactaagctttaaagcattaaagagttgttagtatttacttgcatttatgtcgaattttgtttccttttttgttctctaaatttgactttttttttccttttctcaggtactctctgcccttgacatactccaacctccacacattgactattttgaagaaatgtatcctaaccagggaatgtgaaagaaggggacaatttttaaaattaatttgttcttctagcaccttttggggttcatgccttcaagtattttaaatctcatccttgcagaagtgattgagtacctggaaccaggtaattttgaaatcctgtgtgtctggcagagctcagtattatcaacatatcctgtgtggtgatgccacagaacagaacatctgaacagatatttaatccccacacagccttatgagatagattattaccatccccattttgcagatgaaaccagtgaggcagctgtgttgtagtagaacccaggaaagtgcttttaccactatacaacagctgcctgtcggttaagagagtaatactgccctttattataacacttggggtaagatagaaattgtagaattaatgtaagttaagttgtcttatgttccttagaatgatggtggtggtagtggtgatattgacataatagccattacttatatagtttttatcagatgccgggcacaattctaagctctttacacatgtttatttaatcctacaaacattctctggggaaggtattgtgattattcccatgttacagaagaggaaattgaggcacaaaaggtaagaaaattgaccaagatcacagagctagtaagtgtggggatggagatttggttccaggtattctgactatgtagtcttgctttcagcccttacctatgtgattctcaggctagagcccttaacgttctcctgttactactgttgatgtttaaaaatagtatgttagacattgtgaataataatgaactataaaataatgttaaaataatgcctggtgatagctccatggtaataataaaataatgcatggtagtagctcctgggactgtgcatgaaaaaaattgagacataagttaacctccctgacattcctgggcaaagtgtcaccagtttccattccacatttaacttggtaaagctttaaataaaagacaggaaatcctaagtcattgattttggtaagctcatgatagtgcagtttattcaaactctaggcttttttattaatactttaggcctatgactcagaatggaaaccaatgtaatagtgagatactttttctgattcaccagtgaggtaatgaaaatctcattcttacacagggggttggtaattccatatgagattgttatctttgataacttcctagaaaataggaacaattaagagcttcccaagagaactaagctgggtaaggatttgggaaaccttatatggtaatagaattgtcactgatcaacactgctgggatgttttgatcttttaaaccaaaagctcttgaatgctagtcagccctccatagatgtgaaactgcatccatggatgaaaaatatttgaaaaaaaaataaaaataaaaaaataaaaagtatagtgggcacagtggctcacacctgtaatcccagcactttgggaggctcaggcagggtgggcagatcacttgagcccaggagttgaagaccagcctgggcaacatagcaaggcctcgtctctaccaaaaatacaaaaaaaatta

SEQ ID NO: 85726 - DNA, 1064 bp, Homo sapiens
gcattttgatgtaatcagatgtaaagtaagagtatcggtgtatagtatcatgcagttaatcatgtatttcctaaaagagactgaaactgtaataaaattattatgccagtgctcaccaaaaatttagtgtgggttttgaaacaccatgcatttttagataactccttgaagcaacaaaaaaaaagtcaatatctagactgtaagtttttataaatctgcctacagggttcaacagatgtagggcaagtcagatgtgaaaggagcaataaattctatcatgacctctgtatcttttaactttttgtcttcatagtttttaatctatctaggaaatatattatttaataattttaaagattatatatttttctgagctgatgttagcttttaaaggattacatttttcattttgtactttgagtttctatttggaaatctgtatgcaaacagtttggtacttaattactttgagcctactgaaatttaaatcaagagaaaccagttctaattgtttattagaaaacggagtttattatgcttcagtcaggattctggatgctctacaatgcacattaacaggccccttcccagaaagcactagttacctacagggttggaaataaaaatttggtctgctttgggaaaagcttatttttaacttgaagcataacttagcattctatgaagacgaacatgggtggtgtgagtcttctatgctagaagcaattacattctaaactcagtggaaatgagaagtctagtggagtgtccgtacacgctggtttgttgggacagtcttggattttacttgatgttctggcgcaattattgtgaagttctcactctcagaagtgtcactgtttggatgataggttttgcttgtgcaggcagtgttttaaataggaatctcttgtcataaagacagtgaggaaacctgtgtgtccatttcagccagtaagagtctctagtgctttgaagcagctctgtaaccctcagggaatcttaggagtcattaaaaaactaagaacaatggaaacaaaatgcatatatgcttatgtaagtgt

SEQ ID NO: 85727 - DNA, 1086 bp, Homo sapiens
tctagtagaggatacaatcacataaataatgacaatagtataggttggaaagtatactgatagaaaagaactggccaggcacagtggcccatgcctgtaatcccagcacttggggaggccgaggtgggtggatcacctgaggtcaggagctcgagacctgtctggccaacatggcgaaaccccgtctctactaaaaatacaaaaattagccgggtttggtggcacgtgccagtaatcccagctactcaagaggctgaggcgggagaatctcttgaacccaggaggtgaagattgcagtgatcgtgccactgcacttcagcctgggtgacagagagagactccatctccccaccaaaaaaaacaaaagaaccaaggtatcctgagagcactgaggggttctgatttttactctttcccattttagtttcctactgaattactagaaaattcatttgatgatttaaaacaaaaacaaaaactttcacttacccactatcactgatcctttctccttatctctgaagcctagaacagaaatttaaagaaaggaaaaaccaaagaaaggttgatagaacaatccaggaacagataaattcctgacttaaccaccatttttgtcagtatctggttagccttgcttattcattcagccaaacctttagcactactatgtatatgacattgtactaacctctgggatgaatacaaagatgcattgttcatttatttaatttttttaaaaatgtaatatgtgagaccctatcctaaattactttattcatatctccaatttatagatgaagaaactatagctcagagaggtaaataacttgtccaacgtcacttagaaataacagagctgtgatttgaacccatattgtatagtccaatgggccaggagtgctctcaacccaccatgctctgctgcctcttaatgctttccctgaaggaagatactacaatcaatggggcagagatgagctgtaaagggataactaacatgtggtagaatgtgccaaaagaatatagtgaggtagtgtgggactttaaaaggagagattacttcaggcagaaaaaaacgataag

SEQ ID NO: 85728 - DNA, 1256 bp, Homo sapiens
ttttttctggtgattggattgatttttttttagtcagttttaaattacaactgaggtagttttaatttttgacattctatacaacaaatttgttactttacaaagaaaaagaatctgcctttgcctgggaaagagattgtcgtattcaaacgttttaacaacatgaccttttattccattgatttctatagagaagcacaggcatgcttcagaaaaggtcagtgattctaattgaagcacaccgatttttttctagttgcaaaggctcccatgctttttgttgcaaagaagatgatgagatttacggctgaccatttgttacaagagaacacaatgctctctgtgacacattgctgtttttctttcatgtggaaagcattgtttgaaatcaaccatatctgtaaaccagattgtcattatccacgctattcaatgccctcacttttatttcagatcagccagtttcatatctgagtactaggctgaaacttccttcccctgtgcacctgattttggaagaaaaaaaaaacgagcaggagattttattaagtctcacacatttatggctgtagattcttttttcagacaggaatggcaggatttcagaatttgtgcttaaggtgcctaagcatgttagtgtttaaagtgcttaactgtgttattgcttaagcatgttttaactgtcattcatatacttgtcataagagaatctgtggcttgagggggccaggcttgggcatctatgtactacagtttattaaaccaaatttactatgtcttttggaaaagtcacctgactcatatttgttccaatatatgtcacattgaagatgaaaacttttttttttttttttttgagacagattctcactctgtcacccagggagaagtacaatggcatgatcttggctcactgcaacctccacctcctgggttccagcaattctcctgcctcaacctcctgagtaactgggactacaggcacatgccagcacaccaggctaatttttgtatttttaatagatacaggatttcaccatgttggccaggatggtctcgctctcctgacctcatgatccgcccgcctcggcctcccaaagtgctggaattacagccatgagccaccatgcccagccaaagatgaaaacttttaaaaaaggattgtagaacctttgaccaatatgggacctacttgataaatatttaatattgtaagatttctttttttgtaatctggcttagcattagtttctgtc

SEQ ID NO: 85729 - DNA, 1026 bp, Homo sapiens
tgttttaaagcactgtttaaagttcaaactcaacagctggattttttttccctctgctttgaagagagtcactatagttggaacaacttattcacgctagctctttgaaacacctgtgttccaggtgaagccaaaaaaaaaaaaaaaaaaactaaagcttgaatctagtcttttcacctctccattaaaaaataaatatatctctaaaacttcccagctggtgggaatgaaatgctgtcagtgctcccaactgttagagggtaatattgaataataacaaagccacacttaatttgagcttctgaaaagcctcataacctcattatcattctcctgaactgcttaaccttctggttaaccttctgattattaacctcttgacatacttaattcaggtgtgagagtttagcgaagctcatgggactgtatttatttgatcttttttgtcatgtcccactgtgttgactttattttttaagattgctagacaccaggaggcatgtgttaggtggagacctagaggtttcagaagccactaaatatatcagacttgccataattggaggatatggtgaatcagtggggcttttaggcacttcatagaccagctgagtctcctgctatcaacccaatttatttgagagcagtacctcaggaaacttaatagacctgtagcacactagcacaaatctggattttagccagagtacagtttatttatgtgctgcttgtattattttgctctctgcatattctatgcctgtcattattaagtattaatcaaaaatattgaattgtatctttggcagtgggtttaaaaattacacgtttaattgatagtttacatcacttagaggtggcaagagaaccagatggtagaaaataggatcaggttgaagtggcattttttttaccaaagaaaatatgatttgcatgagtaagcaaagttttggggtttttaatgtgtgcttttgttttggggggatatggggactattaatcagttatagaatattaatccttttc

SEQ ID NO: 85730 - DNA, 1899 bp, Homo sapiens
atgttgatgatgatgatgatgatgatgacgatgatgatgatgatgatagcagctaccacctaaatcgttttctgtgtgccaggcatttatatgtgattctaaatcctagcagtaactctgtgtagtaggtgttcctgtacctgttttataaatgcaggaacagactcagagaagttatttaacttgcctaatgttatcaagctactaagtggcagagtcaagattctaaccttggtcattttgattccaaagcctacaacaaacacaccgcctcccactgctgaacctgttaactccttattttaaaaatcaatttccaggccttctccctcctgaagtagaattgttttgttcttacctctttttttagttttctatttttgaagtttactttatcttttgaaggacagagtacaagaacgagggctgtgatctagtgccacgtccgctgcacactaagacctttgactaatttctttacctctctaaacctctttgctctgtataatgggaacccataatgggacttacttcttacagtaattaggagtaggtgaggcaaaataaatttaaagctggatgcctaacacatagaaaattgcagtaaatttcagctgttttcagtcaggcttctttgttcatttacattaaaatctttttgcaccttcttgccctctctccttgatttttacatgtcaatgtcagtctttttccaacctcttggctgttgccttgcattcatccatcttttttctcagtcttgtcattgagttaacatgttctctacacccacttagtacccagtcagtgtttattgatgctaatgatgatggttaaacaaagatgctgttggcaccagtcctgaaggctctgagactccctgagtaatcatgacttcctaaaaacagaaaagtactcaatcatcttatttataattgaaggtcagaatttgatgtcagcatttgtttctgtggtgactgtgtagctttttctgaggaattacctttgacagttggggtagtcagtatttctggtgtgaggctgattattatgcattcttaaattacttcctaaaatagatgcagcatcgtataggtgggttaaacaaatattgatcatggtacagatctgctttaattggagcaagaggtcaggagaggcttatcattgaggtgtagatggctgccaggctctagattagttacctggtcttcttgcccataatcttttttgcgtcagagaaaattgtacaggcctatttttaattctaagcaaccctctctgttctctccctttttgatatctctaatatgttcccacctaatgtccttgatcttcagaagatgtctcatttcttgctttttcttgcctcaaattctgtcctccatgataacgttttcttcctcagcaaattttgtgggaatctagcaggatgtgctgcttgttatatttgggcactgtccactaacaattcagctgctgacactggttgcattattctaaagaatgtcatgttgttaaggttgaatttaaaacccattaatggtgagaagcttccataattttaatatccaggttttttaataaaagaaggaaagaaatggaaaaataaattttaaagataaacttttatgcaaatgaaaagcagattgtaaccaaatgcaaataaatacctcagtgtggcatatttcatttagtagaaagtagaaattgttaatttttactgtatctaatgattcccaaacttatatttttaactttgatctcccatcaaaggcctgtcctgtatttccagcaatctctcatttagactttaaaaagaaatctgtaaagggctactagtccaagccctgtaccctgcccccacccccccacaaaaagtagccaggagttcctttt

SEQ ID NO: 85731 - DNA, 1128 bp, Homo sapiens
atgtaaaaatctacggggatggacgtggtggctcacgcctgtaatcccagcactttgggaggccgaggcaggcagatcacttgaggtcaggggttcgagaccagcctggccaacatggcaaaaccccttctctactaaaaatacaaaattacccaagcgtgatggcacatgcctgtaatcccagctactcgggaggatgaccacagaagaatcacttgaacctggaaggcggaggttgcagtgaaccaagatggcgccactgcaccctagcctgggtgagagagcgagaatccatatcaaaaaataaaaataaaaataagtaaataaataaataaataaaaatgctacgggaagttagtaacaattgttgcttttgaagactggttactgaagggaaaactcattctccttgagtttagacacacattgccttttgaactgagtacttaccttatcataaattggctgtattccatagctgtttacacaaagactcacttaaatatttgaatttttaattttttcacagccatctcttcctgtactctataccctgtctagccaggctacacatgaagctgttcatctcctttgcaggatgttggtctttgatccagtaagtagtgtttttttttatatatttttaatgaattacaaatacatgtgttcgagagaaacattgtggttttgaatagattggcaatgtaaataattacttttcagaatataaacttcaatccccagtatcatgtgtatcatgcacgctcatcacacagaagtttgattattaacacataagagtctaagggaagagataaggagctggatcttatttaactcttatttcttatttatctcattatttgtaaaaggagtttgacaccaagttaagtcaagacaaaatgattttttgttttgagacaaggtcttgctctgtcacccaggctggagtgcagaggtgtgatctcagctcactgtaccctcaacctcccaggcccaagcaatcctcctacccgagccccctgagtatctgggactacaagcatgctcagctaatttctaaatattttgtagagaagaggtctcactatattgcccaggctggtttgaactcctggagtcaagtga

SEQ ID NO: 85732 - DNA, 1003 bp, Homo sapiens
cacacatgtatgtgtaaatgttgcttttccacctccactggaagagtttataccagtgactttgagcctgtcaccaatcccaaatttgatgacactttcgagaagaacctcagttctgtccgacaggttaaaggtgagtatctgttttggcctttggccaggcaatatgcctagtaacattttccattaggtggccatgaagagctgagatctggatggtaaccaaagctcccctctatgtttattttacaaccttgcgtatagctgtgtgtccggggcataacaaagcatatttaatattatatccaggggaaggtcggggagaggaatgaatattttgttcttattttcaaagtttatttagtgagtatgactcaaaatatgtttaatatgtattcactcagtgtcatttcattgattcaaacgtattgaactttatataacatacaaagttccataaaggataaacattcactgagggaattattccttggacgatgacaagagaagggaatttctgatagtgtactcataaaattttgtggcaggatctcctattggaatacagtgggagtaatgacatccaaaattctgagtgattttagtgtctactgtaggacattttacaagagagagagtagtccccaaagtaaccacctgaaactatacacctagataccaactgaggtctttaagtgatcttcaaaaaggcaataattgccagcaacttagaagagttcacccataatgccaaacctgtggagtctctctcaaatttataggccattttactcttcccactgatggggttgcagtctgtgtaatgccaccagtaggtttcttatatttagcaacagctgtcattttagttttaggaagttcagctgaattctgcttgatagatgatgtgtgtgtttgatttaactaaaccagtaggcagtgcttttcagatgctggctagagttcgctgagaattcactgctcccgggcttgcaaattgtca

SEQ ID NO: 85733 - DNA, 1448 bp, Homo sapiens
tgcatctttcatgtgtgtaaataattcatttctgggctaatttcaaaagaatcccaatattgctgtatagaaagagaactagcttgcacattttaggtctgtgaaattttgtgagacttttcctgcactggacagtaaaaaaataataaaagacaaaaacaaatttaaaaaaaaatttaagccacaaaaaaaggcacatagggaattatgtcaaatgtgtttgtgtccttaggcaaagctgtgggagtcttgaaatgtcacagtagtaaataacttattactttttgacaagttctttttttctgttggaacactgaattcttctgtgcatatgtacatatgaatacaaatcgaaggcctctacctcctggagttatacaacttggcttgtttacctccacatgctgatgatgactattttttttttttgagttcagtgtggagacttgaaacttgaatgtcccttccaacttttatattaaaaataaaaagacaagaaaattgaagatcatttttcacctgtacaaggaatactaatggatcgtcttaaaattggtctaggaaaaaaccttggtgtgtgttatggacaattaactgttaaagttattgtaagttatctgtatttagcagagtattttcaacttgagtgatctgagctgaatttgaagactattaataagttatgtttggaagttttaacttcaatgaagtaattatttgctgtgaaagaaacaaacattgaattactaaacaaagatggtgcaatatctttgttttttttttatgaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaagatgtgtcatctgttttatttcagtttctttcctttgttttctcttcagtacagctcgtatcctgactttgcaaagttttgagacacttcctatttatatttccactttgatctttgaggaaattggttgtttttaaaaatcttctcaaaaactttagattgacaaaaacatattgaaaatttagttaaatcaatatcaaagatgtgatttaaatatacacaatagagaagtctttttagaccttggagtctctaatccagtggttttcaaacttttttttctttgaagcaatatcttggagtccaatatattaaatacataaaagtagattgctctgtatgaagcagactggtaaagggacttgacacctccctcctcttcacttctgcctcctgcctctagcagcccaaaggtactttcagctaaggaagaagtcccagcccagtggtggtgtaat

SEQ ID NO: 85734 - DNA, 1005 bp, Homo sapiens
ctaggactataggtgcacaccaccacacctggctaattttttattttttgtagagatgatgtcttactgtgttacccaggctggtcttctgggctcaagccatcctcctgcctcgggctcccaaagtgctgagattacaggtgtgacccaccgtgcccagcgtcagctttatttttttaatgctgacttactgcagaaggcccaagggccagtgcaggcagcatctggccagaacctgtgtgtgtgtgtgtgtgtgtgtgtgtgtgtgtgtgtgtgtgtttgtgtgagatttaggcattagcacgggcatcctgggtgtgtgtgtatctgtgtgtgtgatgatgtttgaaggcattagctcggtggcatcctggcatggaaggtctgtgcctccattcttgttgctttggtgtaggaaatgctgattttgttgcttctctatggggcaaataataataaacgccttgagttattctcatattctctttgaaaaatgccaaaatttaacatctgtcattttcttcctgaaatagaaggaatgtttccctagagttaaaaaacctgtaggagatcacctagtggttgggctgaaacatgcacaataaattttttttcttggattgcaccaaatcactgcttggaaaaactcatttttttatttactttttgtttttctttcttttttttttttgattttgtttttgagacagtctcttgtcgcccaggctgtagtgcagtggtgcaatctcggctcactgcaacctctgcctctcgggttcaagcaattctcctgcctcagcatcccaaatagctgggattacaggtgcttgccacaacgcctggctaatttttatattttgttatagatggtgtttcaccatgttggccaggctggtctcaaactcctgacctcaagcgatctgcatgcctcagcctcccaaagtgctgggattacaggtgtgaaccaccacgcctggcctggaaaaactcttattttattatgaa

SEQ ID NO: 85735 - DNA, 1332 bp, Homo sapiens
aaaggtgtccatgaccttcccactgtctctgcctgcctgctttcttctactcccttctccaagtggaaactcggaactggaaacctggatgtgccacactgcccaacatgcagacttacgtgacagctcaccgacagctcgccaaagaaccaagaatgggggtcagaacataactcggaaaagctctagggcaataaaactgccattaccggttaaacctgtgtggtacaaaatccaaggggagggaaatccctgccccatggcatctgtttgttcagtaattatatataggtgagaggatcagaaggcagattcagtgaccccagggggtgccaatgggaaacgagcattttcagtggttttagcttatcaagtacacgtgtatggtcacctttttaaaaaagcattgattatatgagaacactaagaataattttaaaatgagaagcacattagggattagcctgatgctacagcttataagtcagtatgatactatccaacgcagagaaataaaagccaacaaaaagagaaattaattctgttggggaacaaaacaaaagggaacaagctcattgtttaagtggtctcaggcttcatgtgtatgcaagggatttccagacgactgaggcagccgtgcaggcctgctgaccacagacatgagcctgagccacactaatgtccctttacaagatctaccctggctatttaccccagatcctgtagcattctcccacaaactatggggaccatccccttccctttggagatactttcccaaaagatttctgggacctgatttctgagtaaaaatgggattttcccaccatttaccaacctttgaggaaggcatacgttgcaatgggaaagaaaggcagctgaaacacaagctcgcaaaacagaaaggacttaaaccaggctgggggctcctgtagcagtgggtctttgaactccttagcataccacttcagcaggtttctaaactgaaaaagaaaacgatcatgatgaattacagccacttgccctcaacaggctcggcgctagctcatttgaaaatacactggaggagcctgtcattaattagccaccccccactaccccggcagcagatggcatgtccagctggcttttgtgacacagcctaggtggtcatttaataaaaacttactatccctaactcaaatgttcccttctctgaaattttctcaactcttccagccccttctttgtgttacccagaatctgttcataattccaagataacacatccaggtgtgttggccactgtcaggagcaacaataagtatctggcacttggtaggcactcagggt

SEQ ID NO: 85736 - DNA, 1011 bp, Homo sapiens
tgaatctgccttctgatcctctcacctatatataattactgaacaaacagatgccatggggcagggatttccctccccttggattttgtaccacacaggtttaaccggtaatggcagttttattgccctagagcttttccgagttatgttctgacccccattcttggttctttggcgagctgtcggtgagctgtcacgtaagtctgcatgttgggcagtgtggcacatccaggtttccagttccgagtttccacttggagaagggagtagaagaaagcaggcaggcagagacagtgggaaggtcatggacacctttgagtcatgaacagacctaaccatttttcttttcccctgactacctcaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgccca

SEQ ID NO: 85737 - DNA, 1051 bp, Homo sapiens
acgcagtgtggtttttcagtttccgtgtctgtcttcttccagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacaggtgaggctcagagaggtggtggcagagggaacggggatcctttggaacacctgggtttttggcattggtgtccaagggcaggagtggggctggcttggcagcaggcatttccttgggtggctgggaagtgatgaggaattgggcctgtttctttacagccatggccaaggacatcctgggtgaagcagggctacactttgatgaactgaacaagctgagggtgttggacccagaggttacccagcagaccatagagctgaaggaagagtgcaaagactttgtggacagtgagtattggggagatacagtgccactcagctttgagctgccatttcaactgtaccccaggctcatcttggccctgccacagtggagctgctggctccctggaggttgaatctggcgtctgtgagttcccacgtgccacccttttctgtctgccctcttgtgctctcatgtgtccccaacagggcaccagtcaaaccaaacaccgggatggggaggggagggtgtctttagatatgccatctttcatttcttgctcttagaaaccttaaactttctgggaacacaaccatggcttgggtgtgggaaatagaattatgtactcatgatttgatttcttcagagaaagtcttctcaggggcaggttctctgttatttggagttagaagtgataggtgaagtttctagaagcagctcaacagacttactgaagtcatcttttggctggaaatcttcaggaagcctcctgtcccagcagccaagcaag

SEQ ID NO: 85738 - DNA, 1565 bp, Homo sapiens
ggtcttgtaggccgggcctcccctcgggcctctgtttcccagcaggctctgtggaatgggggctgtaagtgcttccggagtcaggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcaggtaggctgacctcgggtcgggggacgcgggcggaccaggggcgagaggagcctgacaggcccgcgtcctgaggaaaggcagtaccgggcggggagagacgtgggaattccgccccactctcaggggggcgctttcacacccagcttaggcctggagtttgatgcgttgatgcttgccacgatcttacgaggaaactgcggctcggataagttcggggagtttacatagtaaagagtcggctcgcagtgcctcgcatgcatctgggagagccggggcgcagaaagtatgccaccgcctcatgctcagggagcttagtcccagctcttgggccaggtgttgctcagatgctcagacacgcgtgtgatgggagttggtagataatctgtgaactctttccctgcacctcttcttccatcttacctatctctttaagccagcccttccaatcagataggtgggccaagccagattcatgggagtcatgcctgacttgtttttctcttatccccaaacccccacattcagtcagtccattgctaagccccatcacctcgacttacaaaacatctcaactcggaacacttgtgttcggctgccagccttggttactgcaatagtctcctgtttccacggtcattcattccacaaacatttactgagtgccagttatgtgtgggcaccatgctaggtgctagggttagagtgatgaacaagaaggtacttggggctttgccctctcttgttccctccaatcggttctctcaggctgagcaagagtgatctttctaagtctgattttgttggtctgctgagaacccgctggctgtcccattacccttctgataaaatccaagctcatgactgcgtctttcagagccttcggtgatccagctgttgtctccctgtctagcctcattctgttcccttctcttgctcagtctctgttctcggaatgcatcaaatttcctgttgcctcaggatcttcacatacgtgtttccttctgcctgcaatgccttgcttcccctttcacttgacatacttttggacagtctttaggtctgtttaagtgtcatttttttcagaaggcctctgttggccctcccctccaagtccgccccccatgaactgtgtcctcctgcagcacttcacacagcaccatgtacttttccttatagtaatatcacgatttgtgattatttctttaccatctgtccagaggcattgttttcactagtctgtccccagagcagggactgagtggatgtttctgaataaatgcatgctctcagggaagggggtggaagttgaagcagatatttgctccctcatgtt

SEQ ID NO: 85739 - DNA, 1023 bp, Homo sapiens
gagcccacaccggccacatttcccaggactttttgggtgacgcttaacctttacacctagggtttctgctagatccgccactctagccctcagctttcctcccgccgtcctccgtgtctgacggatttctgggtccttcttccttttagacccctcctctttccacctccgcggctgtttgccctttgttgtgcttgggttcccattagcttcgttgcgtgagccacggatccgcccttagccccgggcatccccaaatatccacacacaaagtgcggaaggaagagcactgtggctatcagtggaaacttcattctcactggaattactttctggggcgtcacctgccacagaattcctggaacccattggtctgggcggaatgtgattgacgtcatccaggggctcaaagcaattgctttgtaggaaaggaagagattagctctggatccgccgacctctcttggcaggcctatcctttgagctcctttgcattggcagaacatgtatgtgtgctttctctgatcctgggaaaactaggactagacacaaaatacacagggaacttgctaatacctgttagagaggtggatttattcctttgaggtgggcgggaaaagggaaggtgatctcataccattctagtgtttcttagtcattggcaacctcctggtgagggctcacctcccatacccaacccctgtggcaaatgaaagagtctcccagacaagccgccaaaggaattcactgcttcacacagcacccacgctggctgtccacttccttggacattcttcccagggacttacctaaatcttttcagggacaatttcagtctaacaaactgacgtatgttaaatacttaaaatgtgcatggcattgtgctgagcaccattaggggaacacagcggtaaacttgggaaaccagtgccctgcttctgggttgcacttacaaggcatgagcaactgtaaactcctgcatgtgatgagcattcggtgaaatcattccactttttttctgtc

SEQ ID NO: 85740 - DNA, 1068 bp, Homo sapiens
ccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggtgaggcactggggctgccgctcggggtggggagggcaggaggagttcccaaggaaatgaccagatctagaattcagtcacttttcctcttcactttatgtagggtgtcttcacctggagtccctagtagagcttcagaattctgtgaaattgtatatggaatgctgtgtttatgcattttccaggaagaagagccatacttttaaaatatttaaataggacaagattctcataggagccgtcaccttaagactgggcagcgggcagaaggccggcagtggctggtggtttctgtgttgggctgggcctggtaccctgagcctaggcccctgtggcttctacagcctggagggctgtatcccccgtgggatgtgccagttctgggtttcagagaggaagggtgaagagcagccatgggcctgagtgctagaacctccatccccgcctctgtcaccctgcgtaagggctttgtgctcgtggacccccttccctgccacctgccgccagcttgtcaggtggcctttgcctgcctcggaggtacctggcggcaaactaaccctgtagggccttctgcacccctaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggtacatgggtggggcggagcagggcgggcagatgaggtcagga

SEQ ID NO: 85741 - DNA, 1057 bp, Homo sapiens
aggggttgagctgaaccaaccttttgtacatatgggagctgcagcccagaagggttcagcccaaggctccacagctagcaagtggtagagctgtgttgggacctagctctggcccaccctctatgcccactagtcccttggtctcaggctggggcaggggtgtggaggatgttggtcttccctgtcctcatgtctgtagagtacatcccctcaccccgccttcggagggaggctggctttccctggagacggaccgccacctgttttatgagaggtagcggaggccttatggagcctcagggccagccgctctgacgcatggcttcctcttgaagatgaaaccttgctccaccttcttcctccctaaccccaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaaggctactgccccttaggcctcagctgggggaaaggcagttctggtgctgtagaggccctggtgcagaaagtgggacgtcttttttcctaaggtgtttaagcacaggcttgataagtttggtttttaaa

SEQ ID NO: 85742 - DNA, 1046 bp, Homo sapiens
aaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagaagtggatttgtctttatcttgttacctcaatgagggctggaagaactagtagctgatcaccaaggtacctgacctgagagtcttagtgctgtttatacattcaagactgtgactaacataaaatgcctaattagaaagtcacatttcccctgtcccgccgtcatgtcacttcaggtccttgtgtctaaccctgggtctggcatttgcccataggctctgtggcatcagctatcataagagtagtcaagagagatgaacttgataacctgtgttctctccaaagagcagaaagtgggtactatacgtggctacgttgctttgttaggctggcagaacagtccctccctgacagcattcctttggaaaataattcagataagctgaattctggtttggccaagccaaacaaaaaggaatgaaaaccaaagccctaaagaggaactcacctcctggctagtgcttggcatctccatggctgagttacccaacaaggagtga

SEQ ID NO: 85743 - DNA, 1120 bp, Homo sapiens
agtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggac

SEQ ID NO: 85744 - DNA, 1533 bp, Homo sapiens
ttccagcctgaacttttgcttcatgtatgagcaccttgtttgcctgggccaccactagggagggttttctaggaggggcaatcgcactggactattgtgtgattggactagatacaattgtatccacaacacacaattggactaaccaattgtatcttgccccagcacctccttttgtggctcgggagacgctaagggcctggcaagagaagaatcacccctggctggagctctccgatgttcatcgggaaacaactgagaacatacgtgtcactgtcatccccttctacatgggcatgagggtatgtggccagcctggaccccttctagcaggggtaggccccaaggtgtatggtgtccttaaggtgactgccgggggaagggagtctaaatataaaccatgtccctgtggttctgcttccaagtggtggcatgtgttgggtggggttgagtagcctctagacagtggctgacaccaagacctagagcgggcaggaaaactcataggtcccaggaaggaatcctttatcctgtctcttccctcttgctcaaagggagccatgtttatgaagaatatacacataattatttaaagcagtgtaggcataacactttttacacattatagacacttacacatcgcctggctgtaagcatgtgcagtggtaggggccgcccaactccacagacagaagctataggtcagaaaagtacgtatagtcagtgcatgcttggatacaaatataaatgaaacaccgtccctgtcttccaggaccttatagtagtggaggaggccaacttaaagtattatagcaagggacagtaatgggagacaggaggaggacaggggctcagggcagcaaggatagggggcagggctggtgaggagggcagtgaaaaaggtaagagccctgtaactgatttctgttggcatccagctctgttggtgatcttgaagggatgaggagtggggaggccaggagtggatacagggatgttgcctccctgtgggtgtgtaggccatggttcagctatcacccttatcccacagatactctcagcttggtctgtctgcaaccttcctggaatacatcaactgcactggagagatgttgattggaacacacttggtcttgccctgtgggacttaaattctttttgttttctccctaggaagcccagaattcccacgtgtactgggtgagtgtcactgtctgggagaaggggagcttgtggggtgtgcctgggggtcagggtggaggtgggggagcccaccttctgacgagagcggaacctgtgcagtgcatgtgtcagctttgttgacttttgctttgcacagaattctgaggagggttacccaaattttattttttttaaactctctctcccacacccacctcagtggcgctactgtatccgtttggagaaccttgacagtgatgtggtacagctccgggagcggcactggaggatattcagtctctctggcaccttggagacagtgcgaggccgaggggtagtgggcagggtgag

SEQ ID NO: 85745 - DNA, 1047 bp, Homo sapiens
tctgcctcccgggttcaagtgattctcctgcctcagccacccgagtagctgggattacaggcatctgccaccacaccagcctaatttttgtactttttagcagagacatggtttcaccactgattcacttcttgccttagtctcagagatctcagacagaagctgtgaccttcttggctaaccatgatgacagtcgggccctctatgccatcccaggtgagtagttagcatttgaatggtgcccgtcaagaaggagtctggtgtgtctcagggagaggattctgatgtcctgtcatccactgggagggattatgatgctgagaggtatgatatcagggttatcccatactggaacaaggccagttaatgtttcttctcaaccccatctctctcctctcctgtgagtttcaccactgtcttttgcatctctgtgccaggcttggactatgtcagccatgaagacatcctcccctacacctccactgatcaggttcccatccaacatgaactctttgaaagatttcttctgtatgaccagacaaaaggtaatctctctcaagaaggggaggtggaatgggagggccttttcatcaaagaatatcatagaaataattccagggccgggcacggtggctcacgcctgtaatcccagcactttgggaggcccaggcaggtggatcatctgaggtcaggagttcaagactggcctggccaacctggtgaaaccctgtctctactaaaaatacaaaaattagctgggcgtggtggtgggcgcctgtaatcccagctacctgggaggctgaggcaggagaatcacttgaacccaggagggtggaggttgcagtgagccgagattgcaccattgcattccagcctgggcaacagagcgagactccatctcaggaaaaaaaaaaaaaaaggcccgggtgcttgtggctcacgcctataactccagcactttgggaggctgacacgggcagatcactaggtcaagagatcaagaccatcgtggccaatgtggtgaaaccctgtttctactaaaaatat

SEQ ID NO: 85746 - DNA, 1044 bp, Homo sapiens
caagaccttgtgctggagttgcctccacctgtgttgctttgtggtctggggcccacctggatggatttgctggactgcagactcactgaggcccctctttccttccagcttttccttcatagcatttttggctaccgaggtgtcgtcctgtttccctggcaggccagactgtatgaccgggatgtggcttctgcagctccagaaaagtaagtttccctgtggttgtgcctcacagtatcctcaggaggagatggcagacatatgtaattggggtactaggggtgaagacagcgtcctcctaggccttggaaacatccccagagtacttctctgggactaagacccatggagacaaaagtgctgagtgccagggatagtctaagtcagagagtccctttaggcctcctcagaatgctttcctaagccattcctaattttcattatgagtatcccagagggcatttgggggacaagtcttcttgatttcttgatgttcagctggagtctttccctcaatctcacatcatccctagaatacattaaaacagaaaaggttcagccccattaagtgatcacagacagtccctgggatataagaagacaagagtactctgggccctggggactgaggtggcaatttgattttctcaacatggcccccttcttttaagaggtatccacacggtcagatgatggctccataccatggtcttccatgctctattatttgccccaactgaggagcagctgagctgaggtgctgcagagcaggtgtccagctggtgctaaagcccctttagatcagagaccagcctgtttaggtgaggaggagtagggagctgagtcagccacagcttccatttctcctggggtgatcttggcctccttctcccaccccatagagcagagaaccctgctggccatggctccaaggaggtgaaaggcaaaactcacacttactatcaggtgctgattgatgctcgtgactgcccacatatagtaagtaagcaagatggctgggcttgggggtcctctccatggaaa

SEQ ID NO: 85747 - DNA, 1030 bp, Homo sapiens
tttgtgaaaccttttcttctcagattccaaactatacctccatgagctcctagaaggcagtgaaatctatctcccagaggttgtgaagcctccacgggtatgtaagggatatgtttgtgagagtggttattgactgagttgggcttatccatgatacactgaacttataaatcaacttttaggcttgaaaaattgtttttgaaatctttgggatctgggggagccagatattgtcctccccatcagctgtttggaaaattgagatcaaaaaaaaaaaaaacagtttcaaagcactggagttacgactagtatgtgggtctcctgatacctttagcagtgctttacccctggaaccaatgattgtgatgtgctttctaacaagctgggaatatcattcttctcatttgatttttctgcttcagaacccagaactagttgcccggctggagaagattaagatacagctggccaatgaggaatataaacggatcacccgcaacgtcacttgtcaggtaaggacatgctcttcagtacgtggtctaggtagcccctcagagtagggccctgcagtggaagaagatacagagtttagaaaaaacatggaaacttggtttctatactgttcagggaccataggaagtctgcatacaaacaacacagttcccatctcattcactgagactctgggctgagatggtgaccaagttttaaacgtcatagaagtgggagttagccgggcacggcgctcatgcctgtaatcctagcactttgggaggctgaggtaggtggatcacttgaggtcgggagttcgtgaccagcctggccaacatggtgaaaccccgtctttacaaaaaatacaaaacttagcctggcgtggtggcgggcacctgtaatcccagctactcgagaggctgaggcaggagaatcacttgaacccaggaggcggaggcagaggctgctgtgagccaacactgcaccattgcactccagcctgagcaacaagagcaagactccatctcaaaataaataa

SEQ ID NO: 85748 - DNA, 2278 bp, Homo sapiens
gagaccacgttggccaggctggtcttgaactcccagcctcaaggtgatcctcctgcctcggcctcccaaagtgctgggattacaaggtgagccactgtgcccagccattcgagcatttcttctgacagggctccctactactctatggcatgctcctaccctggaacaggagagtagatgggtactggcagcctatgtcctctctccgaaatgcctgctctgtagtccagaaaagagtcaaaatggttccagacaaaagaatccatggggagggcagagttaatatgttggggaatagagagggctgagccagactgtcaatggatgctctctgagctgcttctattctgaatcatcttctttttctttttcccaggatacaagacatggtgggactctcagcgacctgggaaagcaaggtgaggtactaggagatcaggcttctaaaaccttttcctgagatgggtcatgacactcaggcttgttgtttgactgaaacccagttggtgggggagccatgagataagagcacctcctagagaatgttgaactaaaggtgccctctctggctcctccccaaagtgagatcattgaaggctctggtcatcaccatcttcaatttcattgtcacggtggttgctgccttcgtctgcacttaccttggaagccaatatatcttcacagaaatggcctcggtgagtaggcactgggcagggcagggtgccctggtgggggtgttagtgggtaagggaggacgtatgtgaaagtgccttgcacaggttaggtattgaacagatatttatgccattaataaggggagcattagagctttccagcagtcacgggaggttaggtaataaccccaggagaagccacattctcttttcttcccctcccccaacttagagggtggttggggggctctccatcctcattaaagttgctggggtacagagctggttgttggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaacctgagctatataaaatttgtgttaaaaagctacactgggccaggtgaggtggctcacacctgtaatcgtagcattttgggaggctgagg

SEQ ID NO: 85749 - DNA, 1059 bp, Homo sapiens
ttttaccatgtgccaggcattgtgccaagcactctataaggcttatctcattagtcctgataataatcctatgaggcaggtatttctattttctatttatgagataaggaaagcaaggtagagagataaaggaagctgcccaaaggtctcctttatcccagttagaaaacgggctgagaagaaaccaggacccaggggatctgctcctgagctgaggctcttagccaccacacatactgcctctcaaggggaggagggagggggagaacggctatggccagaatagagcacccttagaatccgagaagtggggtcctcccaggggaggagatgagggtggggagcagggaggggaatgctctcccctatatgaggccggtgaggcccagagagggttagtgaccaggccccaaacgggcaagccaagctccccaagctgcggcaattccactgtccccttccactttcactgggcagagaccgcgtggcgcgcattgggctgggcgtgatcctgaacctggcgaaggaacgcgaacccgtagagctggcgcggagtgggtcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgctttcgctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgc

SEQ ID NO: 85750 - DNA, 1046 bp, Homo sapiens
ccaggctggtcccgaactcctgagctcaagcctggagttcagtgcctgcctcggctccccaaagttctgggattagaggcatgagccaccgtgcccagccagaggacttgactctaattgttttcgttctcaaccagctaggtgatcctgaacaaaccattatccctttcttttatttatttaattatttttttttttttgaggcacagtcttgctctatcaccaggttggagtgcagtggtgagatcttggtcggctcactgcaacctccgcctcccgggttcaagtgattcccctgcctcagcctcctgagtagctgggactacaggcacacgccaccatatccagctaatttatatatatatatttttagtagagacggggtttcaccatcttggccaagatggtctcgatctcctgacctcgtgatccgcccgccttggcctcccaaagtgctgggattacagacatgagccaccacacacggccgccattatccctttcttggccagcctctgaatctgtgcgatgaataatttgtactgtctttggttttgtataattctggatgaaacaaatttctaaaaatttccaaataaattgctgcaggctcaggattcattccaatgctcagcagaaaggcagcagggcttggctgaaacagcctggacttggactcccgaggcttgagtcagaggaccggcccctcgtgggctgggcgtgtgtgtggcttaggaggaaatcccttcctctctgggcttttttctctccatctgtaaaatggagcggctccccaggaagccagtcaaggacgaagttacgcatgttctttccccaggaaggctccacttcccaagaatgcttggcaccccttgtcgtcccagcagatggcaaagaggtgagaggagcctttgtcttggaccggccccagaggctccgtcatccctctttggttgtttctggtgcttaattgcctctggttttaaaactcctttccctgaagccacattagtgggtaatcaatagggaaaaaccacaagtgaact

SEQ ID NO: 85751 - DNA, 1404 bp, Homo sapiens
tcacaacattgagctaggtgaaatcagcttaaaataaataccaaacgaaagtttaaatagaaaacaaagagagaaagagtcctcaaaagagctgggcatgtgtcatctaaggacacaatcgacagaataaaaaggcaacctacagaatggaagaaaatatttgtaaaccatacgtctgagaaggggttaatatccagaatatataaagaactcttacaatccaacaacaacaaaaaacaagtaacccaatttaaaaattagcagacggtttcaatagacattctccaaagaagatatacaagtggacaagtatatgaaaagttgctcaacaccactaatcactaaggaaatgcaagtctaaaccacaacgaaatatcttctctgcaacattccaattttaatatgtgggctgccgaagcaagcacaaaaccacaatgaaacaccacacacccactaggatggctgctgttttaaaaaagacaaaacactcttcctaagccggcgctcggcaagttctcccaggagaaagccatgttcagttcgagcgccaagattgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcagaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatcctcgaggacttggtcttcccaagcgaaattgtggtcaagagaatccgcgtcaaactagatggcagccggctcataaaggctcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaataatgagtattgttgaggctgtgaggaaatcggaacccttgtgcgctgttggtggaaatgtaagatggtgcagctgctgtggcaaactgcatggcatttccttaaaaaaaaaaaaacgaaacatagagctaccagatgatccagcaatactgcttcttggtatatatccaaaagaattgaaaggaaggtctcaaagagatatttgtacacccacgttcataacagggttattcacaatag

SEQ ID NO: 85752 - DNA, 1050 bp, Homo sapiens
tacctccacaggtgaacacacttccacagggtacatacttccataggtgaacatacttccacaagtgtacaccccttcacagaggtacacccctccatgtggtacatgcttctacagggtacacacttccacagatgaacatacctccacaggctacacatctccacaggtgtacacccctccaaaagtatagacttccacaggtgtacacacctccacagggtatacagttccattggtgaatatacctccacaggtgtacactcctcaacaggtatacacccctccacaagtatacacactttcacaggagtacacccctccacagtgtacatacctccaaaggtgaacaccattccccaggtgtatacacctccacagatatacataccttcacaggcgtacacacctccacagggtacacacttccacaggtgaacatatctctacagtgtccataccttcacagggtacacatttccacaggtataccctcctcaacaggtgtacacccctccacaagtatacacatttccacaggggtacacacctccagaggatccatacttccacagggtatacaactccacaggatccataactccacaggatacacacctccacaggatccatacctccacagggtacacatctccacagggtacacacctccacaggatccttacatccacagggtacacatctccacaggatccatacctccacagggtacacacctccacagggtacacacctccacaggatccatagctccaaagggtacacatctccagaggatacacatctccacagaatccatacctccacagggtacacacctctacagggtacacactgccacaggatccacacctccacaaggtacacacctccacaggttacacacctccacaggatccatacctccatagggtacacacctccacaggatccataccatcacggggtacatgcctccacagagtacatacctccacaggatccacacctccacagggtacacacttccacagagtacacacctccaca

SEQ ID NO: 85753 - DNA, 1080 bp, Homo sapiens
tacccagtggaggtgtgtaccctgtggaggtgtgtatcctgtggaggtgtgtaccctgtggaggtgtggatcctgtggaggtgtgtaccctgtggagatgtgtacccttttgaggtatggatcctgtggaggtgtgtaccctgtggaagtgtgtaccctgtggaggtgtggatcctgtggaggtatgtactctgtggaggcgtgtaccctgtgatggtatggatcctgtggaggtgtgtaccctgtggaggtatggatcctgcggaggtgtgtaccctatggaggtatggatcctgtggaggtgtgtaccctgtggaggtgtgtccttgtggaggtatggatcctgtggaggtgtgtacccagtggagttgtgtaccctgtggaggtgtgtaccctgtggaggtgtgtatcctgtggaggtgtgtaccctgtggagatgtgtacccttttgaggtatggatcctgtggaggtgtgtaccctgtggaagtgtgtaccctgtggaggtgtggatcctgtggaggtatgtattctgtggaggcgtgtaccccgtgatggtatggatcctgtggaggtgtgtacccagtggaggtgtgtaccctgtggaggtatggatcctgcggaggtgtgtaccctatggaggtatggatcctgtggaggtgtgtaccctgtggaggtgtgtatcctgcggaggtgtgtaccctgtggaggtgtgtactctgtggcggtatggatcctgtggaggtgtgtactctgtggaagtgtgtaccctgtggaggtgtggatcctgtggaggtatgtactctgtggaggcatgtaccccgtgatggtatggatcctgtggaggtgtgtaccctatggaggtatggatcctgtggaggtgtgtaacctgtggaggtgtgtaccttgtggaggtgtggatcctgtggcagtgtgtaccctgtagaggtgtgtaccctgtggaggtatggattctgtggagatgtgtatcctctggagatgtgtaccctttggagctatggatcctgtggaggtgtgtaccctgtggaggtgtgtaccctgtggaggtatggatcctgtgg

SEQ ID NO: 85754 - DNA, 1038 bp, Homo sapiens
tatgtctgcccatagcaggagggtgtgtgccccataagtaggtcctgcagggggttcttgccaggaatggggcctggagctgggtggagtgagtgcagtggtggggagaggccagctgggggtgccaggggccggatggggcctgagccggacagcccagggggcggacagcccaggagtggggagcccagcttttctctcttgtctccaatgaggctgtccagctcttctgaaaggcccaagagagaaagaacaccatgagacctccctcctccacagtcttccccagactggaacccttactcggggccttgcctcattctctgattctctcttttttttttttttggctcatgagtaccctgggcccttccttgcgtggcccggccggcctcacctggcttggccatgcttttgcgcacagcaatgggatctttcctcttccatttttgcagctcctcttgcatcttgtcgatcttggccggattgagggcccacaggcagcccttgcgggaggaacttcctgatttgttctccaccttctcgaagcacttgttgagggataggttgtgccggacagaattcttccagccatcgggtgctgtctgccggaacagagcaagacaagcattcaggccaggctcaggaagccagagcgggcttcaggtctgggttctagaacactcctgtttctcctctgggcacagagctgccgcccactctggggcttgttgtcctcctcagcacccatcccttgcttggtaccctttggtggtaggggacgggtgaacaggaaccttgaccccaagttattttcatctcaaatctgccttcatcccacccgcatcccttcctgacccctcagaggactgccgaggtgattcggaaagccagggctggtgggcgctacagaggccttctgacccacaacactctcccatctgaagctgagccactccccactgggtctccatgcctgtgcttggacccctctgtggaagggggactcattactctgaggtcttgtggctggcttta

SEQ ID NO: 85755 - DNA, 1248 bp, Homo sapiens
gccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaagtctgagctctactctttctgcattcacgcgtaagtaacagtttcctggtgtttgtcctcctgtgcccacaggtccactttgcttccacgtggccatgtgcccttcctagctggattgcccaaggctgttagcatctgctttttacctgagatactaattcatcaggtcaaaaaaaaaaaaaaaaaaaaaaaaaaagtcttgagcaccagctgcagggagccttctgctaggtacaggggtcctacagagaacaaagtaggcaggaccagtgctttcacagagctgagctttcagggggaagagtcagcggacaaataaaaataatttcacataatgcattagaaagacaaaaacaggctggtcagatggtgactgagggggaaggacttcagactgggtgtgagggaggccctttgagcagatgacatttgag

SEQ ID NO: 85756 - DNA, 1808 bp, Homo sapiens
ggagaattgcttgaacccgggaggtggagtttgcagtgagccaagattgtgccactgcactccagcctggcaacagagtgagactccatctcaaaaaaaaaagatgtgaagaatgtagctttctgtatcacgctgtctccttgtagggaaaacacgtgggagaaatttttatcaggtcttcctagtgggagtaattgcttctgaataactggcttgatttgatcttgtagacactgaattatgctgttctttgtttctctctttgtgtagactgttaggaaacctggtaaaatacgtgatttttaaagcacgtatttagtttattcagtttacccttggctttgctattttcttctgcaattattttctctcagccctgattttgtctcttatatgttgccttgtcctgattgtgtcttttttaaggcacctcaaatcttttttgggagaaagtagaatataaatctaaacaaagtaaccactccctgtttgctctacagattctttactatgcaatgttgggggtgaatccccgctttgactcagcttcctccagctactatttggacatgcacagcctcccccatgtcatcaacccagtggagtcccggctgggtgagcacctaaggatgagggtctttcttttctgccaggctagggagggaccctgacggctcagctgggtaggggacaggagttggaggtggattatatacagtgatggttcccaggttgggttggtccgaggagactgtggagattgaggctcctttttttctttttttgagacaaggccttgctctgttgcccagtctaaagtgcagtggcacagtcatagctcactgcagcctccaactcctggactcaagtggtcttcccacctcagcctctcgagtagctagaactataggtatgtgccactacacttggctaattttcaaaattttttttagagacaggatctcattatgttgcccatgctggtcttgaactcccctcaagtgatcttcccaccccagccccctaaaatgctgggattataggcgtgagccactatgcctgagccctaggttcctttttcatgatgctctgttgatatctccatcttcacacctatcatatccaaaagcatttattaaacgtgattcctagcactttttacaaatgaatgactaggctgggtctatctccctaaaagccatctaggagagaggctgtcacacacataggaaagacaacagcaaaagtacttgagggcagaatttgaattgacagttctgctgattgaggttgaataaccttgaagctagtattagagtttttcatttttcgggtggaaactaggaagaggaggtgtgactaagaactgtaacacaggcaaaccaaagtgagtatatctaattgtggaatctcagataccagaggcaggctagtgtggcccaaggattgtgagggggtggcatgtgaggccttagaaaattcctccgttcatttattcattcagcaaacattgactgagggactaccttatgacagtgctgagtagagaaaagaagggcatttcaggcaaagggaactgtgagcttagatgcagacaagtgagagagcttaggcattcaggaagctcagagtagtttagtgtggctgaaatgtgagtgagtgaccaaagatgaagccggttaggcaggcaggagccaggtcataaaggaccatgttaaggagtttgaactttaacctgatatgggtggctagtgattgagggatattaagcagggaactgacataaggtcagatttctggtttgcata

SEQ ID NO: 85757 - DNA, 1022 bp, Homo sapiens
cccaacctcaaatgatctgcctgcctcggcctcccaaagtgctgggattacagcgtgagccaccacacccggccgatatttgtattttcagtagagatggggtttctccatgatggccaggctggtcttgaagtgctggcctcaagtgatccgtctgcctcagtctcccaaagtgctgggattacagacatgagccacagcgcccggcagctttttcttactcagtgttcctcatcccagttttgtcctccttttggttccatgatggaaagcagccccattccagaggagaaacaagttcagctcagctgggagtacaggctgcccctcttctttgatccacaagagcctctgacttccctgactcctgtttctgtaggctatgagatcaccttcagtttactcaacccagaccccaagtcccatgatgtctactgggacattgagggggctgtccggcgctatgtgcaacctttcctgaatgccctcggtgccgctggcaacttctctgtggactctcaggtgagaccgggagcaagttgaggagtccttttcaatgtctatacatatttacaagtgcagtctgttcctccatctcttagagcttgctgatttgctaggaatttcctgtgtgtatatgtatgtgagtgtcataagggtgggtactgggggtgcgtgtgtgcccttgtctgtgtccatccatccattgagggcagattctggtgtctttacttccttggcatcctattgagagagtttgtcagtgcttgttaacaaaccaccttcctatagctccctctagacctgtactcaccaattgtgcttagatgttaatgccatgacccatctttttttttttttttttttttttgagacagagtcttgttctattaccaggctggagtgcagtggtgtgatcccagctcactgcaacctccgcctcccaggttcaagcgattctcctgactcagcctcctgagtagctgggattacaggtgcgtgccaccatgcccagctgattt

SEQ ID NO: 85758 - DNA, 1047 bp, Homo sapiens
ttataatcaaatatttaatttttataaaagcactaaagaaaatgttaatgaacgtccccatccccacccccagctcacaaactgcagtgcagtagcacggtgtgtacttccatggttatactccattcccttttggcccaaggcaaccagattttgtgtttgtaattttcttgcttttccttagagtttgatcacatatgctgtatctctgtaaacaatgtatttaattttacatttttgaatttatataaatggtggcttataacacatgttcctctgccacttttattttattcccttcatgtggcagagcctggtgagagaatcatccataattatgtagttgaatctatgtatcattgtataaacataaacataatttacccattctattgctaatggacatttggattatttctaggttttactgttagaaataatgctattatgaatacttgtttctttgccatgtgccatttttatatcagactctccagttgtctgtttattccgcttttcttgctcagcatgccatctctgagtttccatttcaccattttaccagcccctgaagagttagatgctgcctggacccatgtcaactgggaaaaagaagagaacggagacaaatgaaaatactcaatatatactcatagctcagaaatgctgagttaatagctcatgaatctcaagagaggtgcaaacctgttggtcattggcaaaggggcagattcggaacagtaggagccagggtgctttttggctttcttttctgagccatgggcattctgtctcttgctcacccccacaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggtagggcaccaggctctgccacatgaag

SEQ ID NO: 85759 - DNA, 1196 bp, Homo sapiens
cggtcctgccccctcgttgcagagattccgattgggtgaggctcacgaagctctgcccccacggtggccggagcagccggaagctagcatggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcaggtgagactgctgtgcgggagggtcgggggacagcccccccggcaaggtggagactcagtgacggccctgatgctccttcctgtagctccgcctcatggtgcctgtcactgtcgtgtttacgcgggagtcagtgcccctggacgaccaggagaagctgcccttcaccgttgtgcatgaaagagagattcctctgaaatgtgagttactggggatcagggctgcttttcgcctctgagctcagttcagagctgagttgggtgggaggagcgggggtgtaccataaacgcagttaaaaacttactgttgaaagacctctgaatgaacagtgtgtttggtcagaaaaaaactactttcaaattcacagtcactaaatagcaattttactcgtaagacaggctacctaatcggaagcagttgatgcccatcagggtataggggaagaggtgggatatagtggaaagaacacagagtttgaaattaaattggatttgcatataggccctatttagtttgtttgtttatttatttattatattttgagacggagcttcgctctgtcgcccaggctggagtgcagtggcgccatcttggctcactgcaacctctgcctcctgggttcaagcgattcttctgcaccagccacccgagtagctgggatta

SEQ ID NO: 85760 - DNA, 1227 bp, Homo sapiens
cttcccaggctgactcaggagagaagtcaggaactctagcagagctctcccaacactgaaatgtgccttgcctggcttggccctggggaaagaattggcgtgatatcaattggtcccatgtgggctaagcatgggtcaggcactctctcctacctcctggcaagggctgtgaagagaccagctcttcatgtgtcttctcacctccctttccctcacagaatgaaaaggagctccaggaagtgatacagcagcagaatgagaagatcctagaacagatagacaagagtggcgagctcatagtatgttcaccatcatgcccaggcctttgccttctgtgttactggtcagccaggatcccaagtatgagaaatggtttgcttttgttcaccacatgttgtctatccttatgtcctattggacacctctccattctcattcccagagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatgtaagaatgtccatgccattccagggccatttcctaccatcgttaacaaatgccccgccatgtttcccctgtcctaccaagtttgctcttttatgcataggacttataaaatctgtttgctttctagagaaatatcctagaggagaaccttcggcgctctgacaaggagttagaaaaactagatgacattgttcagcatatttataaggtataggcaggagggaggtgatatcactaatgaacctggtacaaggcctggccccaggaggtactaatgagcacagatctggttcccagcctgtgctgagagctgggcctgaatcactattgcaggcttctctgtggtgtctgttttctcccctctaattcagcggctgcctcctggggctgggagccctgggccttaagtctgtggtcctgagctgcgttttctgcctctcttcccagaccctgctctctattccagaggtggtg

SEQ ID NO: 85761 - DNA, 1215 bp, Homo sapiens
ggaaaaagactgggaaaaagttgagagagggatggaagagtcattcatgtggaagggaagtttgaagtagatgtttttgtgatgctcccaaggcaaggccaccctgggaatgaattagagtaaatttagggccaaggacttaacccagaggatccagcagttaaggaaggacctgtgaatagagaagaaataaccagaaaggtgtggggcctgcctttaaaggagagagactcatgtcctggaagctaagaaaaggaagtttctaaaagaacaatgtggtcatcaatatcaaataggtcaggtaaaacaagagctgaaatatatgcattgcatttgaaagtaaggctgccattggtgaaccaaatgacaagaatttaggtggaatgacaggggagaagcctgagtgtagtgggctggggagtcaatagatggtgagagttataaacaagaagtataggctctttttttctttcttttttctttctttcctttctttctagaaaaggcagtagctaaaaggggatttaaggtaagaagaagggttttgttttgttttgtttaggtttgtttttaaaatactgctgtttttgttggagaggcttaagaatataaacatgttcagagaaaggcactaatggagaagttgaagatagagaattgagataataggtggaacagcattttggaggagatggctgggagttacctggaagcccaggagttcactagacctgaacagcagctattttttcttctttgcccttagactgaacaagagacccttctgctgagtacagcctgtcctcccacccaggaacaccctctgcctaatgacaggaccttcctgggaagcatcttgacagcagtggcagatgaaggttaaaggccctgggatttgggggtgggaaagttgtgacgctgctcctgatatcttctgctgttgaagatgtccaccagcgggcttgtctatcttaccctggcttccattatggtagacccctgcctggatcatcagaggggccctctcccattattggtttttctcttagagccagaatcaactcctgtgcccttgcttggaagtgacaagagtgctttcacccgagtagcatcaatggtttcccttcagcccgcaggttaggaggggctccagggatcctgcctcatttctagaaaatctggtggtgatgagtaaagacgaaagcagtgagaagt

SEQ ID NO: 85762 - DNA, 2356 bp, Homo sapiens
ggctctcagaggcaaggatgcggtaaggtgacaggcatttgttcttggatgtgggaggtttccacctcaaggttcctgcaggaacacaaatgcactttagacacagatgggtggcctaagaactgcctgccctgggcagtaaagaactgatctattgaggtgtcatggttacatctttttgtgctggctcccctgttgcccactgtggccttgcaaccacttccctcaataggcagagatagtgttggaggctttctgtgcacacgccagccagcgcatcagccagctggaacaggacctagcatccatgcgggaattcagaggccttctgaaggatgcccagacccaactggtaatttaagggcattttctttcctggggtctgtgctgacagactgggagggtagttgcatactcccactttgctgtatccaaagggaaggggttcccgcctaggcaatctttcttttgtaggtagggcttcatgccaagcaagaagagctggttcagcagacagtgagtcttacttctaccttgcaacaagactggaggtccatgcaactggatgtgagtatttgggaccatcataactaattccttactcacatcaagtcctgttgtgagctttgcctcaagtgtgctctactgacctgcttgcttcccctggtagtatacaacatggacagctttgctgagtcggtcccgacaactcacagagaaactcacagtcaagagccagcaagccctgcaggaacgtgatgtggcaattgaggaaaagcaggaggtacaaaccaagagtggggactgcttaggcttggtttccttcctaatgtgtgataccattagcctcttaccctggatctgttttcttttcaccctgtgggtttggaggccagccagtaaggtctcttagctgtaagatggccttaagcgcagttttttcctttgcccttcagcatctttacttcagcaacttttctcctgtctctactttttcctgaggatcaaccttattttctgcaatgttgatgcccaggagcaaggtagttttctgtcttgtccagaaagagaagctggaccaagtcctgggattattgattcaggaggaactataggaggaaaaccatctgttcttcctaggtttctagggtgctggaacaagtctctgcccagttagaggagtgcaaaggccaaacagaacaactggagttggaaaacagtcgtctagcaacaggtgtttgtgtgtgtgtgtgtgtatgcatgcatgtaagcatttgagccctgttaaggcttggagtgtggcactagagcaaggaagtactcaggagcacttgctttggagcagaagtttggggagtttctagcctgctgaccgcatggtgtcattaggatacttttgttctagatctccgggctcagttgcagattctggccaacatggacagccagctaaaagagctacagagtcagcatacccattgtgcccaggacctggctatgaaggatgagttactctgccagcttacccagagcaatgaggagcaggctgctcagtgagttcctaacggggtactgtggcagtaggcatccaggatttaggaccaaatgggatctaatatgttgtctctggcagatggcaaaaggaagagatggcactaaaacacatgcaggcagaactgcagcagcaacaagctgtcctggccaaagaggtgcgggacctgaaagagaccttggaggtaaggaatatggcttgggccaagggagctggtaagcctcaggagtgtgattcttgcctgatagtgttgaggtaaggtttgagactgtgaactagaaaaagcctctgtacccagggcactaaaattctccctccctgtcttgctccttctcttgtcttcccagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacgtaagttctctaactttctgtacttccccctaagtgcttatttttttctcaggaacacttctagaagccaaaatctccaagaagagaactgtgagtgttgagcctcttgtttctctcctttaatgcagctctgtggggatttgggataggcgttcagagaaggtaatttggtctttggtcatcttccctgttccttatttcagggctaaactggccagcaccatagcagataaccaggagcaagatctggagaaaacacggcagtactctcaaaagctagggctgctgactgagcaactacagagcctgactctctttctaca

SEQ ID NO: 85763 - DNA, 1888 bp, Homo sapiens
aagaattcttttcttttttgagtgcactatcttgcacctgtaattgtatgtcgggaactgaattgactgccttagacaactacttttgtttcctttggcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtgggtaagcgcccctatgtccttgcacctcgtgagttccattaccctggaccttcccctcccatcccttcccctccttttcttttcgtcatgttcttctctttctgctgcagccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtggggtaagaaggttcctctcaaagcttgagggatcccagtggggatccttggaatttaagctgagaagctgccagagggcaaaggggactcctatcacaggcttatacttagaacatttgcaaaagctgagaatctgggcagtcacaatggctgatgcctgtaatcccactgctttgggaggccaaggtgggaggactgcttgaggccaggcatttgaaaccagcttgggcaacacagcgagatcccatccctacaaaagatttttaaaaaatcagctggatatggttttgcatgcctcactactcaggaggctgaggcaggaggatcatttgagcccaggaggctaaggctgcagtgagctatgatcatgggcaagacagtgaaaccctgtctcttaaaacaaaaaagctgaggatctgg

SEQ ID NO: 85764 - DNA, 1573 bp, Homo sapiens
aggctcctttggaactgtcctcaaggtgctagattgcacccagaaagctgtatttgcagtgaaggtaggggcgtagataccacattagtctctgtttccaatcttgattccagagaggttgggaggaataaacaattcaatagcactatctatgagtcatcactactctccttttataggtggtgcccaaggtaaaggtcctacagagggataccgtgaggcagtgcaaagaggaggttagcatccaggtatgcacagagtcctggaaaggattgtgggaagagctaggccacaggtagggaaagtacctttcttgcccaccttcttttcctggttctgcctcatccatctgcttcagcctagtttaacactaaagtagatcctgggaaaagtatcagctctcaacacagttttcccatgtcctactagggaaatctctgaagcatgtcccagtgtattccttagtatttgctggttctaggattaccagatagtcagttccaaatattgagttcctctgaactgagaggtgaggcagcagttccccctctgcacatctgggtaaaacctgatttctcagctgcctttattctcaatgaccctgttcctccctaacttcctgttttctttgttcctagcgacagatcaaccatccctttgtacacagcttgggggacagctggcagggaaaacggcaccttttcattagtgagtgactggactctctcctcatcccccagggtctttgtaccatgttccccacctgagattacctctttggcttgttctgcctttgctctgtcccccttctcatggcacctctctgtcccaaagggaggggaacagcaggtggtatcagtttgggcaggaggcctacaatgccttgagcccaggcattgcagctcccaaacattgcctagacttctggcaatgtatgtagctccacactggctttgcagtgtgtagctactgcagcacagatctgtactccctttggtcggctgttggctgctttcctgaggcttccatccgtctctttgctgccgagttggtgctggtactgtgtaagtgaaacagtggtaaaggaaatggggagggaagatttaagttcggaagaaggagagtaaaaaattaatattaataatggaagttaaagaataggatagggatgggatgagggctactagggaaactggaaaggacagaaaagctgcagcataccccatacttgttatccacaggttatctccatgacttgggcatcatgcatcgagatgtgaaggtagagttaagtgcttttttccctttgtctgagaaagagtctcaataagaagtgccaacaagtccaagaagttagggagctgagaactgtagacattggggcccccatgggtgccaaggatttggggaagggctctctgagtatagatttgagtgctgagtagggcatcaccttcagctggggtgtatacatgatgaaagagagttgaaaggaagaggaagaattacttctcacctgtgatctttcagatggagaatattcttctagatgaacgaggtaagtctttttcct

SEQ ID NO: 85765 - DNA, 2913 bp, Homo sapiens
gctcctgccagtctgggcgacagctagctctccgcctcttcagcaaagttcggccccctgttgggggtatctctgttaaggagcattttgaggttagtaagcagtcccttagggacctgggaacaagggacattcaaaagccacctgtgtgttacacgatattaggagtaggtaaactgatgatggtatctgagcttaattgcttcttgaatctttttcctttttaggtaaatgtggtgcctctcaccatccagctgacacaccagttcttccacagaatgatgggctttttctttcctggccgaagtgtggaagatgatgaagttggtgatgaagaggataagtccaaactggtgactactggtgagaacttttatggtggagccccagaagaatagggtagcaaccccaaagacagctgagacttcagaacgaggatggatgacagctggtacacttgctttttcataggaataccagtggtgaagcctcggcagctgattgcaacagatgatgcagtaccactgggccctgggaagggtgtggcacagggtttgactcggagttctggggtcagaaggtcatttcgcaaatcgccagaggtaccaaacatgcccctgatgatagaaaaatgggagagtcttgaggtcctgtttggtgtggcttgggatttcttcggtttcctctaagtccattctagggataaaagaagagggagatgtttggggtcctgagtttcttctgatggattcagggctcacactccttgcctgcctttcttagcaccctgtggatgacattgacaagatgaaagagcgagctgccatgaacaactccttcatctacataaagattccacaggttccactgtgtgtcagctacaaggtctgcacctctcaagcactttgtagaacagggtgggaagggaaccagataagatcagagattctatacagggagacagctaggttgtttgtgatgctgagctgtgggtgataaatctgctgttccctctgctcccctcaagagtcagcatcattacgaggctgaggtaaggggaaatcagtatctgtaggttactattgtaggacttggcactcaagtggctggctgggactcaaaatggcagctgatgtattccccacccctctttttttctttcccctccccctcctcttacagggtgagaagaacagtgtggactggggtgaccttaacctggtgctgccctgtctggagtaccacaacaacacatggacatggctagactttgccatggctgtcaaaagggacagccgcaaagccctggttgcccaggtatcccgccagggctcatggctgtttggctaatggggctggcaggcagatcctcttttcaggagcctttcattttagaatccatgaataaatatccttgggaaggggcaggtgcatgaagtgagtggcttctatgcctaccctctccatgacctcactcagattattaaattcagtgtttactgagtgtttcgtatagcaccattgattttagggaactgagagctaacacaacctaaagtttagaaggggttataattagactgtaagcttcttgaaagcagagaccattgtatgtgaattgccccattgtgccttggatgtgtttaataaatctttattgtcttggttcattttgatttattctgcctgcccactaatatttacattttcttttactcctctccaatctgccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcatttttgtgtgtgtgtgttgagtgcatgcattcaatctgtgtattcctccctcatcaacccagaacatcctgcagctgccactctgagggtggccccttccttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaaggtaggctgtggggctctgg

SEQ ID NO: 85766 - DNA, 3401 bp, Homo sapiens
gtccacattgtactgggcatggtacaccccctatatgagttacaggatttagctgtatctggtaaggaccacagtgataagtccatttgcagttctacttagtggggataaaactgatccctcttttcacctccctggctgatgcttcttttatcaaggaccttagggcttaatccaggcaacctcaagtgtaataagaggtaatgagcatttagatcagatgttaagccgtgtaagggaccggttgttggtaatatgagaagtcatgctgatatataagagctgtggttcattcagacaagcagtgctctttatcagtagtcttaggaggtaagcacaggtgttaactacccatgcagaagtagaatggatgagctatcaggatctttctggcattttttgcacctctgctgcttttaggcatgccttcttttgtgggtgaactctttccccccgcccccctcaggctgcgatactagcattagagtggaacatcttgggcttaggtacaagggactttgatctggcctttcctatatttttttgagacttgtcagatccaccatctgctgtggtcttcccatctcactcaatgttattcactctgacttcagcttggcagagtgaataaaaataattcaattcccttcgcccatggcaacattgtcagagtggttatctatctgaagatagaaaaagcaagaacacaaatggaacaaataccaaaatgtgtgagaaagtcattttttttaatgagatattttgcccatgacatgattagatttgaacctttctcattgtttttctggctcgagacctgtgggcctggcaaagtgtgcatgtaactcagttgggttggagaatttgggtagactggggcaagagaatgagacaagtatgtcctctatcctgggagatatggttcaagctattccatgcagtggaggtccagatagtaagtgtaactacttgaaacatggagatctgtcacccaattgtccaggacaagccactcttttcccaggagctaaagttgcctgcatctctttcttcaggtgaagaatatcgaggagcaccggcagcgtagtctggactctgtgcaggagctgatggagagtgggcaggcagtgggcggcatggttaccacaaccacaggtcagccctccccctcctctgcatcaaatgattaggagcagatgtgcatcccaaagggacctcatttccctacctattcttaacgtcagtgtatgctggagtaggaccattttgtgctaggctgggttgaaagcagtgtttctggagtttctgagacatagctgggaggctctcacattatctttattgagaatgtctttttcttatctctttcccacctcttcccagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggtattcagggcttgaaaggcttttaggaagggactagagaaattgtgaaagtagttatttccttggtggttttgagacagtagagttattaaaaatccactgtgcactggcattaacatttcactttgctctactttttgtaagttctgctatgagaaaataacctctattcttggagggagctgggatgaatgggcattgtttatgattctgaagtaaacatgtttctgcccatgagcaactctcaccctttctgtggggttgactagtggggtggttccaaatgtgggttaagagatggagtagatatttaggtagaaacttgagccttttatttagctgctaacaattatctaggggctgtggataccttcacccttatccaccatgagctggaaatttccaccaacccagctcagtatgccatgatcctggacattgtcaacaacctgctgctccatgtagaacctaagcggaaggtgagcatgggcccttgtagaatgctggttagcctcacaggaacacccagactttgtgctttatttgggcttctgtaacaaaagccatgcttcacactgaaaaagggccttgtggttggtagattctcttagtcggcagtgacaattgaaattccacttacttaggaaaggcctgaatatctctcagaccgtagggcttgtttgcctgattgttttctcctagtcatttctctactcagtcacctagacacctctaaaaacatttactattccctgcttccacctccatcccatcctgttgggcctgacctattgtgaaatccacattgccacattttctgcattgacctactactgttgctattaccagtgacagataaaggttagctttctagaagagaccccccccatttctttctcctttctctatttcactttactacaagacttgtctacttaaaaatcatattcatttccctttccattcctttaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaaggtagtcactgcagatagatagtttgagaaccaggaagtctcctagaacgagggcggtctctcagtttctatcctggttccctagtctttgcaggatgacagcaagaatgagaatctgcttgacctgaaccagaagcttcagttgcagctaaaccaggagaaggccaacctgcagctggaaagtgaagaactgaatatcctcatcaggtgccccagcattctttccttgcccttttccagtgccccagctagaggcagttctctttcttgcccatgttttgactgtctttaggtctagtgtgcattatcaaaggctgatgtaggagtaggttcagacatctcttcctgaataagaaaatgggtagttgggaaggatcactttttttttttttagagacaaagtggtctcactatgttgaccaggctggtctggaactcccgggctcaagcagtcctcctgccttggcctcccaaagtgctgggattacaggcgtgagctgggattaccacacccagctgaaagatcactttggtggccttgatactatgcatctgaactgaaaatatctttttttttttaatgaacctgacataaacatatgaaaatgtcttgaagttgatcagtatacagttgcagataaaattgtaggaattattagtgggaagacactactttatcaagaagctatagagctgaaagatgggatt

SEQ ID NO: 85767 - DNA, 1837 bp, Homo sapiens
ggatctgaggagcttagacctgggagaaggaagagggcctggagacataatcaggggaagcagcagacctcagagaatataatgacattgatggcaagagagtggtttcaagtggaaaagagtggtcaaataacatgtaaaataatatgaaatgaaaaaagaaataaaatgggggtaagggagagatcatagagtaatacctaagagaaaaaaatgttacctagcatttctaagtttctgttgggaatctgttacttttattaaaattgaagggaaagtgaaataacccttgttttgccttcatgggtcaagggatgggctgggctagagttttaggtttgggaggatgtattctaagctcttacctagccagataaattgagggaagatcaatttggctctggaaagggaaaagtctttccctttgagactgtgacctttccctgcttcctatttctctgccaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcaggtaccttctctttacaagttacctcaacatcaggctagatcatgatcatattgttccccttcccccacctctaaatatgaatgggtgaatagagctccaaaaaatttggccttctcataggtatcataggtaatcacttctatgtctaaaagccagtaaaatttacttggtaagccagcattagacctagctgcagtggttgatacaatgtgctcactaacctcatcgtccttggtagcttaactctgcttctatctctggcatagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggttagtcagtgagtttgtgaaggcccattatattcctggttttccgtagactttctaatggctggaagattcttgacagtaacctgctgttactagcttagcagaataatgaggctaataacaccttgaatgtgggcaatctctggtctggaagcatgtagtgctttttttttttttcctcatggtgttctatttcattgcaaaagaaactctcatttctcagaactcgtataaaatggactggaactgtttttaagattgctgatccctattaatgttcacactaatcagcaggcagccaagaaaacaggcagtgactgagaattttcagtaagttcactatctgccctttctctgtcctctcatgaaaatgactgattggttatttcagcaaggcagtgaggttgaatgaaagactgcctaggagtcaggttatgtgatttctaatgatagctttcccattatagtagccatgagctcttggacaagtcacctttaatcgtgaaatggaattgatacttcaccctcacaagattgttgaaaggatcacataaggtgctttgaaaatataaagctttattcaggtggaaagtactcttatttttttttttaagtcagtatgtctggggaggtctaagtgtgtggcaaggtaatgtggttttgttttttttgtttgtttgttttttgagacagagtttgctctgtagcccaggctggagtgcaatggcgcgaactcagctc

SEQ ID NO: 85768 - DNA, 1137 bp, Homo sapiens
taaagaataaaatacagtaggtatagtttgaatgtaatataatataaaagccaagaccacttagtttttcttctccagggtctgtctccccaccacgcccagtgaatttttttttttttttgagactgcgtctctctctgtcgcctgggctagagtgcagtggtgtgatctcggctcactgcaacctccacctgccaggttcaagcgattctcctgcctcagcttcctgagtagctgggattaccagtgccagccaccatgcccagctaattttttgtatttttagtagagatggggtttcaccaggttggccaggctggtcccaaactcctgatctcgtgatttgcccacttcggcctcccaaagtgctgggattacgggcatgagccatggcatctggccaacaggtttcttattcaacaaacttttatcactgcctctgtggcactgggggcaatttccatgctaccctgaagtccttttcctgtttcttaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtaagctcggggagatgagactttttgggtttgggtttagaacatggatatgggcttggacaggagttttaaaaggactgagtcatggtgcttctatctaggtaaagaagtgaaactattatttttccttcttaggccacctaagtcttacatattaagtaacagtgatgttggggcattaaatggtctggtcctatggccagaagagaatcagaaggggagtgttggagccaaaacaagatgagtaagggaaagaagcaaagtggtaaatgccataagagagaaataaaagaaaatgggagttggatgggcacagtggctcactcctgtaattccagcacttttgg

SEQ ID NO: 85769 - DNA, 1008 bp, Homo sapiens
tggtcagcactacaagcaactttcctatacagccctctttccccagctgcaggtaaggcactgatgtccctgctgacatcttcactttattctgcttctagttttcttgtttctcatattgagtcccttaatcatccctctcatgccatcctttgttaatgttatgctctcttgttgccaggtacattattgggcctcatttgcccagcaacggggcatccagattgagtgcagtcagggccatgtcttcactcgggggactcagcggcttatacctcaaggtaaaatgaaagactcctttcatttctcctatcctgttccttgtttttcccttctcagttccattcccctcctccatctctgtcttacactatcctctgaactggtcagcatggtctctgtgtgcctctttttctcagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggtactccctgacacactttctttattaccttatttatattagtaggtatctcagcctacttgggctgccataacaaaataccagagactgggaggtttatacaacaaaaatttatttatgagttttggctactgggaagtccaagatcacggtgcccgcatggttgggttctggtgagggctgtcttcctggcttgcagatggctgccttgtgtctgtcctcacatggcagagagggagagagagcacaagtgtgcacgagtgctctggtttctcttattgtaaaagcactaattctgtcatgagtgccccaccctcgtgaccttatgtcattacctcccaaaggcccatctccacatactgttacattgggggttaggacttcaa

SEQ ID NO: 85770 - DNA, 3383 bp, Homo sapiens
ttgaagagaacttaaaaagtataagtgctcttaaatgtcagacactatcaactgtcagctcagcacattagtgctaacaggaacaaagcaaggcagtaattaatgtgattactcaggaacaacttctgggtggagatggttcttgagccaggtgtgcatgtgtcataatccttgccatctctactgttttgtgacatggtaattgacagatccttttcttctgctccctaaaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctgggtaagtagtgtttcctttatttgcagaccccgtgtttgcccgctgagctctggggagctctcagtgatttcagaggaactaggttatattgggaactgtgccgttttgggtgggtggagtgggatgggtgggcttcccttccctttctttgttcctgaatttcaccgtgaaattgcttggctaacataaagggaaagctaacacagtcatctttaaggttattgtgtctcttggatctcagtgctatgcccttaaccacctgctccagggtcactgtcatttttcagcttgctgtgtcaactgcctgcccttgttctctcaattgactttgtaaatatagatgggtaaaatagtggtgaggaaaaagataggcccgagagtgctcagactgcccctgagtagccagtgtgtacccttcctctggtaacagttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactgtgagtagagatgaggcagttggtttggctgagggacgtttgtgatgggtgaaatgggaggtgagctgagacccttctggagtgaaggaggaagagaggggtaatgttgtgaacaagttatagcctttgttcctctaccccagcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggtgaggggtgtcatgatacttttatcctatcaggatggtatggttgaggtctgtatagcacatgtgggaagagagacaggtgctgatttgggagatgaggatggttttcttacctatatctcaccaaattctcgggggtggtcataggatccatacaacacaactgaaaatatgcactgggagtggagccacctgtcttttcattggaaacctggtcagtttgtgttcaagggtgacttggatatcaacgtgagaacagcctctaagtgagtggagtgaagggagggtcctccatgggatgaggggctcaggttggagggagggggaagagccaaggggaagtgagtgaccagggcactgagggctggggttccattgtgaggcaggtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaagtgaggcttgggcctggggcagtggggaggaagggcttgggaggacgggcatggatgctggggactttagcttgaccctctggggaggggaggggaggggagaagggcaagggagaatctaggttaggacctttttttttgttttttggcaggggaaagggttggtgtcttagtcctttttggctgctataacagtaataccacaagtttggtagcttataaacaacaagcgtttatctctcacagttctggaggcttgaaagtcgaagatcaaaaagagctgatagattcagtgtcagtgagggcccattcctcatagatggtgcctttttgctgtgtcctaatatggtggaaggagtcagtgagctcccttggaccacttttaaaagggcactaatcctattcatgaaggctccaccgtcatgatctagtgacctcccagaggcccacctcttaacatcattaccttaggggtatttcag

SEQ ID NO: 85771 - DNA, 4593 bp, Homo sapiens
tatggagggctgactttttgtatacatgagttcccacagggacaactgctggacttgagtatgtgcggactttggtatctgcagggggtcctggaaccaaagctccaaggataccaaaggatgactgtatattctctaactaaatcctcagcatttcacaaataaggaaactgaagcctaggaaggttagctaggtaacttgactgaagtcatacaggcagtcagtagtaaaaatgatgtttaaattatttggccctaaggtccacattcttttcatttaccaacctgctccttgtactctttaggtttttagagactggagaaagaagtactgcaggtgcctggatctctggggcattcgccttatggtccatccagcttaggcatttgcttagcctactttatgtgggaggatttgaccatagaggccagggcatttcgggagaactgggagtgttaagaattgatggttcttacgttattcattcatattttcagaggtgacagaaaacttagttgagccaactctgcctggcctattccttctccagcagctgccagaccaggtcaaggttaagatggagaacacaagcgtggtattgtccatgaatagtcaaaagaggtgaggtctctcctgacacagaagatgggagagtgatagtgggagctgtatgttggtatctctgtaaccagcctagtatttgctgagcttgtctacggggagaaaggaagtagaaatggttacatccatgtagtgtgggaaaaattaaaaaaattattattatttttgagacggagtcttgctctgttgcccaggctggagttcagtggtgcgatcttggctcaccacaacctctgcctcccaggttcaagcgattctcctgcctcagcctcccgaatagctgggattataggcacgtgccaccacgcccggctaattttttgtattttagtagaggcagggtttcactgtgttggccaggatggtctcgatctcctgacctcgtgatccccctgcctcggcctcccaaagggctgggattacaagagtgagccactgcgcctggccaaaaaataattacttttaaaaaataaaagtaaaagaagtaggaatggcattccacatcttcctgagctggaatctgtctcggtccaggcacctgacttggactctgaagctgctgcagttcctgtaccaccgtgatgaggatcagctgccccttcgaagcttcacagcaaactctgatatggcacagatgagcactgaactgctgctggaaggttcatgggtcggggtactggtactgagcgagaatgggaggactagatactctctttgctcatgccccatatggtctccttaatctaatctcagtgtaactggggagtggaaggagggaacatactgagagaaaatagccccagctcacaagttttgatgacagtctgttgatccctttgccggcttctgaccctctcccagttttacctcttgcccttccagtgctctcctctgatctgtcctctggcctcttacagatgggttgttgttgtcccagagtcgccaacgcattgtctgcctcaactccctcaaggctagtgtgcaggtgtgatgattgtggtaccaagaattgttcctttctctattctcccgctacattatttcgttttgagtttgtgaaataaaacccaaacccacagttctggtcttcttatttcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaaggtcagtctgatctttttcagccaccttcttgtcagttggattctctgggattcttttggtccaaattggcatcctgtgttaaatatgtatttggttgtttgacctcctcaaatccgagtctcaacagcaatcctgttttatatatctttcccattagactagactccttgatagcagaatgctgtcctctttgtttttatgtcctcggtgctcagtgtagtgttttatacaaaataaatgtttgttgaactgaacttaaatgataaggaatgtctttgtcttgcctgcctttgattgtaaggtggcagtcatgtctttgtgtagtgcttctattgtgctgcacagagaacttaaggttatggtttagaagtgatgcttcttggttattttaggttcaagcgtatagtattgctggtgttcattgtatttggcctatgaaaatgataattttatatgagtcaacctaatatccttttggggttcctgcagattaccattaagagtagcaataaactgatgagttcagccttttatcttctaggtgtgtctcgtcctaagaatcacaataaaactctgaattctcactctgattgtgagagcttcagaaactgttccatgataggaagctgcagttcttttcttaccaaacaatgatgtcttgttcctatgcagaaccttcccccaaatcctggctcccatcatctttagcacctccatctccaatgtcaacatttccattcaacttggagatacaccaccttttgccttgggattcaattctatctctctgggtaaggctctcagatggaataggaacaagaatctgtccgttagtggagctaggcccaattgatggccacagtggctccatgcaatccctctttctcacctttgttcagattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacaggtaggtgagggctttggtgaataggggcctgcacagctttcctcatcctgtcatgcgtcagagcgctgagcatcctaatgcagcaggaagtgcattagggcattataaaactgtgcgcctgcatacttctaatgggatccgtctgcttcttctctagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtaagtgggacaaggagtctatactgaagtgtgctacttgggagactgaggcaggagaatcacttcaacccaggaggcagagtttgcagtgagctgagatggtgccactgcactcgagcctgggcaaacgagcgagactctgtctccaaaaaataaaataaaataagtaaataaatatactgaagtgtgtagtgtgtaaccttagcagattatgttggtttagtctgctcctcatttaatgaagctgattatctggaatttttctaaattagaggcacgagatgcttgaaagtcttgcataaatattagacttcttggtatttcttaagggcttatgaaaggcaagtactaagcaagacatataagaaaaagccttgatctagtcaagagagatccatataactttttatttccttgtgtgtttagttctagagagtaaatggtatgtctctgtgcaatttgtaggagttaaggaacaactttgattctgccgaatctagttaggttaagatgggaaagggaaagtttacttaaaacctaagaaatgaacttagggaggcatgaggaataaagatagttaagggaataagtgagaaaggcgagtgaggactattgttgccctttgagagccgggaaccaaggctgacatggtttctggttgttaggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggtaatgttcctgtggagaggtggggccaggctggttttttcctcagcttagagcctttctctgtctttttttttttttttcttgtcttttcccaaaacagagtgtcacatgttgcccagactggtcttaaactactgggctcaagcagtcctcctatcttggcctcccaaagtgctgggattacaggtgtgagccaccacgcccagcctctctttttaactcatgttgtgaaactggtttcatgagaaatatgacacctgatcttctttattttttctagctcgtatgtttttaactttttgtggaatttaaaatacatacaaaactagagagaatttataagcttttgtataccaagattcaataattaccaatt

SEQ ID NO: 85772 - DNA, 1143 bp, Homo sapiens
cctgggttcagaccattctcctgcctcagcctcccgagtagctgggactacaggcggccgccaccgcgcctggctaattttttgtatttttagtagagatgaggtttcaccgtgttagtcaggatggtcttgatctcctgacctcatgatcctcccaccttggcctcccaaagtgctggggttacaggcgtgagccaccgcgcccggcaaggccaagtgctcttaatttttttcctttcccaggctaatctgtgaggtgagcttatgtaagatcaacagcaaagttctaaagagtggtcagctggtaagtatgccatgatcattcagatgcctcatttcctcctgggcgtaaagtgtgaaggagcttagggcttacatcctaggttctttgaccttagggggttccctcaagtcagtacccagtgttccagatcaccacattttgacctaaaacttccaaactttcttacatacaccttagaggcttatcatccccacaggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcaggtaaagccccagtgattgagcttcttggctgccttgttctcagggtttgttttggaagtagaaaaaatagtggtctcactgcttatttagatgtgattcactagtcaccatggactttgaccctaaggatagttagaggaaatagggcatttgcttgtgctgagtggcagaaccagcattgagtgggcacctatcatgagttagacctgtactatgggttttttttttttcctttttttttaaaaaaaaagatggagtcttgctctgtcacccaggctggagtgcaatggcgtgatctcggctcactgcaacctttaaccttctgggttcaagtgattctcctgcctcagcctcctgagtagctgggattacagtcatccgccaccatgcctggctaatttttgtatttttagtagagacgggatttcgccgtgttagccaggatggtctcga

SEQ ID NO: 85773 - DNA, 1044 bp, Homo sapiens
tgaccaggggtgtaacttccgcagaaccctgagtccaggcctaagtggctaggcggactccaactcccctcaaagtgagctccccggaccgaaatgagtcagccaggtccaccgccagcccaggtagtgggcccggactccgacccccgcgggtccccgagccccgcggttccgggcaccgtggtgtgcgcccggggcgtgtttcagctcttggtccgctccccctcgccctcctcccggaaccacgcccgctcctcgcgcacgcagcccgtcggccctgcagcgtcgtaggacagggcgggactggggtgggaggccgttggttggctggcgggctgcggaaggcggggctcgtgtgcgcaccagcgcgtcctcgctcagcgttgctcctgcgcgcgcagctggtcggcccgcggcggtgctgcgcggatccggcgtcggggcccggcatggcgggggccggggccaagccgggccggacccggacctaaatgcctctgttcttctccgcgctgttggtcttgctgctagttgcgcttagcgccctctttctaggccggtgagggttcccggccgcgccggcggcggcggcggcggcgggagggagggggcggagaggaggaagaaagactgaggagggggcgcgcgccttactgaggcgcgtgaggcagagtgggtagggtggagggagggggcgcgcggcgaggggagggatcgtgaggaggcgcgtggcccgagctcccagggatgggctgcgagttggggagactgaggaagcgggcggggtctgaggaaatgctgaggccaggaactgaataggagtgtgaggaaggggcctggttcagtggcttccctttccccctccacccacccctgcatgtccctttcgccaagcgcgatgggcacctgcagcatcggtctggggagaacagcattcgagctgccgggtctgacctcaaagtgccttctcgtggatacctgtctggagggtgggagcaggagacagacagaccctctggggagtgtgatggcacatgtgacaga

SEQ ID NO: 85774 - DNA, 1146 bp, Homo sapiens
gttccccacctgactcctgcgagaaacacgctctccagtcggaactttacctgtctgaagcccgccgctcctccagtgcgctaagcccccaccgaggaaaatggagtcgtcgaaccgagactgggaaaagatagtacggacccaccgcacggcccctccgccgccaccgccgccgctgctgcgtcaacgtgctacgtcatttccggctccctgtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtaatgctggggaccgggctcgggtgggctagggaggactcggaggctctggaggggcggggcctatagaatatctgacagtgtggtctgggaaagttaggggttccctgggaaggttcctcaggtctagagagtcggagaactgaattgttctaaggcatcttaatcgcaacaccacctaatatttggtgagctacaggccaggcacgttacctatgtcctttttccgattattaacattgttgtaaggtggacagtattgttatcctcatttcacagatgaggaaacagacgcagagaaattaaatcgtttattcaaagccttgcagttagcaaatgacaaagtcggggttctatccaaatctatccaggttcaaagcctgctttagagacaagaaaattacagtaagtgctgtgtctgaaattttaaagttacagtaagtactgtctgtgaaactttaaactccaagagctcactc

SEQ ID NO: 85775 - DNA, 1036 bp, Homo sapiens
tgctcttccatcagctgtgaatttagagcccttttttacgagtaatgtccctttcaccagtacaagtacatttttattcacttggcttgtgtggctgctagattggattagcatagccttgcaactctaggaggttttaacttcatcaggagattaattacatcagaaagtggtaccgtctggagaggcttagtcaaattttacagttcttcctctgaaagcctacctagtgtggtggaaacatgatctttgtaggcaaatacgtttgccctgattctatattcttgaccttaataaatggcactaccatcagtcctgcctgtaatccttgtcttccttcctgtccactatttcccaataaaatcagtcaccaaatcctgtctctccctgaaactgttcccatcagcatacaaattatgttctggtatccttcacatccctctccaattaccatgccaattttttaaatttccattcatagatttctacctgtaccaactcagctttctcaactttcattcactcttcattttataccaatctggcttctcttctgcccactccatttttttttttttttttgtggagacagggtcttgctctgttgcccaggttggagtgcagtggccccatcatagctcactgccacctggaactcctgagctcaagcagtcctcctgaggcagcttctagtaatcaagtgccaccacatctactttgcccactccattgaagttgctcttatcaaggtcaccagtgacttctatgttgccaaatccaatggatactttgttctcatattcctctgtctctgcaatattcaacatagttactcctgcctccaaactttcatcttggctttattgacatttcactcttggattttctccatttctccggctgttccttctgagtctcatttgctagcaacttttgctctctatctaatgtctaaatgctggggctggtcgcagtggctcatgcctataatcccagcactttgggaggtcgaggtgggcagatcacttgaggtcag

SEQ ID NO: 85776 - DNA, 1040 bp, Homo sapiens
gaggaggatgagggcagtgactctggtgattcagaagatgatgttggccacaagaagagaaaacgcagtgagtagtctgtcgttggctcaagtgaggcttgggtggaggttgcagtggaaaagggcaaccccatcaccatgggcaacactttgtttcttcagcctcttttgatgaccgcctggaggatgatgattttgacctcattgaggagaatttgggtgtcaaagtcaaaagaggagtaagtgtcattctttgtcttttgtccctgggggtaaaggaaaaagccctggaaatttcaatgtctgtgggtgaggaggcacacgcaggacagtttggagaacattagagcacggtgttcggtatcattgtactacggagcctagatttgcatcccagatctgggtgcctgttagagaaagtcttgtccaagtttcaaggatgggctttgaggctacaagagcatcactcggcatgttctttcccatctctcttggtcagagtaattgtggtgggaagaagggagtgagactggagatttggtatccgtatgccagactcctcagatcctgataaggcaggttttcccacccctagcaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcaggtatgttatattgggcagggaagccagtgtttggatgggtattgggatttcctggcccatgggaacaggatggaaaccattctttagctacatcccccagcatttgacacaaagaagttccttttcaggagcttcccttctctgttgctcactggccactcacatagtaggaaccaaagcaatttagtcctggctcagcccctgactctgagccccaacccatccttttcctacccagatattgacgacttc

SEQ ID NO: 85777 - DNA, 1618 bp, Homo sapiens
cctagaggcagttgttgcagtgagttgagatcatgccactgcacaccagcctgggcaacaaaccgaggctgtgtctcaaaaaaaaaaaaaaaaaatcaagaaagaaaacccaggagacttgacagcccatggcatcttgaaggaggcccttggctgggtaccctttgaggcttctctcctaatgtgtcagatccttgggagtgattggaaactagaaccctaaatctccccatgttttcttcccaggtgaaggtgacgaggcagaagatgaggagcagagggggcctgagctcaagcaagcctctcgccgagacatgtacaccatctgccagagtgctgggctaggtaaaagctagctgctttgggatttaggcattctagcctgagcaaggggagttacccagaaaaaagactggtaggtaggaaaaagaaaggctatctgggtcaatcaccaatccaatcctgaactagcctattagctggtctttaaaaatactccctctccaaacccattcccgcccgacatgatggttcagcctctccctaatttcctgagataatgggaaactcatgattggagggagagagtccagtctgtctgtttcttctgccttataacagcccatcaagtgtttaaaatcagttttttcattgttctttgactacctggtcctgctcatttatggcctctttaaattccagtgctctagctgggcacagtggctcacgcatgtaatcccagcacttcggaggtcaaggtgggaggatcacttgagcccaggatttggaggccagcctggtcaacgtagcaaaactacaaaaaatacagaaaaaattagccaggagtggtgggacacacctgtagtcccagctactcgggaaagctgaagtgggaggatcacctgagcccaggtggttaaggcttcaatgagccatgatcacaccactgcactttagcctgggcaacagagcgagaccgtctcaggaaaataaaaaaggctagttcccagaattccaactccagattctgaaagccaagaggtttatcagcctatctgctgccttacccttcactcttctgtttgctttagatggcctggccaaaaagtttgggcttactcccgagcagtttggggagaacctgcgggatagctaccagcggcacgagacagagcagtttcccgcggagcccttggagctggccaaggattacgtttgcaggtaggcatgcagcaggtggctgacaggaggaggggcctgaggaccacaacaccctggtcctgtagctgcaccattttccccacagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggtgagctgggtgaagggctttgatccaagatgtgcaccagctctttctttgattgcctgagtttcttgccttccacttcactgagctgtgtgtctgaaagcagaaaggctgtcttttctcctggggcctggcccagcccatccgcaggctcatgattcccc

SEQ ID NO: 85778 - DNA, 1027 bp, Homo sapiens
ctatagttgggcatgaaggaaccccttaggaatagtcccatagctaatggagaaacacggggggcaggtgaagcataatctgagagggaatgctaacaaggccacagggaccacctctaagacctctctgctccaggagcttctcccctcccccagccccactcatccaaacattctttgtttatatcactgttctctgtatacactcctgtttccacaagcaagatatgccttcaggtggtaagcctgccaatggctaggaacatctgcacataagagtacacaccctcgcacatgtgtgtatgagtgtgtttccatagcactcttggtgagcctgatgaccataatgtcatcatgtatgtaatacctgttgtgtctcttccctcaggcctgtagtcgaaagctctacaattggttgagagtggcaccctaccgaccagatcagcaggtggaagaagatgacgactttatggacgagaaccaagggaagggcattcgagtcctcggcattgctttctcctctgccaggtaacagcctatttttgcctccccagcaccatctcttgtcttcctaatttcatttttctctcattcataacttcatattgctgattattgcattcttgtttttctgtctgtctggcagagatcaccctgtgttctgcgccctggtcaatggtgaaggagaagtgacagacttccttcgactgccccattttaccaaacggcgaactgcatggagagaggaagagcgggaaaagaaggcaagtggctaggacgaggatactaagtgtacatctggagtatgtcttatgattcagtggagataagtgtttacggtctaagcaacatcctatgcaagactgattgtgtctgatctggtcactgacttgtcccctgggatgcctcacttccatgagcagtagatggcactcaagttatctagtacgggatttgcttctggcttgaggccagttcctaggccttgtgtgcttctggagttgctttaactgcctcttttcttacc

SEQ ID NO: 85779 - DNA, 1118 bp, Homo sapiens
ggccaactttcaggaagaggtgggaatagttccttggtagcaccttggaccagatatcttctgaagacttccagttcttacaagatctccaacatagggagacagaatttcctgaaatctttacatcctcagagccattcagcttcaattttctttcaatccaggctcaagacattgaaacgctaaagaaatttctcctgaataagaagcctcatgtagtgacagttgcaggagagaacaggtaggtagggattagaccacacctggtttaaggccgtgacccaactcatcccttattattgagtctggcatatgcccataacagatggggcttgtgcttgtgcagggagtgtccctggggatgtttgacctcattttcttcaaagccctttcctcccctacctcttcacccccaaggcagtcatgagactgtccatccctaagaaaacatattcattgaccaacactcatcccaccagggacgcccagatgttgattgaagatgtgaagcgcattgtacatgagctggaccagggccagcagctgtcatctattggggtagagctggttgacaacgagttggccattctctatatgaacagcaagaagtcagaggtaatgctggagcctcacccttagggcctgcccaggcaagtgctattaatcccaaagagattaaattgggaaacaaaagttatcaggggcacaggactgtacctgtgtacttatccatgcagaagttctccgttttgcagttacggttcagattgggagtcccagaaattaaatcggtctcaggaaaaaagatcccagagaagcagagaaaatgatttaaaccagaatggtttggatttcctcttgatgttgtagctaaggggattttaaggccctgctgaccctcgtttgactctaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggtgagtaggatttgacaggcaggctcgggtgaagggaaaggcagagtaaccttactcctgcctgctg

SEQ ID NO: 85780 - DNA, 1235 bp, Homo sapiens
gaccagcctggccaacatggtgaaaccccgtctctacagaaaatacaaaaattagccgggcatggtggcacacgcctgtaatcccagctgctcgggaggctaagacaggagaatcgcttgaaccctgtgggtggaggttgcagtgagccaagatcacaccactgcactctagtctgggcgacgagtgagactgtctcaaaaaaaaaggagggggggtgttgggggagtcaacctttgatggcaccttgggagcagtaactaggcaacttcatgggagaagagaagagtgccagggacagggtagatccagcaggcttcagctggttttcctgcccagagtggaggcattagtgcagggcttggcctgtagtctacagacaagattccaccccaaactcccagtctgccattcagcagctggctggctttgggcaagtcactttacaccttacacctttctgcctggactttggttttctcatgggtgaaatagggcatcgggctagatcatctttgtcccttccagctcaaatgttctgtggatctaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccagtgagtgtgcctcccaccatctctgtgcaccctgcatcttggcagttctcccagtgcaggattcaggccacaggatgcacatgtgtcagtctcccagtggaagtggggactcagctttgaggtgctaaggcctggagatgtcatgaaaaagtcataggtagggctggaacccagagtctcttgggtcacattttctttgctaatgccttgtgactcttaaagcctcattctttcagtgtcctaggagcccaggtgaacatgtccttcatatcagctaatccaagcccagagaaggtgaaagagtctcagaatcccatagtgggtcagaaattaagcccaaacagggtggctcacggctgtagccctgcactttgggaggccaaggcaggaggagcacttgagcccaggagttcaagaccagcctgggcaacttagtaagacaccatctctacaaaaaaaattttttaaatagccaggagccaggtgcggtg

SEQ ID NO: 85781 - DNA, 1901 bp, Homo sapiens
tttgggaggctgaggcaggcgggtcgcttgaggtgaggagttcaagacgagcctggccaaaatggtgaaaccccatctctactaaaaatacaaaaactagccaggcgtggtggtgggcgcctgtaatcccagctactgaggcaggagaattgcttgaacctaggagggagaagttgcagtgagccagaattgcgccactgcactacaacgtgggtgacaaaatgagactgtctcaaaaaaaaaaaaaaaaaaagccaggcatggtgatgtgcaccggtgtattcccagctattttagaggctgagacaggaggatcgcttgagcccaggagttcgaggctacagtgagtcatgatttgccactggcactccagcccagatgacagagcaccccaactcaataaataaataagaaatgaaggcctggtttgtcctgttgctgccagctcctagccccatcacccagtctgtactgcttttctgcccttttcagcatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggtgagagccagtgcctgcccacctcccatcccactcctgcttccagaaaggtgcccttcagggtgctttcacctgacattagtaactcgggtcataggtattttagctgtgcacagcaacaaaacgggaggtggtttgcggaatgagtcatttgatatcaattttattttgtcccctccttccgtgtcctccaaatgttaaaatagtctacctagagagagccaatggaggaagaggagaaaatacacatatatacgcacacacatatatcaagtttctcttttctgttttcagtgaagagaaatctggtgaattttcctgttgttcccaagcactaggggagaatcaaagccaggatttaaaggactttatgccctgtgagctaatatatctggacatgacacagatggataaactgaggggactttgctatggactgagaagcccatcccctcccatggtttttcttctggatggatttgatcaagaatctcagctctggatatgacacatggggcctttaccttcttcccacaggaattcgaagatttggatgagattgttgctcgctatgtccagcccatggcatcctttgcccgggaccttctgaatcacaagtattatcaggactgcagcggtggggaccgcaaggtaagcccagggccctctgaggaatgacacttgccaatcacttaaggatgtacgctttcccttcagtataggggacactcaggcggtgaaggaagtgtacatcatgtgtgcaccagacgttgtgtaccaagcatgctgctatcccaacctctccccctcattctacccccagaaattagaggagctgctcatcaaaactaagaaggagaagcccaccttcatcccttatttcatctgtgcctgcaaggaactgcccggcaagttcctactgggataccagccccggggtaaacccaggtgagcactagtgctgagaaggtgctgccactggggttcataggcaggctagaaggcagggagaggcccggagcagtgccctctctggctctgctggactgcctttctcctctcatctgtttagaacagaggtggaggttggaggtgggaaaagagggtgatgatttcaaggcaaaaaggcaaggattcacataagaagggcgctttccttaacaccgtgag

SEQ ID NO: 85782 - DNA, 2453 bp, Homo sapiens
cacacagagggccactgactccttggtcttcaatatgttctgccatgtgctgctcacctcccttcacaggcctggggactggctgtgtcatctctcctttcccctagcacccagaatggctacttcacatggtgggcatctgttctggtcgctcttgtggtgggtcccaagtggtttctgatgcatgtttccttctaaaatcctaggatagaatatgtaacggtgactccagagggattccggtaccggggccagatcttcccaaccgtgaatggactgtttagatggtttaaggatcactaccaggatcctgtaccaggtgagttctgctcttcctgacttcagggacgtggctggaggaacacctaggacctgactcagagtagtcccagcctaggggaccaggtgaggagtaggctgtcactgcagctgtcttactcctcctgcagcctcccagcaccaggaaggttctccatccactgtgcctatgcagcttcccttcctccctctacctacttcagtgccccttccaccccctgaattgggaaaccaaaaataggtttctggagggatgtaactaaataatcacttcctgcaggcatcacccctagcagcagcagcaggacccggacacctgcctctatcaatgctaccccagccaacatcaaccttgcaggtgaggagcttgagcctgggactggaggtgggaaggatggagctaaagggactttcacctctaacatgcccctccccacctctgtgtgcttacagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtatgtggcttggggaggaagctccctgtgcagggtggggcccatagactgccctctcgcattgcccacaaggggcttcacatgcacagatggggctgccacggccttggtaactgtctccaacagatatttcttgtccttaggcccatttgaaggggaagagggtaagagagggcataacctttccacgggcctttgggatctttggaacccgcaagccaccagaaagttgacatggtcaggaccagtgggcaccactgtgtgctcggtgctgacctgcaggcttcccactgctggtcagaagcacatactcagtggaagatcatctggaaagctttgctgagcccacccttgcgcttacccagaattcacagcaaggccaaacaagccccacacccatccctatttaactgttcatgcctctccaggtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtaagtatctggatggtggcacagtgcaggtcagtggtaggggcaggtgttgtcaagaggccgaaaggcttagcagaggcaggtgctctggatcctctgagggccctgaccacatgatatgccaggaacactagtttctgggtgaagacggaagagggcagtatggcagccagctgctgctgtatctgccttatcccagtagaggggctgctgcccataggtatgaggttcctttctgcaagggtacagtgattggtgggaagacttccttctagcaaagtcccaatctcaacttttcttcccctcccaggtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtgggg

SEQ ID NO: 85783 - DNA, 1035 bp, Homo sapiens
catgaaggcgcagccgggtatagaggtgcaggggagagcagcctggggagtccctatctggataggctccagcctgggtcggggcggtcctggtgcccggtgaagcgtcaaaagagggagcctgagcggggcaacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccaggtaggcgccggggccacgtcgggcttcagtctacagcccggggtgtgggcgaggaggaggcggcaccagaccagttagaggactgggcccagccctgccacccagctaggcctggtgcttctgggtggtccctgcac

SEQ ID NO: 85784 - DNA, 1358 bp, Homo sapiens
cgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagttggtcgctttcgcctctggtatcgtgcatatgatggaaaagttttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcctgggcaataagagtgaaactctgtctcaaaaaaaaaaaaaccctgagtctctcaaaatttgttaggttaattattgcttca

SEQ ID NO: 85785 - DNA, 2277 bp, Homo sapiens
gagaccatcgtggctaacacggtgaaaccccgtctctactaaaaatacaaaaaaaattagccgggcgtggtggcaggcgccgctagtcccactactgagtcccaggctgaagcaggagaatggtgtgaacccaggaggcggagcttgcagcgagccgagatcctgtcactgcactccagcctgggcgaagcgagactctgtctcaaaaaaaaaaaaaaaaaaggaatttgcccctggcccgattctcctgcctcagcctcttgagtagctcggactacaggcgtgcaccaccatgaccagctaatttttgtatttttagttgagagggagtttcaccatgttggccaggatggtcacgatctcttgacctcgtgatcagcctgcctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctcccaggcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctgagcaaccaagcaaggccctttttaaaaaaaaaaaaaaaaaaaatcccctggacctttcagcaggggaaaaaggttccttgacttaaacttggtgtaggtttagcagtgtgtgtgagccttgaggcaggaattacaggctgctttagttacagacctttgtgtggacctgaggctttctaggacttgattgggggttggtcctcattttctgggtccctacttctattgggaaaggcaactagagtgcgacacgtggcagattaccttggtttaagtcttaatgtggcctgtggtgtttcccataagagaattggctttgtggcttcatggtgtcctctgggctaatgatggaaaaatcattattggaaaagaatgacatgaacaaaggaaccactgaagtgccggaggactggaggaggaagggggagggtgtgggggcagtgagggtggcagggactaaggcttccttctctaccctaggcctgatggagagaagaaggcatatgttcgactggctcctgattacgatgctttggatgttgccaacaaagtaagtttccttcctacaaaccccttaatgctcaccccttgggtgcaaatgatgcatatgttagcgaccaaagcctgatctttgctgattagtcataattaactgactgcacccctatccttgacaaaccttatcctcacattcctcattttgctttctaaaaataacattccagcttaatcttcatatttcaactccagtaacgaggctcccttttgtttttcagattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccc

SEQ ID NO: 85786 - DNA, 1029 bp, Homo sapiens
tctgaagtccttgtcctttattgggcaaggggtgagggaagcagacagaccggttggacatagtagatgggtgtgtgaggacaaaatgctaccagagagccagccaatccacactcccctgaaatggatgctaacacccttcaaaccctgggcattggtttcatacacagcctcttccagggataaaaggggttcttgtacagcttgttactcaaccatggaggcaagttctgagttctggttttcctaggacactaactctagtcacaaagatctctggaatgatcatacatggtggagtggcagggtgaggtatttcaaaaggataagtagaacaggagtcttgcccaagccctgtcatgtcagtgtgtgtgtgtggcctcccagcccaaccagaaattgacagacaggcatgtatatggtgaaaagatatatatatatatatattcagaattaggcagctggactcagtttagatgatcccaatctgaaaaacaaaagggagcctcgttactggagttgaaatatgaagattaagctggaatgttatttttagaaagcaaaatgaggaatgtgaggataaggtttgtcaaggataggggtgcagtcagttaattatgactaatcagcaaagatcaggctttggtcgctaacatatgcatcatttgcacccaaggggtgagcattaaggggtttgtaggaaggaaacttactttgttggcaacatccaaagcatcgtaatcaggagccagtcgaacatatgccttcttctctccatcaggcctagggtagagaaggaagccttagtccctgccaccctcactgcccccacaccctcccccttcctcctccagtcctccggcacttcagtggttcctttgttcatgtcattcttttccaataatgatttttccatcattagcccagaggacaccatgaagccacaaagccaattctcttatgggaaacaccacaggccacattaagacttaaaccaaggtaatctgccacgtgtcgcactctagttgc

SEQ ID NO: 85787 - DNA, 1031 bp, Homo sapiens
gcagctgctttcggggagagtttaggtataaactctgggcgaaaggaggagcagctgagagccagcgagggaagttaagcggagatgagagcggggagggagaagagggtagtaatagaggaggggcgggaagaagcgggggaggggaaaggtgctgcgggcgggaggaagaagccgagaaaacctgaggcgcaaggacccagggaccaagccgtttgagtgttttcctcccctatggctccaaggttacacattaacccctgtgggactcttaagtcaaccaaagcccagtcggtttctaggtgagaacacgggtgtcctgggtgagcggctttcccgcccctccccttggctcacagagctgctctgtccgccggccgacaccggcctgagccagcgcccttccagcagtcattccacgtgggtgggtttggatacccttgcgagagccaggacaggggcagaagataaaacgcccctttcctcacaccccttgcccactctgatacagggacgctaaccttcagctagtgaccatcctcctcctgaatactgatgttttctttctttctttttttttttttgagatggaggctcactctatcgcccaggctggagtgcaatggcacgatctcggctcactgcaacctccgcctcccagattcaagcgattctcctgcctcagcctcccgagtagctgggattacaagcgcgcgccaccgtgcccaactaatttttgtatttttagtagagacgaggttttaccatgttggccaggttggtctcaaactcctgacctcaggtgatccgcccgcctcggcctccccaaagtgctggaattacaggcgtgagccaccgcgcctggccgaatactgagtttttctagagctcccgcagagcaggagcccgggagaacctggaattaacctcacttccggtaaagagcctagctggtcacactaaccagccccctgcctctaggcttttgccttgagctcatttcggcgaaaccgcggtctttccttctcccc

SEQ ID NO: 85788 - DNA, 1018 bp, Homo sapiens
ccttggcttgctttgagaagaagctgtccccaaatgggcttatgcacagagcccctggtcttccctccctgcagggctgtgatcccagcttctatcctgcaggtggtgggtaccccatgctatatctcccctgagctgtgtgagggcaagccctacaaccagaagagtgacatctgggccctgggctgtgtcctctacgagctggccagcctcaagagggctttcgaggctgcggtgagtgtatgcaccctccaggggacaactgagaaatctactgcctcgcccagcagcccttggctcaagccacctcaggtttctcctctagctgagtcatgtctctcccttatcagattaccccaggggagggctatgggtgtccctcagactatggatttctgagagtaggtcttgcctcccattagacggagggctcctgagggcagggctgtggctttcccagaagaccctcccaagagcaagacttgagttttcccagcatgctggggtttctgaggatatagctgcagctcccctatcagactagggatcactgaaagccaggttggactcccctgtcagtctgggagtctcctcatcagactgaagtctcctgagggcaaagctgttattgtttatttatttattttttttattatactttaagttttagggcacatgtacacaacgtgcaggtttgatacgtatgtatacatgtgcgatgttggtgtgctgcacccattaactcatcatttaacattaggtatatctcctaatgctatcccttccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagctccatccatgtcctacaaaggacatgaactcatcattttttacggctgcatagttttccatggtgtgtatgtgccacgtt

SEQ ID NO: 85789 - DNA, 1048 bp, Homo sapiens
cagggtaccaaggagaccgtgagtccccctctgacctccagagcccaagtcctcctcaccagtcacagcagctgagtgagcagtgcccaggtctatactcagcagaggctcctggtccaggggtgcagagcctagtagtgtgaagctcagggcctcctccacttgctggtgggggacaggctcctcccccagggagaggtggtccaggcccagcttgttgaacctgagggcagagccagaagccaaatccaactgacagacagtttgggcaggagctggtgcaccaggagacagatcccaccctgggttgaaccaatagcaccctcaaccccctcaattctggtctttggtgaaaggtaggcaatgatggacggagcacttgcagccaaggagagccaggggcaggttagtcatcctgatgatctattcacctgttgctcccacaggctagggcttggccaggcacagtgaggatcatggaggaatcgataccacatacaactcgctgagcttcctgtcctgggggcatgggcacctgctgggggcagctgtgggactccctggtgcctagccccagtctgcctacaagaagaaacccagaaggagttaatttgagctttagtgggggtgatgcccgaatgaggagggcccactgaggggagggaacagcatgagttctctgttctctcagtcccaaatgcctttcctaggcccctctgctggttaaaatcctccttctttattttttatttttatttttcgagactgagtctcactctgtcgccaaggctggagtacaagggtatgatcttcactcactgcaacctctgcctcctgggttcaagcgattctcctgcctcagcctcctgagtagccgggattacaggcatgcaccaccatgcccagctaatttttttatttttagtagagacggggttttaccatgttggccaggctggtcttgaactcctgaccttgtgatccacctgcctcggcctcccaaagtgctgggattacaggcgtgagccaccacgccggctcaaaatcc

SEQ ID NO: 85790 - DNA, 1020 bp, Homo sapiens
ccaaaagcagagcaggggttttgccagccctgataccccatgatgacacaatccaggagacagctgcaagtcatgccttgggcacctgcacttttcagagcattcagaggagaagcaatatcagggtggtccagaggtgaatccgggtgcctcagggggggaccggctcatctgtgaccgctggagggtaccgaagagaaacccttgcagcttctgagggcagtgcctccagaaatcatcacccacctcccactcccactgggccctggattctggaccctgttaggccagaaagagagtttcagcatcaacgggactcagcagtaggagaaagaatgcatgtgagccctggggagcagtggaggcagcccttccatgaggcccaagaagcaccagccttggccaccccaggcaggaagcttgaagcttttcaaccgcagcttctgctttttttatctgggggctaaagatgcttttggtgatgtggccatctgtgaacactggggatgggagtgtggacaggggccagctgggctgtgtggtgaagtgggaaaagttacaactcacatcgaacagccaggagggtgtttccatggcaacaggacacggaagtcaccgtgtaagggtgtgtctcatccaactgcactggccgagggagtccggcatcctcatccctccttcccaatcgacctcgcgcccctttgccccaagagtacacttcgctctctgccaggaagaatccccaggagggaagtgggaagtgggcacagcccgagcaggatctcccctcccacattgccaggatggcccctgggaggctccagagtccagtggccctgaatagcaacccccaccccccactgctcatggcactgtctgcccccaccatgctcagtcctcacctgccccaatagctacagtgaaggcatccccacaggctaccattgccatcttgatgccctcaaggccttggaccttacagggtgcccgactgcctcggcgagtattggtgcccaactg

SEQ ID NO: 85791 - DNA, 1041 bp, Homo sapiens
gaggcccttccccgtcacctgagagccggcgcggcctcagccttgaactttgaatcctgggggaagaggacaaaacccgctcccgcgtggcagtttgagcctccggagctttcccccatctaacctcttctgattcttcgaacgttcagagaacggtagctattgttctcccatttcacagatcatgaaacgagattcaaagaaaggctgcgacttgcccagggtcacatagttacttaaaggcttaactaggatttaaacccggactgcttatgatcacacaatggaggaaggactgaatcctcccccgaagaaggacccctctaggcggctcccctctctcccgggggctggagtaaggcgggtggtccataagtcatgaagaagggggtcgcactcgtgttgttactgaactcccgctgccctctcaggacgcaggttagcccttggctcttgggcatccatcaagtttctgggcgccctgtatgtcttgaatctcctgctcacgcagggaacccctcaggcccgggtgtgggaagcagggtgaaggagccccgactcttcggaggtcatgcccccagagcgcaggggaaggccgagtcggccactgcctggctgtttgctgggacgaggggatcgagggcctggcagggatagtacctctgagacgcctgcctccggtgctccctcccgccgtgcctccctccctcgctcggtcctccgtagctcctactggcggaaatctcagcaggccctttgttttctgttccccacagcctgggccggctcctgccctcacatatgctccggcacaagctgcaggactgccccctccccctcggcagtgtacacatttactctcctacagacacagccccattgtctccgccactgctcttccccggccctctgggttccagatgaggccagctgagccccccgacccccccacagctgacccaccctgactgcctcgggaaaggagcgggggagggggccgtcaggccggattccttccaccaccttcttggcccccctctc

SEQ ID NO: 85792 - DNA, 1439 bp, Homo sapiens
cctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaaga

SEQ ID NO: 85793 - DNA, 1052 bp, Homo sapiens
tgggaacaaagagactgttaacattaatgaggcacaccgagtgggcatttccgcagtctccaaaggcaggcaggtttttcctctttctttttggaaaatgacagctgacatggaccaaatacagactatttttggctctcaggactgaaaggactgaaagatgctctgaatcctttcttctcaattccctccctgctgccctgtcattattatcttccttctcaagcaaataaataaagcctttgatcctcatccagtcgggcatagagtaaactgtaaacaaaagtgaacttgtgacatggggaaggggagagatgttggcagcttattcctctgctcctgaaaggaagcattctgtctactgttcagggtgcccacccagtgggcaaagccccccagctgccaagatgcaagggaaagctgatccctcattggtccctgcagactgaagagtcgtagctctgggtaccctctagactgaagggccaccatggccctgacaaggagctttgcttagaacctacccccaagccacatgggctggtagagttccagaccctgcatttctctcttttttttttttctttttctgagacagagtcttgctctgtcgcccaggttggagtgcagtggtgcgatgtcggctcactgcaacctccgcctcctgggttcaagcaattaatcctcctgcctcagcctcccaagtagctgggattacaggtgcttgccatcacgcctggctaactttttgtatttttagtagagacggggtttcgccatgttgcccaggctggtcttgaactcctgacctcagatgatccacccaccttggcctcccaaaatgctgggatttacaagtgtgagccaccgtgcccagcgaccctgaatttctgtgtagggggagaactctcggttacctctctgagaattggccaaattctggttctgcaagatatgagactttgaaagatgctttgctgttctgatctctacttacctcatttataaaatgtaaatgatgatagtgcctgcttctacagcaatagtgagga

SEQ ID NO: 85794 - DNA, 1050 bp, Homo sapiens
tcccaagtagctgagattacaggcatgtgccaccatgcccggctattttttttttttttttgagacaaagtttcactcttgtagcctaggctggagtgcaatgacgcaatctcgcaatctcagcttactgcaactccatctcccaggttcaaacgattctcctgcctcagcctcccgagtagctgggactacaggtgcctgccaccatgccctgctaatttttttgtatttttagtagagacggggtttcaccatgttagccaggatggtctcgatctcctctccgcctgccttggcctcccaaagtgctgggattacaggtgtgaggcaccacacccagctaatttttgtatttttagtagagacggggtttcaccttgttggccaggatggtctcgatctcctcacctcgtgatctatccacctcggcctcccaaagtgctgggattacaggtgtgagccaccacacccggccataggttttgtttttttttttaagtgtgcatgtaattactgacttcctaatgaattggaggaatcacctctcctaggccaacactttgcaatgtaactcattcttatgctttggctagcctaacactttgaaatcaattcatagtgaaaatcctttcaaagtgaaggataagacagcaactataagcaaggtaaatccgctgggaaaatgactatacataggcaaaggaaagcttgaagtggtcagacttttattcccccaggggagagctgtattattcacacagagtaaactgtatcaaaacacaatacaactaatgatggaatagttacctctcattctcaagcaatcctagcacagaaaacccttccccttgtatcctcattctctccctgaatgtaagaagtaaaccctgactttaagcctactctcaactcatacctttcctaagtcagttttcatttggacacttgtgctgtgacatcttttggaagctgggcatcatacagcccgcccaggtctctagcaggaagcatctccctgctccctatattattttgaattttctgggaaaa

SEQ ID NO: 85795 - DNA, 1044 bp, Homo sapiens
catgagagcaatttcatgtttgtccacaaattatcattagcagtttcatttgcagattgaagaagcaggaggaatgggctctttgccagttacagcttccctccgcttagggtgttagttcaattatgtccaattaacttttattgcagatagtgatgataattacttgcaagtcagtttttggctgcagttaaaccaagactgaagtatgaacttgatggattttaataaccggtatgacacatttcacaccctcactccactgcagttatttctttttccaggcctcttttagacaagaagtcaaagcattgaaaagtccatctcacaattaaaacatactgtccttccttggaagagacttataggatcatattttaaaataatctattaggagcagtcttaatggctttttacattctgagatcatacccttgagttcactgttgcttatcataggagaatagactgagattaactaaatgtcattcatagcaatatatgctaattttaagattatagtaattggcaaggtacaatctggttttctgattgcgttttaaattctcttctaagtgcaaaagaaaacttggtttggacactttaaaagtctgtaggacattggctgtaatccagtgcctgtaatcccagcattttggggggatgaggtggattgcttaaacccaggagtttgagaccagcctgggaaacatggtgaaactccttctctacaaaaaatattttaaaaaattagctgggtgtggtggcacatgtctgtagtcccagatgcccaggaggctgtggtgggagaatcacctgagcccgggaagtcgaggctgcagtgattgcatcactgtgctccagcccgggcaacagagtgagatgctgtcttaaaaacaaaagaagtctgggtgcggtggcttacacctgtaagcagtttgggaggccgaagcaggaggatcacttgaggtcaggagttcgagaccagtctgcccaacacggcgaaaccctgtctatactaaaaatacaaaagttaactgggca

SEQ ID NO: 85796 - DNA, 1047 bp, Homo sapiens
tccattatattgaatagtttccttcctagattaggtatttcataaaacttctaaatatttttaggaatgtattacttatgcttgacatctttatcattatttttttcattcaaaatagcccaagtttctctggaagcttgcagttggcagtactatcaagacaaaatgcctttaggactgtatggagaaggcactttccaccactacctaacaaaatggaatatatatataatttttgactttatgtatttcttctgtgatttactatctcatattctttgaatattttcccctttggttatttgtcttcctcttatttagttataagagttctttgtatattgtggcattcaactcttttttatgtgatgttagtattccttaaggctatgaataagaagtgagaagggaggctattgcattgaatgctaatcccagatggtgtttggttaaattgttttattgtttgccttgattatttgagcaatggtaagcttcttttgtctcttcctttccaaagatgcatagaaaagctccttctgtctgaagtaaagtgttggctctgtgttggttataatttgctttttctggcttgcacagccttctttttgttttctgtcttctgacagattataggattgtggggaaacagcgtccagggctttttcaggaaccgtgccattttatctacaggagaagccattggctttggcactagaagggaattggctgtgcatttaaagatgccaaatcatgctcgattcacaagtttgctgtctcattttgtctatgtgtgtgaaactttttcaggattttggctttttactttttctaccatgtgctaccccatcagtatgaaaaattaacaacttgccccttctttccagctctctactcccagaacatacaacccaaacatcctaaaccataaatgatggagcagtcattttgaagattagggaaaaatataccatacaagtgtttccctttggcacccttgtcgtgactttgagctttaattctggtttatcagtcattcctatagag

SEQ ID NO: 85797 - DNA, 1016 bp, Homo sapiens
gagacggactcttgctctgtcgcccaggctggagtgcaatggtgcaatctcggctcactgcaacctctgcccagccccaggttgaagcgattctcctgcctcagcctcctgagtagctgggattacaggcatgcgccaccacgcccagctaatttttgtatttttagtagagatggggtttcaccatgttggccaggctgatctccaactcctgacctcatgtgatccacctgcctcagcctcccaaagtgctggtattacaggcatgagccacctctcacccggccctgtacgattattttatatggactcctatttccaaaaacctgctttaactacttttatgagcaatacaggtaactggtgagcgaatgagactttttataagggttaggcccttggtctataagaaaagcagactgacttgaccttgttcttaaagtacatcagttttctcagctgtcaaatgaggataacaggaccattttggcttgttgggtggttgtgatgcatgactactaatgaaaataattgtaaaacacttttgcaagttaaagtgtgatataaatgctaaataatagttctttattgggatgttgtgaaaataagcaacatgctttttattgagaggccttaaattccttttgaggaggcaatatatttttataagtactattagatcactttagaatgttcatattattagagttttggccaggcgcagtggcttacacctgtaatcccgcactttgggaggccgaggtgggtggatcacgaggtcaagagatcgagaccatcctggccaatatggtgaaaccccgtttgtactaaaaatataaaaattagctgggtgtggtggcgcgtgcctgtagtcccagctacttgggagactgaggcaggagaatcgcttgaacccaggtgggggaggttgcagtgagccgagattgcactgttgcactccagcctggcaacagagcgagagtccatctcaaaaaaaaaaaaataaaataaaaaga

SEQ ID NO: 85798 - DNA, 1066 bp, Homo sapiens
atttgaagtcatggtatttaatcaggaggtcatctacagatggtttgtggctagagaagagcaatttgaaagagaaggaatagctagtgagataggtggaaaacccagaaagtgatgttttagaaggcaagtaaagaagtgtttcaagaagggagtggtcagcctgggtaacatagtaagatcctgtgtctacaaaaaatagaaaattagctgtttgtggtggcacatgcctatggcagtcccaggtattcaggaggctgaggtgggagaattgcttgagtctggaaggttgaggctgcagtaagtggtgattgtgccactgcactccggcctaattgcaccactgcactccatgtgacagagctagacactttctcaaaaaaaaaaaaaaaatagaacggagtggtgagctctgttgaatgctatatagaggtcacgtaacagagaagtactcacaggatttgacaacctagggattattggtgacttccagtagaaccgttcattggagtggtggaaatagaagtctaattgtagttgattgagggggaaaaataagatgaagaaacatttgatcattttttttgtttttgtttggtaacaggttttggcacccagtttccttgaaaacttcctgtgtcattgtaactaagtacttacctgtttgtattccagttgaatatgttttttttttccccccaagatggagtctcagtctcttgcccaggctggagtgcagtggcgtgatcttggctcactgcaacctctgccccgagttcaagtgattctcctgcctcagcctcctgagtagctgggactacctgcgcatggaagcacgcctggctaattctatattcatatatgtgtgtgtgtatatatatatatgtgtgtatatatatatatatatatatatatatatatatttttttttttttttttttttttttttttttgagatggagtcttgctctatcgcccaggctggagtgcagtggcgtgatctcagctcagtgcaatctccacctcctgggttttaagcagttctctctgcctcagtctcccaggt

SEQ ID NO: 85799 - DNA, 1010 bp, Homo sapiens
tttttaatgtagacaaagcagaggacaaactatgtgtttatggaaagagaaaatgggttctttttattttattttgttttgacacagagtcttgttctgtcgcccaggctggagtgcagtagcgcaatctcggctcattgcaacctccacctcccgggttcaagcagttctcctgcctcagcctccaagtagttgcgattacaggcacccaccaccatgcccggctagtttttgtatttttagtagagatggggtttcgccattttggtcaggctggtttcgaaccaggtgatccgcctgcctcggcctcccaaagtgctgggatcacaggcgtaagccaccaagcgcagtgagaaaatggtttctaaagtagagatgcagactccttttaaaaggacatagacacttcagctttgctgactctgaggattgagaccttaaactgtcaaggcgttttggcaattgatgagtgattggtcttttacctgagtaaaggtagggaggggctatactagattcttgaagattcacaaataaggggagtgaatttacaggaatgggaaaaatgaacctggttgtttttaacttctctgtctggtaaaatgtgtttcacttttctttcctggaaatgcacagtgatgtataattttaacctttttactttagttccttgaccgtcccaatagattatttgtctataatactttgtttaagataatagttttaaaaataaagcatttgttactattgtgataggtcattacagaaatttattccatgtttgactactacatggagtagagtataaaatgttaaagctgggcatagctatcttattttattttttaatagttggacatttatttttaatgttggtaatgcatttttccccctactggaaatttccatcagttcaaataagcgcataaatgccacccatgttatgttaaaataatagaggtttgttcagctgtgatgagaatttcctgtcctcctctccttctgttatc

SEQ ID NO: 85800 - DNA, 1334 bp, Homo sapiens
aaaaaaaaaaagacccaaatttatcatcagtggtcacctcagagcacctgaattcaggcctttaagtgcaagtaggatgcagaattctggaagagccagtaagtctgtggctccttggggaagcgcgatccaagggtttagtaacctaggcacggtactccagaggcgtaccctgaggcagccgccaaattctctaagcctcagaattcttcaaggccagctcccatgtccactagagacccaggggtccagaccatcaggcactgaggaagacgcccccggcaggggctgcgcaggcgcgtgcggcccgaaagggcccaggcgctacacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgaccgtgagtagtggtggagggggagtggacaacgcgtgggaagagggtaacttagcggaaggatacatgactttgtggggtgggctctgactgtgggagacggaagggcgtgggggaggtacagtttgaggtgatgatgggagaatttggggcacgggtggcccggtcgccggccgcagagctggacagcttggtggagggggacggggttgcgtgctgtggagtgaagcagcccatttgtatcatcccttcctccaggagcttttggtcgcctctcctttccgcttctttcagagaatgattgcggggggagggtggtggaggatgaaagctctgctggagcttaagaagccacctctgaaccaggcaggggaagggtcggtctcccggagtaataggctgctctgggtagaggatgggagtcgggaaccctcttttgaaagccgggaggggtctagggaaaagagctaggggcttagagtcaggcaggttcgaaaggaagtccaccattgataaagctgttaggtaaccttgggcaggtcccacttaacctttctgaacaccaggaagatgtcatgcttcaaacgggctattgcaagcatcacctatgtaattgagattgtttatgcaaattgtgaattgtaagtactatgttgatgttaatgtatcaccaacaatgttagtggaatttagaccttaccgttgttaatggaatgactgatttctctgttaagataagaagcgtattgtttgtaaaacctcagtagacacatatgtgctttctttatgggcacagcagaccatgtgcagaactaccagttctgtaatgtgataaattagccatcagacttctgtaggaaaaataccgt

SEQ ID NO: 85801 - DNA, 1050 bp, Homo sapiens
gctatttggcctcatgggaaatgtagtcttttaggagacatggccagaagggccgtttacaaaactttggcagaagaaaaaaatacgttgtgtatgggagtccaaaactaccgtcatgcttgcacagactctaaatacacattttcccctttccttagcctccaccagtctccagagcaattcctcctcccgcccacatcccatgtgtctcggctttcaatttgggcagacctacctctctcctactcgctggttcgtcagccgctctgttcaatcgtaggagcgctcctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagaggtaaagcgccctgataggtttgctcggaactgtcatgtttttagtattgaaaggtttctggggatactgtctttgattctattttatagaaaacaattttgaggccctgacagggaggagcagtgaaaaatctctcaggagagaaataacagtttgagtgggagaaggaaacgatctggtcacaaccagagacgctcactaaagagcatgagattgaagggccacaaagtggaactatggctctgcaccccgacatgggaagcaaatttgatccagtaaatgcatgttgggcctcatcttcttgttaagacacagttacacctggaaaacagcacactttattcttcaaacagtgtccggtattggagactggacacaaactggtcattgcaaaatggtgtcataagaagataatataaaaagactgggccctctcccttcttgacc

SEQ ID NO: 85802 - DNA, 1067 bp, Homo sapiens
catctcccatccttgcagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtc

SEQ ID NO: 85803 - DNA, 2184 bp, Homo sapiens
ggaacagagtgaggggggagagtggcaagaggtgaggtcatagagaggcactgtgtcctgtagggtttggagggaggttcactataggcattctggcttttactctgagtgagataattggggatccagagcaacactttgtcttatggaagaggttataccaggataacaagatctgtcatattcatattaccatactgcattttagatagtcactgcctaaggctcattagtaattataatagcgatgatcacaattagcctttattaagtctttattacactccatatcactaatgtccaaaatagtggctggtatactgcaagtacttaataaatgctggttaaacaaggaacaggacttgagctagaagaaaagatggagagagactgagaattgtttcagacatgggacacagcatgaacaaaatctgggatgtggggtgaacaagcagtctggatggaagcgaagaggcttcatgcaggaaatgagtgaagtcacctcgcagaagccccgaatgcctggtaaatactatcctggttcccttgaaaccagattctgtccctgttcttctagctctgttctattttttttgttgttgtttttttttttaaagagacagagcttgactatgttgcccagtctggtctcaaactcctgggctcaagtgatcctcctgctccgcctcccgagtagctgtgactgtaaatacacaccactgtgcctagcccgactcctttctttcttcctgcctacagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcaggtgagggggcggcgaggaaggtgggagctgtggagggtgctcggggtgggtgcagggc

SEQ ID NO: 85804 - DNA, 1068 bp, Homo sapiens
ggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaattgttttctgactgtctgtcctacctgtcatcacccttagaggagaccctcccctagatctgggtctagcaggtggggggccttttgaacaggtctcattcccatagggaagtttggtaggggaggtgttggagaaaagtgagccagggtgggtggatgacaatggaatgacatgggtgcgtctgctggcccggggggagctgtttctccagagaaccctgactgatagtggaatctagtcttgacctgtcacttctagtcatgtgatctgcagtcacacttctctacaactgctattcctcatcaaaaaacgagtctgctgcattaccttaattctcaagtcccggggaccttcattaaaccaaat

SEQ ID NO: 85805 - DNA, 1037 bp, Homo sapiens
aagactgacacccttacccacagaagttagaaaggggtgagggaagccctttccagagttgactgctttaaatcagtggatagctagacaagagaaactaagaatagagacaatcagccagtcacggtggctcacgcctataatcccaacactttgggaggacaaggcaggaggaacacttgagcccaggacttcgagaccagcctgggcaacatggtgaaaccctatctctaccaaaaacaaatataaaaaattagctgggctaacatgcctatagtcccagctacttgggaggctgaggtgggaagatcacctgaggctgggaggtccaggcagtgatcctttttgtgcctctgcactccagcccaggcaacagagtgagaccctgtctcaaaaataaaagagacaatcagttccttgtcttcccttgttcaggcccttttgctttgtctttgcccagtgttgcaacagcagagatgaaagtcagctctgactactgcccagggaggcactttaaacactgcagggaagaacctaaggagaaggcagatgctttgtccctggtggtctttgaaagagtgatagactcacacatacccaatcttcagttagccctgtatctgttttttgttttgttttgttttccctaaaagtcctagagaccgatagctctgtatctggtacagaaggacagacagattagcccttaccctagaaacttccctttctttaaggtgataagattttctaggctctgcaccccgatgttgtattttcatagaaatatcccatcctcttcagtagctcactcttcccttctgggtagcagccacatgttctaaagcagatcagctggcagggacagctgttctttatcaggagcttggaaaagacaacagtttttgttcaaaaataaaaggggagggccctgagctactcacccttgaagtctctgctagtgccaacccagaagctaactctctccctgtcttacctccccgacacatgcaccttacaatctgttctctgccttcctt

SEQ ID NO: 85806 - DNA, 1088 bp, Homo sapiens
tgaggaatcacagatgcaccttttgaactctgagcacttagccacccaagcagagcagcaagaggtgagtgaaggtggggcggggattccaaatccaaccttccttctgtgtcaccacagctgttatcagaagtagcctcagtgtcattctcattccagtccccacccaccctcatcctaacccctcaagagttgagtattccagggggaacttctggctcaaatcccaaaggcaagtaagagatctacaaaggcaactggtctgcttctctccatcgttaccccagtgcactgtgagatgggcaaatctatactgtagaaagagatgagtagacccatagagaggttaggtgatagtgctggacataccacaggtgctcggggtaattgctgaatattggtcacaagtaagccttaaaggcagagtcaaaatgcagatcccaagctctgttggccagagggagtgttggcctgctgagggtacctataagtcttgcttgggaatggaaatggaattctatcaggagtcaagcacaccctttgtgagcattcatgatgggacctcggaaactgcttgtcagctctgctgcagccctggccactgtggcaggaaggaccggcgcctctcaggcttctcacccccctctcctctccttccattgcagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccacta

SEQ ID NO: 85807 - DNA, 1825 bp, Homo sapiens
cggcctggacaacaagagtgaaactctgtctcaaaaaaaaaggtcagtcacaccactgccatcaccttcagtgggtatcagcactagcaagatgctaactgttgaaaattgtataacaaacttaactgggcaaatatttatacatcagtggagacacaggttttccaaaactagattcaaatatttcggaaatggatgatattaaaggtagtatgcctcatctcagtgaaacagatctaaaagtaatccagactgtgtaattcactgtgtagatttgtcagagagcatagctgctgaagtgaacgggccaggagaccttgataaaaatccccttgttgtatggtgcccctcccaccttttaagtgtttctctagtgaggaaactcaaagggcatgagttacctgcaaagcattttgtacttggacagtttgagagtgaaatgaggaccgtagcaccatagaacattggtgaagaaccccagctctctcctggaacattagcctttacacttgattctagcaattcaggaaaaatctgctgagaactttgtatcttcgttgcgaatttctcttccacttagcccttcactcttccccaggggtatcctgttcttaccccaggggtagtggaataaactagtccactgtttattcctcctcctctcattcctgggtgatctcagaaagcccatggcaccagctaaggccatcaccagcccatggtgatgactctcaactccatattccatgcctttctccttatatccagactcatatctgcctgcccatcccacagatatctcaggatgaacctcctccataagaccagaagtcttctgcctctccacatctgctcttcctcctgtatctcctattgcagtaaataacaatgatcactactcagtccctcaaactaaaattctgggaaccattttcagttctcccttgtctaccataaggattttgtcaccaaatctgttggttctctggatgttttccaaatccacaaagtgctatcacatctctatgccttacatgcttctccccctcccttatttttcctttatctgcctggaagatccttctcaacttccaagtgtcaacccaaatactgacttcctataaaatcatccccaatcccaaattcctgtcccccaaactaaaataagcactatgtttttaatagcaccttagacatgcttctcttctagaacccattaccttgtgttgtaatatttctgtgtttatctccccactagactgtgagctccttgagggcaagtcttaacttttattcatctctggatctctagaacttggaacagtgcccagacacaggaggtgctcaataaatgttggttgaatgtatgaatgactctttgcttgtgtggctctttcattcttacatggtgtgattcagagtgtggcttctgtttttgttgcacaaagacgtctttagttgtttcatgagtcatgaatgaatggatgaaggaaactgacattgatggagtgcttatcatgagccaggcctcatgtcaagcatttttttttttttttttttttttttttttttgagacggagtctcgctctttcacccaggccggactgcagtggccctatctcggttcactgcaagctccgcctcccgggttcatgccattctcctgcctcagcctcccaagtagctgggactataggcgcccaccaccacgcccggctaatttttcatatttgtagtagagatggggtttcaccatgttagccaggatggtctcgatctcctgacctcatgatcctcccgcctcggcctcccaaagtgctggga

SEQ ID NO: 85808 - DNA, 1048 bp, Homo sapiens
ctttgtccctagctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggtgagtcacaatcaggtgcaggcaagatggtagtctgcctgccatcatgggttagacagaggatcactgtcccaattttacaggcagggaaactgaagccccagaaataggtttgtggtgtctcgtgagtaatgagtgtgaccttcattttaatacttggggatgatggtcaggattatgagggccgaacctcaagttagccttcgaagtctaccagtctctagttttccaaaggataagcactcttcagcccatcccaccaaacccaaatgtgctctgttgttactgccaccctcacctaacgctcattctatctgttcctgttagatggcctctgtccaagaggcaaagtaaaggtggggatgattaagcagaaagagccatgtggaaggtgaagagctaatcccagctcaggaacttaagtggaaaatatctaaaggaaacttgaatctatttttccaggctgctgttaatatatcaccaatgctccaaattgtggcatagctgtaataatgcctaatatttatatgctcttgacattggccaaagtgtgtttacagagattgacagaaaaatttccctccttgaaaagcatttggtggtagtgaggatgtttttaaaccattcaatcccctcattcagttaacctagagggtccaacactatatacccatatataaacttgtttttctcttttgaaatgatcccacagtcttatgtgctaacagaaaccagcacttctcaagtatggccacttggtggcagccacattttaaaatcaatcacactggccaggcgcggtggctcacgcctgtaatcctagcactttgggagaccaaggcaggtggattacctgaggtcaggagtttga

SEQ ID NO: 85809 - DNA, 1035 bp, Homo sapiens
cactgcaacctccggcctcctaggttcaagcaattctcctgcctcagcctcccgagtagctgggattacaggtgcccaccaccacgcccagctaattttttgtatttttagtagagacagggtttcaccatgttggtcaggctagtctcagtctcagtctcctgacctcaggcaatccgcccacctcggcctcccaaagtgcagggattataggcgtgagccatcgcaccagccccatccatctttctaatcataaatgtaactgaatcactggaggaagataggggagaatgttaggatcaaggaggggagaatgttaggatcaaggaggggaggctgttccacaggtcaaagttagtttgaattttccttttcttgccacagaaatggccaacatctcttttttgcaggagttgccgtgtggctcctctcatccagtgtgactattgccctctcctgtttcacatggattgcctcgagccgccgctcactgccatgcccctgggcagatggatgtgtccgaatcacatcgaacatgtggtggtaagcacagcagtgtccattcagtcctcaatgggcatagctggagcgtggactgattagcagaaagcatattaaggtcagcttggtgccaagttcaccacattgtcataggtactggtttctgcaggccaccctactcaattctgatcattttgacatatttcagctatgctttttctcacaatgttttgtttcagctgcccatacagacttaactcactagtgcttggttgtttgtaagtgacttatagggaattaagcagttgatgttatagccctaaaaggggagtatattagatccaaccttaaggaaataaatcgttggctgtctggggtacatgtgtcccaggcaccaaatgaagtttagtaaataagctgttgaatgaataatagtgtgaaggtcctattgctttctcttccaagagtcttgggtttattttccagactgaggctagaaaagagctgtcacttgctatctccaaaagaagttta

SEQ ID NO: 85810 - DNA, 1089 bp, Homo sapiens
gtcttagtttttattcccaaagaaagtgaaattggtaggcttaagaaggatgcatatagaatcaaagcttctctgatttttatgaaaatgtgggccaggtgtggtggctcacacctgtaatcctagtactttgagagatcaaggcaggaggattgcttaaggccaggaattggagaccagtcttggcaacataatgagaccccatctctcaaaaaataaaaataaaaaagttagctgagtttgatggcccacacctgtagtcctggctcatatggaggctgaggcaggaaagttgcttgagcccagtagttcaagactgcaggccaactccacagaatagtccttgttgactatgtggcttggacatttacatttcttaggttgcctgtatctaacctagcatttctgaccattttatgtttgcaaaacagttagatgtgtttctgccatagaacaggtgacttctggttctgacttacgtattagtctctttttttttcctccctaatctttcttttttctaacttaaaatcaaccccaggggcctcagagagcaattcatgcttaggccatgacacatgcttaagatctgtttttgtcacttaatgttgtttccatattgcaggctaggaactctgaagccagggatagctcagcaccatcattttcttttctaggttctagcaagaggagaagaaaggaggaaaccacagggaaaaatgttaagaagacacagcatgaattagatcacaatggtctcgttcccttacccgtcaaagtctgcttcacgtgtaacaggtattttctttcatactaaggggctctttctcattatttagcagatgatactttttctctcatcacctcttccagaccatgtatgttaaatgtgaacagcccatattctgatagtatgagtacatggagactaactaatggactgacgagagccttgaatgtgtatgtgttaacaaattttctgaagaatcacagtacaggagtactgtgaactgtgttgaggccgagcacggtggcttatgcctgtaatcgcagcaatctgggaggccgaggcggtcagattgtttgaac

SEQ ID NO: 85811 - DNA, 1031 bp, Homo sapiens
ggtgattctctgatgcaacagttttgtcagctttagttcagttagagttgtgtcaactttaacagaccagtgttccaagtgaccaggtagatgagtctgtgatatgtgaaggccttttacagttttgattagtggtctaccaggactttgtagcacccatctctttgtttcatggtacttttcatgatgggcccacctgttcatttgcacagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggtcagccaaaccatcatcatatcccttcccaaccccagtttccccaaaggaccagcacaagagcagtgctgcctgtggagtcactgttcatgtagctactgtcttgggttcctgttcctagttctgcttggagagatctttgaaggtcttagccattacagagcttactcagttttccattttctcagtttctgaacttctttccttcccctcccccagaattatctttttccttttttttttttttttttttttgtgagtctcactttgtcactcaggctagagtgcagtggcacgatctcggctcattgcaacctccgcctcccaggttcaggcgattctcgtgcttcagccttccaagtagctgggactacaggcgcatgctaccatgcctggctaatttttgtattttcagtagagacagg

SEQ ID NO: 85812 - DNA, 1107 bp, Homo sapiens
gactgacctcttttggaagagaacctgcttagtaggctgttggtgtattgtatatggatatgctatttacatagtgttcctgttaagtatttgtattaaatagaattattttgttaatccagaaagagaaaatggagtgtactttttcttaaatatttttcatctacttgctttctctccctctacctctcgcctcttccctttgttctcttattcccccatcccccgctctcccctccaattccagactgagaaactgcttgttctggatggataattaacatggtgctgtggagcaacaggtcccactggtagcgactaaatctgaagtaaatgttaatgtcgtgcaggttcacatgtattaataggcgagggagatgagtgaggttagactcagatcaaccacactggtatatgacttgaaatagatcctcttaattagagcgccaagaaccatgacaactaccaacatcttctacttgcagtgttgagctgcagccttattagtgaatgcaaggcattctaaattaaaactgaactttaacctcgggctgagagttgggatcatctggctctgggcttcgatttgaatctttgaaacagaaatctgtcagtataggcattacagttagctgagggatgtatgtttgtggttttctccttgatgactccagaaatagactgatctagataaccttctcagcagtagagatgggccatttggatttgtttatgggagtctaggtatgttggagtcatgctgaagaggttggctttaggaattggtttgtatgttaatattactcttaacactttgtaggccctctaggcctcacagagagccacaccaaactgagaaacataccctccaattgaatgtacagtctctgaagatttagggctttactgttatgaacagctttataactaacagcatgtctttaagatcaggtagtggttaaaatagtgagctggggccaggagtggtggctcacacctgtaatcccaacactttgggaggctgaggagggcggatcacttgaggtcaggagttcaagaccagcctggccaacgtggtgaaaccccatctctactaaaaagacaaaa

SEQ ID NO: 85813 - DNA, 1123 bp, Homo sapiens
tgcaagaagtgtgtcacctggctatttcctttttcttgatagtctgttaaaatttggcaatagaatagtacccagctttccatacctctgagactcttccagaatacagagttggcagttgttggttcttccttccaatggaatgttcccaagagtgtgagaaaattaccgttgaggccagaattttgtcccttttccaaaacaggtgggctctagcatcaatcatgaggtgaattaatgaaggccctttttaaaatgtttgcaccccagcccatctttctttgtagagaagccagaattgcaagaatagccaaaccaggctagtgatagatcaggcccttgagactgaggctcagcttgtagaaaagttagcagaggcaaacacctggtataactgtcagtgctctaccctccctgcttccttttttccctgtactaactagtaacactcgtatccaggtgtcctttaccgggaagatgccaccagccagctctacatagaaggcgataaaacttgggggcacagtcagccagtttaaaaggattgtttgcctgtggaagtgacgcaactagctaagtttctcaatggggcatttgtaatgttctggcacttcatttgtttccttgttaacactctcactgaggctttgcatgagaaacccaacagtccttgtacctttttatgtactttgtggcattagtggtgtttgagtcagtagccaggatgaaggaggataagggattaaggttgagggaccctatgaattttctccttccatctctttaatatccttcaatatagctatcttcctgcaaaagacaggccatacttgaagagaaaagctgatgcccacacaagtgtccagaggaagctagctatttctgctgacatttacatttcattaaatgttgttccctcaaggcatgcactttaaaatttgggtgtattaatgcaacttttaatttaaattaaaatttaaattaaactttacccagcaccacttagcttttccaggacataagtttgttttcgtttataaaaggctggttctctgtgctcatggctccctttatagagcaaaatggctgctaggaggctgagacatgattgtggtcctttcag

SEQ ID NO: 85814 - DNA, 1035 bp, Homo sapiens
tgcccgcctcggcctcgcaaagtgctgggattacaggtgtgagccaccgcacctggcctatttatttatttttagaggcagagtcttgctatgtctcccaggctggagggcagtggcacagtcataactcacagtaaccttgaactcctagtctcaagcaatcctccacctcagcctcctgagtagctgggactacaggcatttgccactacacccggctaattttttcctttttttgtagagatagggtctcactgtgttacccaggctgttctcgaactcctgtcctggcctcaaccgatcctcctgcctcagcctctattttttattttttagtcttaacctagcaaaagatggttgatttaagcacactttaatatctatgcctatattagctctgtaatgtcagtaaattaagagtttcttccgtgagctccagttaggatggtacatcccagtgaagagaaccttacgatgtgatttggtatgttgttgtttcaacttttctgcatgtcctttcctagcaaagaagtctaaagctgtattgttgccttagaggaagtacaaaaaatccaccatctgcctttagataggatgctcacctgtcacccactagccacaacagaaaatgtctgtgtttgagcacttctcatacttggaggaccctagtttaagaaagaagatgttggctgagggcagtggctcacacctgtaatcccagcactttggggagccgaggcaggtggatcacttgaggtcaggagttcgagaccagcctgaccaacatggtgaaaccccatctctactaaaaatacaaaattagctgggcgtggtgatgcacgctacttgggagtcccaagtacttgggaggctgaggcaggagaatcgcttgaacccgggaggtggaggttgcagtgatcacgccattgcactctagcctgggcaccaagagtgaaactccatctcaaaaaaaaaagattttaattgtctcagttttattggttgtggtggaaataacttcaggtcaattaaaat

SEQ ID NO: 85815 - DNA, 1053 bp, Homo sapiens
atacttacattgctttttaatggctaaacaatattccattgtatggatgacattttatttattagttcattagttgatagacacttgggtagtttctactttttggtgttgtaaataatgttgtgaacatttgggtgccagttttctttgttgttggttttggttttgtttgtttgtttgtttgtttattttttgagacagagtctagcttcgttgcctaggctgaaatgcagtggagtgatctcagctcactgcagcgtccacctcccaggttcaagcgattctcctgcctcagcctcccgggtagctgggattacagatgtccgccaccacgcccgactaatttttgtaattttagtagaaacggggtttcaccatgttggtcagactggtctcatactcctgacctcaagtgatccacccacctcagcctcctaaaatgctgggattacaggtgtgagccaccgtgccagccagggtgcaagtttttatgtgcaagttttcatttctcttggatatacacctagaggcagaattgctgggtcgtatggtaactcttaacctttggaggaactgcctgttttccaaagaagctgcattattttactttcctaccagtagtgtaggagggttctaatttctccacttccttgacaacacttgttattttctgccttcttgattaaagccatcctagtgagcgtgaagtagtatcacattatggttttgaatcagatttccctgaaggctagtgatgttaaactttttttcatgtggttattggtcatttgtgtatttacttagagatctctattaagatttttgtctatttttaattgagttgtttggttttttaattgagttatgagagttctttatatgttgtaaatataagttccttgtcgcatatatgatttacaagtattcttccattttgtgggttgtctttacacttcccccatcttttatttatttatttatttattttattttacttattatttttttgggacagagtctccctctgtcgccgaggctggagtacagtggtgt

SEQ ID NO: 85816 - DNA, 1290 bp, Homo sapiens
ggtctctggactgatcccaaaaaatctgttaaaaattagaataaccagtacagctttacttttcactgacccatctttctgtttgagattggtaggattgttgtcattgacagagtgaataccatggggcatcagtaatcaggatgataaaactgactggtttcctgtgattaccttcttatggcattttgctccaaacagactgagggaccaaaatggtctgatagagaagtgcatctacctcggcagacctcagcatggtcccttcccgtcagacagatttctgtagcatttgcctccgcgtgttatatttggaattgttggccagctttcctctctctggtgttggcagcgagatccaaaatgaggttttcgaagaatgagagtaaaaaggtctctgtgcacaggcaaaactaagctcagcttggagttttgcatattttcagtgagtcgtaacaaaggtttcacacatagaatagaaaactgccttgcagaaaatgtttgatgtttgaagtggggttgtttgtttgtttttggatacagggtctccaaggcttgatcctagctccctgcagcctcaaactctgggctcaagtgatcctcccacctaagcctcccaagtagtgggaccacaggaacattccaccatgctgggctaattttttaaatgtttttgtagaaatagggtctcactatgctgcccaggcacgtcaagcagtcctctcaccttggcctcacaaagtgttgagattataggagtgagctgtcatgcccaacctgtttgaacttttaaggaggtggtttttctgattttgttgtgtttagctcctcattagaatagtatcaggcaagtgatagattaaaatatattaactttaacattatcttgtcagcatgttgtttttgacattgtaagtgcttagaagcctagcactgacgaactggaggtgacaacgtctagattccttcccctcgcccggccccatcaatagtaaaatgattctacagtaaacaaacctaatttggttttatgtttattttatttatttatttatttgttttgcattttctgtgttgaattagaatctaggtatgtcgtattgtctttgttttttttcttttttgagacagagtctcactctgttgcccaggctagagtgcattggtgtgatctcagttcactgcaatctccgccttccaggttcaagtgattctcctgccttacgtgtcatgttgtcttactggtccacctaaatatggaagatacggtaatgttcaattttaactcag

SEQ ID NO: 85817 - DNA, 1079 bp, Homo sapiens
gaggattgtgtgcggtggcactagaaaggcatttttaaggagctgagagctggaaagccgtacgctttttcccccttactggacatgagaggaggggagagaccgaaccgagagggagggacctgagttgatcgcccgctgcgtgatcctcctcagcggctcagcccaggacaatccggcaaagaagagtttaaactccatcttctgccggccgaaatcacctctgccctccacaaaaatcccacatctgcggcagcaaacccagatttcgtcttgttctactgggtctcgttctgttgttctgcaacagttgactgaggcaggggtttgagagaggagccagactggagagaggaaaagggggctgttctgtgttcccaccagttgtttgatgttgccttttttagccctctttttattttgttttaagtgaaatttcaccgaaggtctctcaacagttccattcacgttccatctctcggtttgtggagtagtgtctactgtatatttgtactaattgcaggtttgggaacacttattagacagatgactgatactgagcaaattaagtttatggtcagaagttatgtaggaaactcccattaccattcccaagatacttttgcccaggagggcaccccatcccagcttgtaaaattgctgggacaaaaatgattatcgtagaggaagttttgctgctggctttaaaatttttattatgaagtgactaagggtctgtggtttttagcctttacttcctataaggtgtaatccacctggagaagatatttctggtcacatttcttttgctattcttaggagaaatttgtgcctgaatatacgttgtgttgcttaccagttattcccagttgcttacatttttttagtgtgtttgtttggtatgtataccaggactgagttgtagacttcttgatttaaaatgtgggcttacgtcctactcctaggatgaaattggtgttaaccatgattgctgacatgcatgttgagtgagaatttgataagctctcttatttgataaagctgaaattgtttattagaaacctcaggcatgggaaaag

SEQ ID NO: 85818 - DNA, 1140 bp, Homo sapiens
ctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggaggtaagagtggccctcctcatctccttcctccagcgccgggagggaacctccgccctccgccccacaaagccagtcctaaactcgaagcgcctagatggccgagggagggggattcttcctcacctagcctctccctcccctctttgcaatttagggggctgagctcagcctccgaggacgtttgcagcagtttcacctacccgccgccctcgattcgctctcccgaggcgccagcccactccatctcgttgcaccggcaggcctccccacccccttcttgttggcccctttgtgcttcccccagcacgtccgggtaccgggctttgggcctctcccgagcgggtctttggagtcccccactgtccatacaaggaagtggcaagaagggaaccgcgcaccctcttcccatccccctacccttgatcctccccatttggaagaagctgttc

SEQ ID NO: 85819 - DNA, 1036 bp, Homo sapiens
tcaagttaaaggagagcaaggaaacccctataaagcagcaagacattttattgcctgggttataaattggcctgaaggtatttcacacatcagctccaggatgacttgggccacacattgagtaccactggattaactactcaacttcatacgggggagactttgaagagaaccatagtcatttggaaatatgtggtctggtatgttttaaaataaaggtacaataatcaagttaaaaacaacttttcaatgacttgttgctttgaaaccacttaggccacccctggttaaccgctgcatcccttgggtgctcagccagggctgcatgagttggtctcaatcagcacttctcaaagatccgagagcatcgcagatgtaggggaggtgcaagggaagccattattggaaaagtgtgcacgtggctacctggagtgctgcaagctgctcccagcagggtctccccagtctcaaccactggttcattggttcggtttatgatgatattactttgtatctgcatggtccattgggatccttttacgtttcatttctttccagtctcctctaggacccgttttcttttttttttttagacatagttttgctcttgtcgcctaggctggagtgcaatggtgccatctcagctcactgcaacctctgcatcccaggttcaagcaattctcctgcctcaaccacggcctcccgggttcaagtgattctcctgtgttagcctcccgactaggtgggattacaggtgcctgccaccatgcctggctaatttttgtatttttagtagagacggggtttcaccatgttggccaggctggtcttgaactcctgacctcaggtgatccgcccatctcggcctccccctaaagtgttgggattacaggtgtgagccaccgcacttggcctgtttttttctctttctttctttcttttttttttttttgagacagagtctcactctgttgcccaggctggaaggcaatgtcacgatcttggctcgctgaaacctccaccctctgggttcaag

SEQ ID NO: 85820 - DNA, 1003 bp, Homo sapiens
gagaatttggaaagattgtgtgaatttttttttgtggggggacaggatctcactctattgcacgggctggagtgcagtggtactatcatagttcactacagcctcaaactcctgggctcaaacagtcctcctacctcagccttccaagtagctgggactacaagtgccaccacacctgatagtttttaaatttttgagaagactgggtcttgctatattgcctaagctggtcttgaattcctgggctcaaattatcttcctgtgcataatccttccccagattgtgtggaaatatttgaaggataaatggctcctggttgacagcacatgctgatatggctcttaacaggggatgcagtgtgaggggtaatggcttccatcatctctcttgttttccacttccagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggtgggctgtgggaggaattccttgaatcgtggggctctgcacctgcaggtacttttagtgtgtgaagtggcagcgccatggaacatttggaatgcaatgggagggacacaaggcctcaagaagtaccagatgcatggaagagttctgctgtcatggtggtcaccccacaggtccagctgactctggccaggctctgcgttgcaggactgggttcagaccatgtgtccaaggctagcagaagcagtactggaaagcctgctggcaaggcaccgtgtggcagatgcccagagtggacaggagtctgctggagtgtgtattttcaactctgtggaggcctctgcaactcttttagggcaggggttgagatagaggaggaggctgctttcaggaggattcttttttttttttttttttttttttttttgacagagtctcgcttttttgtcagg

SEQ ID NO: 85821 - DNA, 1040 bp, Homo sapiens
cttactactattgttattattctattattataagtcctttcttatggctaacctaatgtactcaggcacaccaatttatttggttcttttacttagcagggacacagagcagatacttcccattctcagaatggtatctgaatacagctctactacctttgggctaaaagccattctaattcctttagcttttactgattcttattttctaaatgattcatcatctgtgtggttcttacttttccccaggtttttctagaagaaccagcacaataccataatactactgatagatatgagcatacttaatgctatttgatgatgattaaaaaaaaacctttaggagttggcagttcaggtggttgtccagtgcttttcattctgtttagctgcttcctgtgacagcggcatactaaacatgggtgggtttgggacatttgcatatattctgggaacagacaatgacacatgtgtcagatcacaaggtctgaatcttttgtgatgtgtacagccaggatgctgattccaacagcaaaacccagctccctggcccatctctttcctgccccgccttctccctttgagtcctactgtctagctcctgacctgggctgcccctgcttagctgacagtatcagacaagatcacagccgtaggcagtacagctgctggcagaacctggtggccccctctgcagctgctgtttcttgtgtctgcgaagtgtctggcttgtcagccacatcccctccctggagcagtctttgttaaccaattccacctcggcccactgaacggaagatgaaatgcctagagctcctccaaaaccaacaaaggcagcagccattaccaagtccccattcgaatcccttccccaaggtgactcagagctggcttgctgggcatttttaacccacagaggggagagctgaagcttgggatgggagatggcaggtgcagggagagccgtctcctctcccaattcctccccactccatcctacaccctgtcctgctacagtaactggtggaaatccctgatca

SEQ ID NO: 85822 - DNA, 2392 bp, Homo sapiens
aggagcctgcttcactcatggcgatttgcaaggaaagaccctcagctgccctgaggcccagcaaaaggagcccttcctttgcaaacatagggtggttgcagggaccaacagctaagcagcctcaggtgacagcccacagcacctgccaggagtggggaaggctggaatgatggatggggctgtcctgtgtacacgcctgcccttcggctgtgggtgtgtgtggaaggccagccctcaccactcatgccactctgattgggagccaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacggtaaggggtctgggcagccttgctgggccccctcaccactctacagaagggaagaaggagacagaccttgcactggccaggcccgattgtttgacccctgacatagtgtgtgactttaaacaaacgggctcatttctgtgggtaggttcacctctaccagggagggtcctgttcgaaattattcctattcttcttcattaggaaactaggttatgcctggcagtcggtccttcactctgattcccagaagagctctaaaagattttctggcaagctcctccagttgagcaggccttagggacaaagagaagagacagatgtcaccacggcctaaggcatcttggctaaagttagtttacaaagattaactgaacacctactgtgttcgtagctctgtgcgagaagaaaggcagccggacaaatgaaaaagactggcacacccagaggggcacgggcatgcggaaagcatccttgtgcctcattccatcctttctggaaagaaatccagcccatccccttccagttagagcctgcagttctttctcttccctcgagcctcaaagaacacaaggtgtgactgtttctttctagaatacccctgatgagcagttcattctcgatcgccacccaaagtatgacaacattgtcattggtgctggattctctggtgagtctgagctggggggaatggggtgccttaaagctgacctacctcagtgccaggtgaaatggtattttccacactcttagctgcccagataggtgtgaagcctggacattgtaggtataaggaggctgggcagtcagaaaaggggtattcatggtgggaggccacttctggctttgggatgtgaccaggaggacagtcagccctgtctgggtaagtaggggatgtccagagagctcaacctctgtctgtgaagctgcctgagagtctgctcttcccttcctagggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatt

SEQ ID NO: 85823 - DNA, 1356 bp, Homo sapiens
gagacactggtccatcctttagctgtcaccaacaagctgaataaggctggatattttggaaggggagctgcagctggctgggggaaggggtggcactgagagaagccagagggaactgcaggcagctgtggggtgagagggggcattctgagcatcttagcttcccaactttctcggcttgggagctggtgggatcttattctggcccttctctgtgtctcatttgtctgtccccaccagtgataacacaataccttgctttacaactcatcacattctttcacctgcatccgaaggcctgcatggctcactccttctccttcaagtctgctcaaaggccctcctctgtgagtcctcctctgaccacccacctgaaaggtcagaccctcccccagcactccctgtcacctcctcatcacctgcctctgttttgtccccaaagcacttatcaccttctaatttataattacttacgtgaattgcctatgtgtctccttctcactggactgtaagctttgtaagaatgagatttttttttaggccaggcgcggtggctcacgcctataatcccagcactttgggaggccaaggcaggtggatcacttgaggccaggagttcaagaccagcctggccaacatagggaaaccccgtctctactaaaaaaaaaaaaaaaaaaaaaaaaaattagccaggcgtggtggcacatgcctgtaatcccagctactcaggaggctgagacaggagaatcacttgaatccaggaggtggaggttgcagcgagctgagatcgcaccactgcactccagcctgggcaacagagtgagactgtgtctcaaaaaaaaaagaatgagatttttttaaaaattgtcgtcaaaaacacgtaacgaaattgactatcttaaccacttgtaagtctacagctaagtggcattaagtacattcgcactgttgtgcagccaatctacagaactcctttcatcctgcagaactgaaaacctgtacccattaaacaaatccccatttcttcctcctcccagatcctggcaaccactatttactttctgtctctatgactcagactaccctagatacctcatatgtatgaagtgaaataataccacttgtgtttttgtgactggcttatttcacttagcataatgtcctcaagtttcatccatgtggtggcatgtatcagaattccctttatttatttatttatttatttatttttatttatttattttagacagggtcgtgctctgctgctcagctcactgcaacctccacctcccaggttcaattgattcttatgcctcagtctcccgagtagctggaattacaggcttgtgccaccac

SEQ ID NO: 85824 - DNA, 3122 bp, Homo sapiens
ttcatctctttggactggcttcctcgtaatatttcatagggttattgtgaagagtaagatagcctatctcacatgcctaggccgtgtcttacacataggagtactcagtgaccaaatcttgccctctgcatctctcactgccaccttgggaaaagctaagaaggtggttcttgccgcagaacgctgactcctcctattttggtttggggatagaactttaaaagggctagtaaacaaaggtcccttttcagcttaagtcagaattataggcagcagggaacatggaactcctgcttgcccaagttggaactctaggatctggaggcagggctgcagctccagggaccacgccgagtgtggggcatcagtaggagaggagccacactgggctgtgttttctccaatggtgttgaaacgagagtgcacttgaactgacggaggcagtggaggcaggaggagtacgggaaaggtggccccaaggctttgggagaaagaaaagagaaggtgaatggagctgtgagatgaggtcccctcttccctgttcagtgctgtgatcctgctccatcagggggaagaggcctcttcacatctgggatagctggaggcctccagagccagaggcctgatgaagactctgagttatgttattgtaccaagaaaggggcttttccccttgggccatcctaaaacaggtcttcccagcctctccttcctgagcctccatttcttgttagtagatgatggcatggtcaaagctgaaaattctcacaggcctcagggagccatcattaggggaaagggttcagatctgggagtatttgacagggaaagcgcctcctcctcagaaggaatctttttaggaatcactcgcctaagagagcccctaccctagacaagttgtactcaccagacctccagtctccaagccaatgtggttcacggactgcctgcttcagagccttctggggaaggactgaaaatgcagaattactgggttgtacccaaaagccagcgattcaaggtttctaagaggaagggcccaggaacctgcatcagattcttatgcacgcttgagtccgagactcactgctctcagcatccctttcctcggagctttaaaagcttccagagtctccttcctcttagcattttgagtatcttctaagtaagccaaggaaggtttttacttaacaatgtttggcttttggggagtgctctgacgcagctttgtgggcctccagaaccaaaggcgtgcgtgcttaatggtaggagtgtcatttgtccctaaccttattcctcggtccctgcagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggctgcgccagttttcctgcctgttccttcaggctcaggcaaagtctggattggtcctgggggtggtgggcagaggcaggattctgatggggaccgtgagggcatcaccctggtctctggcctgctccccaaagtgtcagaccagtgccacttaaagagcctaggcagctcattttggggcaggcagaggtagtggaatgaggggattggccaaggaagacacaagccccaccttttatgtgaagagcctagggactgtgattcaggttagcaagggtggcagagactccaagcctcatcctccctagcctccacaagggaatgttgaggtccctctgattgttaaatctcaccaattacagagattctcttctcttctcttctcttcctccttccgtccctccctctctccctctctc

SEQ ID NO: 85825 - DNA, 1134 bp, Homo sapiens
ctcagcatcaactggctttggggtgggggcatgggatggagcagtcacttagcttcccatctggtgatgaggaccagcaagaatttgcaacaggaacgcagcttccatagcaaagtcaaggggaggggagctgccgccctgggcttgcctggcaggaattagcttatgtaccaaattgtttgtgacagtgctgagcaggagacgctggcttgtgaggaggaaggcttttttaaacaatttggttaaaatgttcaaattgccagctctgactcttgccctggagaggagggcagcggcctgctgttgactccctgatggctggagcagtggaagccactaagaatggctaaagatcacccaagctacgggcaagggcaatctcgtgggtccgcagcccaaggcagagagagacatggagtttaccacctccccggcagctcctgccactgcccagcgtcttgatgaaacagtatggaaacacggctgtcatttatccaggtgtctgcctagcaggtacaggaatgtgggcttggggactggagcccccaccttaaaaagaggtgaggcaatggaaaggaccagaggggccctgattcagcaatttacagtgccttggagctcgccagcagcacctcatttgcatctggattccagccctggcatctgcctcgccccgctctgctcacaaagtaaccccactgtctttccacaaagccaggcactccttagcctaacggcagatcctagccctgagtgcccagaaattctatgtaaagaatgagaaccaaaccaggctcccactaatttagaattcaaacaaccccaaagctaaaataaccccaatttttttctatattgcatagtcatcagtgagctttataattttgtcctagaaacccccccagagtccctaagtgcctttggcctatcaaagtaagactcatttatgttcagtctagtttgtgttaaatgtgttttgtgctatcctgattcctttaaaaatggtaattcattcatgagaaatacgataactattaaccagactgccccattcctgaaccattttgcataattgaacatgtattctatcagcctcttcctttcccccagggatagagaccgacctttctttac

SEQ ID NO: 85826 - DNA, 1039 bp, Homo sapiens
ggctctgaagctagagagggaggttttttgcacaggtgtataaatcaggtggtattggtgttccatggggcccatgcaccacagtaaatctgccaggctcggacgggcacagggcttgcattagcagtttcgaggttgtctgctaaactcctgtttacccggggcatcagccagcctcgtctttgttataattctgtatttgatggaagcccataaaacatgcctctttattcccctctctatgagttgggctctcgcatggtccccagaacaatctgctggtttcgtgtgtgtgtgtgtgtgtgtgtgtgtgcgcgcgcgcgcacacatgcctgtgtggctgtttatttaagaacataattcaggaatggagccattcctcttgacacagaggaaaggaaatttatatcgaggagaaaccctagcctatccatagcagggcaacttggtgagcagacattctgcagaattttagaagcaatcttactcagaagctatctccaagcccagctgcttcatgagggggtggccatgactccagcctcagaattggactcctttgggctttctttcaagtgctaaggtcagctctgcccgatgaagcactgtgagcaagggctgggggctacctgaggacggaagaggagaccttgagcgacagggctctggtgtgggactttctgagcccagctgggtctccagggacaatttagatactgaaactgttgctagtccctctggaaatgctgatgccccccgccccccgccccttttcctttctctgtttcttaagagccagagaagccacagggtggatctgggatgtggcctgggcctccttaacctagagcccaggttggtgctgccatccactaaggagaccttcaggttcaagctaactccaaatcctacgaagcccttctcttctgctctgtggctggcagcccagctcttgtaacaaaggcatggaaattgacagcagctatagccacaatctgaggaatggcagacaagaaacagcagagtaggcctcaaggag

SEQ ID NO: 85827 - DNA, 1049 bp, Homo sapiens
tcccactgcctggcaggagattcattaggcttagagagatgctctctgcttggaatctgatgattgtttagtctctcctaattcagaactccagcaaagccatttacctctgagcacaggatctagcttttggggcttctgggttcagagtccctgcgggaagccctgctgacctgagaggactctacatgcagtgtcaataccgacaggcccaccaggctgtacccagaacactccctcagtcttggtgtagtaataatgataatagcacctttcatctttcagagtgcattcacattcattaccttattcatcctcagaagacccctgggggttaggtgttattctccccacattttacagaaaagcaagggaagcttcggggttgcttgcccaggtagccaatgaacggtggagccagagctcgaccccaggcctcctcacccagagctctgccacaccctccctctgcctggctgatgggcctgcctgctgtgtctttcttccccacctacctatccagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggtaatgccccctgtcccccacggggcccacatggcagccccttgagtagctgctgagtgtatgcctcactctggcctggttgaggatagggtgcaaagaaactgcacatgagtcagagaatgggagggaggaggagcatatcaagagggcaggccaggaagctagcggcactggagactccctcagatgaggcttggaccccacagcccagcagcaacagagcggaaaaggctctggcagcctgtgtcagccctcaggtagcacccccatgaccggaaagtacttgaagcaggcttcttctggccatctaggggagaagctagccctcctgcaaactggg

SEQ ID NO: 85828 - DNA, 1031 bp, Homo sapiens
gggactggctgtcggggctggatgcccagggagtgggcagtcccagggaaaatgagagtctaagccaggagaccttcgcagacttgaggggtccttccctggggcctgaagggggcagagtgcacgcaggccagggcctggactgatagtgccaggatgatgggtcatttgttctgggcagaccttttctgccttctcattagcctcaaaggagctgccaggaagcagctgtcattcagctcagaggcccagggtctgcctgtactgcacacagccctttccctcatctccctggtccagagcgggacaggcagctccttgagcatcactagtcctgggacccaccccagcaggcaggctcagcccattatcatcttctctacaatgcccctgccattggaggcagctggagcccacaggcacactgggcctgaggccctctgatctgtctttgcctctctccagctggaggagcagctgagccgccttcagcgtgagaagaatgagatccagaaccggctggaggaagatcaggaagacatgaacgaattgatgaagaagcacaaggctgccgtggctcaggtacccctgccaggagtgcccgtcacactctgcaccgtcaccatccttgtggtcctcctcatgggtcccccgcacaaccgcttgttttgggaggtgatggagtgggaacctcggtcccctggtgttccagctgggctgggctggttgaatgcttatgggggatcctgcttctgatgctctcattcctttcccaggcttcccgggacctggctcagataaatgatctccaagctcagctagaagaagccaacaaagagaagcaggagctgcaggagaaggtgaggaccaggggctccctcaggagagagagagtgccagggtcactaggtgtgggaggaacccccaagttcacagtttagaaggcgcttttctctgccatcagtaatccacagagcagcgtaaatgaggagcaagagctaggcttggagccatgtcaccataacagacat

SEQ ID NO: 85829 - DNA, 1005 bp, Homo sapiens
gaggacaagcagaaggttctgcgagagaagcgggagctggagggcaagctcgccaccctcagcgaccaggtcaggggatgctccacccaccaagcctggccggctccctgcccatgcggcctgaggagtggggatcctagggatggggagccacgaacagagctgtcgggggtgggggtgctgcaaagagcccatcgtcatcccttgtgggatgggggcatcaccatacattggcacacccagccctttatcgctggttggcatgaccctggctcttccagcatccttatggggacactgataatgaggacgtggtgaggagggagcttggggaagataggaggaagccctgtgcagagcccagaaccccaactgctggtgcccacccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccaggtatccacagagagcacacggctgatccaggcacaacagagcttacctttccattctctttctctctctcgctcctctcagtggttcttgagtccttgggaaggaaagtgacaggaaagaggggagagccacgtgtagcagctagactccccaggctctgcgtgtgccttactgtctcaccgcccagcctgggatggtgtggatggggcctggtgcccaccagccatgtcacgggaggagatccccacgcgtgcaccaccacacagccatggccctggggtctgaagtgaatggaggaggagaaggagggcatccgagctccctctttcctgtacagccctcctgcccccaaggaatggctgacatctctccctggggcgggggtggtctgtgtccagctggaggagtcagagttcacctgtgcggcagccgtgaaagcacggaaagcaatggaggtggagatcgaag

SEQ ID NO: 85830 - DNA, 1592 bp, Homo sapiens
gctgcatgggtccccccacccctgcttgagtcctgtccatggcaccacctcctgacagtgtctgtgtgggggaccctggctcttccccatctgatggagccgccacactccctcgcaggtttgacagtgagctctcgcaggcgcatgaggaggcccagcgggagaagctgcagcgggagaagctgcagcgggagaaggacatgctcctcgctgaggctttcagcctgaagcagcaactagaggtgggtagggccacccaccatctgtgccctgtccccctcacaacctggggtcagccctgcaccagcctcatctcttttgctccaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggtacaggagggcttggccaagggagaggtgaggtgcagcgaggccgccaccatccccacagccagcctcaggcatgggccagaggatcctgcctccattcattcgcgtattcactcactcacctactcacaaaatgtggagtgagcacctgatctgtgccagccacagtgtgaagacgcgctcgtggaactttccacaaaaacaaatctgatggagctctagtagggaggggctcaggatgcatggcagctgagggccacaggcccacccagcctgctacccagccaccaagtcagttcagggagctagagcctgcaggcagacggagaagctgcaggactgtccccaccccagctgcctctctgtgggcctatgccagacctctagtaagggagttcagctgctctggagaagctgctgccacgggagcaaggtgccagcaaagggaactggctggtggacgttctcggcccctgagcctagggagagccatgcacaggtgggaagggggtggccacagctggggagggaacccagaccctactccaaccacctccaggccaagctgcgtctggagatggagatggagcggatgagacagacccattctaaggagatggagagtcgggatgaggaggtggaggaggcccggcagtcgtgtcagaagaaggtaaggtatctgagtacttacctgtccagcgtaaacacctgttcccatcaccgctttaaagtaaggggctttccacctccctacctcagccacatcgtcttccattgtcattctgggccaggaagcgcctctcgggatcctagcattggcaggatgtattggctcagagtctgtagagaagcttgggcccctgaggaactatcgctccctgctttctgtgccaggggcagccccctgtgcccctgctgtgctgcgctgcactggtgctgcctgcagtcagccagcctggccgggcaggtctccaccatgcggcaaggtctctcctactctgtcttggctagccaccgcatgtggcctgccatccctcctcaccctcccaggctgctttgaaacc

SEQ ID NO: 85831 - DNA, 2577 bp, Homo sapiens
acactgaggaagcccacgcaagtgcatgaataacagactgtctaggaggagggaggggaagggccaagggcctggagaaagccctgcatggtgaggggaggcccaggcgggctgcctgacagaggcctctctccacaggcagtggaggagctgctggagtgcttggatctggagaagagcagctgctgcatgggcctgagccgggtgagttgtcccacaggagggcagtcgggcctcactccaggggcccctgtcaggtggctggcccactcctcctgttctctttgctcagccagacatcaccagtctcctggtgccctctgagtcttgcccccagctccaccccgcccagccactcaggggctgcccccttcagggccaggggccagggagctagaggtttcagatgcagcaacctggctttccttcattctggataactggcttgttcagtggaacacctctgtgatgtcaggagagagtgggtggaaggtggccctgaacttgacccgagtcctggtgtggggagtaggggagacaggagggctggacccagaggatgtgggctggaagaggcaggaggccttgggtagagcccctgtggagagttatctggggctgctgggttccagagagcaagtaggacatggtgaggctgtgccaccaccacctgcccacaggccaaattcctcatctgaatggaacgccatgcgtaaaatgcaggcacgctggcccctgggtgccagtctgccacgtcactcctcaccaaagggtcagctgagcattcctcccacaggcaggaagccctgcatgcccctctcttccgagcctgggaagcttggacaggtggcacccgcatgtgtgccccagggccagggtggaagggaggccagtggagagccagagagggttctggaccagttgtctgccagcagagagggaaggaactctcggttgcagggccccgtggggcgtgtgcggtggaaggaggtgcttgcagaggcttgagtctcacttgtcctgtgtgcttggtcctctcggccctgcatgttgagtcactttcctggctcctcctgcccttcgtctctgtcaatcgctcccatctctgtgtctttgcgtcttcccatctttgcttctgctgtctctggctttccctttggccccagcagtccctgctggtctctattccttggtttctagttctgtttttctgtttctctccttgttctctgtgtctttgtgtcccatccactttctgtgtcattttctggtttgtgtcactgctttgtctacctctgtgtctggttcagctcttttctctctctctgttcccctcctcctgcttttttaagctggggctgccagctgggcccctgcctagggctatctgctgtcaggatttgcttcagctgcagggtctctccctgggtccactcaccctggtctttcccgccaggattcctgcctctcaagcaggctgagctgctgctggctgccactggggatggcacctcctccagcccatgcctgggttcccaggcctatcttgggaagggcaggaaagggcctctacaagctgatcctcttcccagctgccatctcagaccttctgtcatcctgagccatgccaggtgcccggctgaggcaggcaagccccagggcccactgtcactcaagggcagagctgggtcaacattgggtgcctgctcacatctagtttgggaaagaaagttcaggtcgtctaggctctggttaacactgactcatgggcgaggattccctgtgtgtcacattgcttcagaggaggggggtcttcatctgagccatgggaccctgagagtttcaataaggactctgggggggctcagagcctcctgacattgtaaaatttgtatgaatgtgttttctggggaggagatggccctgagctttcacccaatacccaaaaggacccttaaccccccaaatgttcaagagagatttgaggctcactgctttggcctctagaccattctttctcttctcattgtgtctctgagccattatccaccccccactccagcacctcacttctgccctggtcaggtggctatgtgtcctaaccaagcgtgtttgctgtcctccggcgggacttggatattccttacccccagcaggatttcaggcttgcacattatatgaaattaagcagctgggggccaggcgtggtggctcacgcctgcaatcctaccactttgggaggctgaggtgggcagattgcctgagcccaggagtttgagaccaccctgggcaacatggtgaaaccccatctctactgaaatacaaaaaaagtatctgggcatggtgacgggcacctgtagtcccagctactcgggaggctgaggcatgagaatcgcttgagctcaggaggtggaggttgcagtaagcagagattgcaccattgcattccagcctgggtgacagagcaagactctgtctccaaaaaaagaaagaaagaaattgagcagccaggcacagcagctcatgtctgtaatctcagtactttgggaggctgaggcaggaggattgcttgatgcc

SEQ ID NO: 85832 - DNA, 1079 bp, Homo sapiens
atggcggctgtcaaaaagaagtcactgtgcatccagatgaagctacaggtggtgagtgccagccgggtcccagcaggcaggcctggggacccttccttacccctggtaggcaggcctggggactccgagcacactgaggccatctggtgcccactcagcgtcccactgtgactcaatggctgcaggtgggggtcttcttttcagtgctgccacctgtgagtggccaccgaggcccggcgagggcagagttgtccaggtttagcatgtcctggctggtgctggggccgctgctaccctgtgagcagtggagacgctggcaccagtccctgctcttctgagcacaggccatcagagcccactgagggcagtctcttcccctcggcaggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggtggggcctcctttcctctccactctgggctctcttttccagagctggccctgcccggccccacctcccacctgcgacccgtgggctgcagtggggctgctcctgtctttcctcacgatcctttctgctctggtctctcctcatctctcccagcccacagcccctttgtccatttccttccatcctgcagagtccccgcctcctcctctcccttccatattcagttctctttgtccccctcccttcctagctccaccctgcaccttgtcatttgtccacagctccctttcttcccacgtccctagtttggacagttcagctttgcccacagcagcaaacccagtgccctttcggagccatctgcccagtgagaaatgaggtgctaaatctttctgaagtacttaaaattcccaagaaaggtcagacagacccttttttatggacccatct

SEQ ID NO: 85833 - DNA, 1064 bp, Homo sapiens
tgcccaccgtggggtggggtagggtgggcttgctacctggggcctccccagaccagttttccccagtcctcttcccttctccactggttgggtagctccgtatcttcctcttgcatgtcagggtggcggccactagggggcagcaggcaccgtggtaacgaatgggctgcagctttggcacttgcgctcggggacttggcctggcttggaggagctctgctccatccttcaagatgacttacgttggaggatggcgattcgagcacctcttcaccccctttttctccagtttagggaaaggggatgctggcgctgaacagcaccttgggctttggctttggccccttctgggatgtgaagggccccaggctgctcagctggagtgagaaagtcctggcaggtggtgggtgtatggaggaatgggtgcccaggcgtgaggctccatgcgagcgaccccaagaagtggcatccctgcccaggaggagccaggctctaggttagagaagttttctcgagaatgtggaggacagacaggcgggcaggcgtgtggctgtgtgttgagggaagttacttcactctgaggcggtgacaagcctagctttcctctaacctacccagccccaactgcaagcggaaagctccgggtgtcagcacagcgatcttctcaaacaatgtctgttagcgcctcagagcttccagtgttttccggcggggggggggggggggggggagggtgtgtttgcgcacacacacatgtgcacaaatgtctttgcgggtctctttctgtgtgtgtcagtgtgattacacccacaaacatactccctggagactgtgtgtgtgtgcgtttgtcccaagtctgactgtggttgtgttttcttgcctactcatcctcacaacacccccgccccacggtccctccgaggcggcgagctctattgatgactgtttgctaacacactgtttttctttgcatgctgcatgctggtcctttgccttacagaagctgctgaaggtaaaaccttgtttcttgttagctttccctaattgccgtgattagacacatg

SEQ ID NO: 85834 - DNA, 1010 bp, Homo sapiens
cattccttgcccagtggcttgtctcaaagcccatgccctcacttgtctcccctctacggctgtccttgtccctgtcttccatagcagggcctgtttattcttctctctctctgacaggcgaaaacagaagaacagattgcagcagaagaggcctggaatgagacggagaaggtgtggctggtccatagggacggcttctcactgggtgagtctcagagggtctgggggcacatgtcaggactcactggtctcagggctgggcagcgaatgtgccttctgcatctggtgagggctgagcagtgagcaaggagaggctggtgatgcagtgggggggaggataggaccgagaagttcccaagtggagtagcagaggcttcccaggcccatcccagctgtctgtccctcccctgcagccagtcaactcaaatctgaggagctcaacttgcctgaggggaaggtgcgtgtgaagctggaccacgatggggccatcctggatgtggatgaggatgacgttgagaaggtaggtgggcagggggctgggtgtgggggaggaggctcaggagtgcactgggcagggcaggcccatcctctggcagcggagatgggctctgctgctctaatacccacccgcctgtcctcccacacaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgcagcaccctcaaggctaccctgcagactcctggtcccaccccctgccctggctctctgcccttcccctgtggcaccccactgggctcctgtccactctcacagttgaccttgggaagaggagtcatttcaagagatgggggacaggacctccccacaacctttgatggagtccaggacttagt

SEQ ID NO: 85835 - DNA, 1029 bp, Homo sapiens
gcaacaacgtgtaacaaacattaatatttccaaagcaaaatctatgaatattcacactacaggggcatagaggataaactgccaggttttgccgccaaaatagttaagaaaaatattttgtttgggggggcttttgggattttggaattgcaaataagggttaataagggttttaagtaaccagaagattagaaatgatacagataatgctccaagccggtccctggcatggtgggtgctccataaatggtagcgttgatagtggtgctaataacagttgttattgatgccctcactgccatcactgccttctttaggcctggccagcatgaccatctggcagcaggactcttgaggagccctgtgcttggatggcagatgggtacagtgggccccttgggatataggggcaaccctatcttcccagaaagtgttctctgggtggggcaggaggctgagaagcaggagggagggtcagtccagcctctttcccttggaaagtgttgccttcttggctggcctctgagttggggacagttctcttcaagcttcccttttttggaccctgctgaggcctcccagggtgtgggagaggagcatcaagttttgccactacttccctgtgctcatgcaggctccttctggctggaaggagaggggtctggagggtatgggggaatagcctgagaggccttgaggccctccctgactgttacctcctgggacctggggagccttgttgctccccattcttcctgggcattgcagcacttagagaaaagccagccgccgcttcccccacccacctggcccactctgtgaatcagggaagtgcctgttcctgctcacagggaggagctggcatgggcattttgggcagggtatgggcagaactgttggtcgctctggagaacccataagcaggtggggagtgtcgtggtcctgttcccgggcggctgccctcccctccctcctccccgtccctcctccccgtccctcctcctctcacaagggaggagatgggagctg

SEQ ID NO: 85836 - DNA, 1014 bp, Homo sapiens
ttaggcctgggattggtggtaggaatggaggtgggactcggctgtttgacctctccatgctccatctctgctgtgtccatgctccatctctgctgtgtctgggctgcgaggcagtgggctcacctagaatgggacttggttgctgccctgacacaaagccagtaaccccagagcacctcataggcctctcggcgctctgtgccggcatctcacaggtccatgctaagtctggggatagacagcaggtgacagtagtacctgattgtgctgattgtgctttgtgggaaagaagccagactcttagctgcagttgtcctatttgtaagatggaaagtgggcttcctggggtagcctcgtggagccatgtgttgcttggtagatgaatgggagatctgttccagggcgtgaggtcacaccttcttattccctctgcatgggatgggcagggctgcaggggtgatgctaatgtctacctgtatttgtatgactgtagctagagggcagctcaaaggaaggcagtggcccatctaggagtcctcagcctcccaccagcccgatacccccagagacttcccagagagccaggagccctgcacccacactcgccatgaacggcccgggagctgccacagcagaaggcctaagcgaagaggcccagggcctgtcccggaagcgggtggcaaatgcagtgaggaaggtggtgagtaaggtgctgcccagcgaggagcttgggaatgccaaggagaccccaggcagaggagtcaagtcccccgagcacccgactcgaagcaagaggggagaaaaggcagcttctagtcccaagccgccaccccctcccccacctccccctgctccgcctaagcctgaagtgaagaaggaggcagccaaggatgagctctccctgggcctgcggagcctgatgtctcggggcaggggcaaggagcacaaggcccgcggcaagcagtcttctgggaagggggagaagccctccagccaggagccaggctccccaga

SEQ ID NO: 85837 - DNA, 1076 bp, Homo sapiens
attacaccaacagacaaacttaaagtctctagcacattaactgaataataaaacagaagtcaacaaagcaaaatagaaataattaattgaaaacaaaacatttcctaatttttaactattattcatgataagcagttttaagaatgaaccagttcttggccgggcgcggtggctcacctctgtaatcccagcactttgggaggccaaggcgggtggatcacgaggtcaggagatgaagaccatcctggctcacacggtgaaaccctgcctctactaaaaaaatacaaaaaattagctgggcatggtggtggacacctgtagtcccagctactcgggaggctgaggcaggagaatggcgtgaacccgggaggcggaggttgcagtgaggcaagattgcaccactgtactccagcctgggtgatagagtgagatgagactctgtctcaattaaaaaaaaaaaaagaaccagttattaaactccactgaagtgccctgattctttggatgcagcctctccctggactgaggcagattctgacttgatttttcaagcggcccagctctggtttctaatccatagatggacagttttgcagttctccgggcctcttgccccacgtaattgtgtgttacagctggaaggcaaagtcgctggggtcctgaggcagattcctcaattcctctcctaggtcacaggcctgcaactttggtttactgtattaagggtttgagtgttggctgggcgtggtggctcacacctgtaatcccagcgctttgggaagctgaggcaggtgggtcacctgaggtcaggagttcgagaccagcctgactaacatggagaaaccccgtctctactaaaaatacagaaattagccgggcgtggtagcgggcgcctgtaatcccagctacctgggaggctgaggcaggagaatcgcttgagtccgggaggtggaggttgcagtgagccgagatcacgccattgtactccagcctgggcaacaagagtgaaactccgactcaataaataaataaataaatagagtttgagtgcctctccccacgtagactcctaaggt

SEQ ID NO: 85838 - DNA, 1049 bp, Homo sapiens
agagtgcaggttaagggcgggtaggctctgctggcatggtggagggtaaaccccagctgctcccagagtgtcagaagcctcctggggctgaggcttgacagtccctcagtacatttcttggatttctcctctttgagaacaaatgcttctagctattatctcctttgctttttttttgactatttagccatcttcacaataaaaataagcagtaagtaacaaatacataccaaaataaataccaggtgttcatgttgtgtctaattcacacagtttacaagattattatgatcactgtttgtatactatttgggttccagtttttttgattgatgtcattttatatggagctttccatatggttacattgtccacacatttgtcagtttaaatggcaatacaacaacgggttgtacctaaccatttcttaattctaggcatttgggctctttccaatttggagctgttatatagagtgcatctataaaaatctttgcgttttttttctttttctttctttaagtcagctcactggacatacattcctgaagatggaatgggtaggccagaggatgatgcattttgtggctattgttcacgaagagctactaagcaatttcagtgtccttgccctccctgcaaacccaggcattgagttcactatgtatttattgtgagcaggtttagagattatacctcccttgtttgtaccatgtccctgggaatcagaatgggcaagtgttgttctctgtagtttatatttggggaagagattagatgggaataagaggtttgtgcaaagaacccctgtcccagcactctcgtgcagctaacatttattaagcgcctacagtatgatgagtaagatgggtaagttctgctcagaggtgaatcacagtccagggatgacaaagacgcacaaacagctccccaagatacattctggttgtggctcccagctctgccacttaatagttgcagcgctctcggcaattcaccttctttatttccttatctagaaagtgtgttgttatgaggattcaatgagg

SEQ ID NO: 85839 - DNA, 1071 bp, Homo sapiens
agcatccccagggaaggggggcctccagcaggttcagtcgttggaggaggaaaccaagacccttctgcaactgcagttgcggcaggaagccattccagtgcacctgcttcctctgggctggcctgcagtgaggcgggtgcccggctgctttctgttccgccctggggctggggagggctctggctggaggctggactgcaagggccaggttgtccctgccaagctcatctccccctcccccgctgtctggcagcatggccttcagttcattccttagagagcttcccttcctctcaagcagttccacgtaaagcatattcaggttggtgggtggaggggcgggtcatcattgggaacccctgctttcctcccaagctgctcttctggcagctgatgtagaaggacaacagtgcaggtgaaccaggggaaatggagggcagggcgtgcctccatcccttaaagtgagcagtggagggctctcgcaggagacctgagtgtgagtcccagatctgccacttgctgctgtgaggctttgggcgagtcacctgaccttctgagcctccttttgctcatttgtaaagtagcagtcacacagtcacactagtatctatttcagagggatgttgtgaggatcaaatgagatgattcatgtgagggattcagcacagcacctgacacataccaaatgctcaataatgattaaccgttttttactattatgctagtatttcttcccttctcctttgttcctgccacccttcctcgccctcaatccctagataagttggtgctaggttgggactgggaggaagaagtctcctgggagctgccctctgtgcctctgaatgggaaagagggaggagaggagaatgccctgcctcttggtcctcagaaggagaagcctccggtgtgtgagtgctgtcagaagcggcgaggcgggaaagtgacctcggccaccagctacgtctcagcttcctttgggcactctcttgagagttacctgctgctctcgggggcttgcagtgtgcagatgtctggtgtggatgcttgggcctcaaagcatttgtccag

SEQ ID NO: 85840 - DNA, 1082 bp, Homo sapiens
tagtggctgtcttggcctctgccgcagtaattagatggctagggtaggcctatgatttgggtgttctcaagaacactgtgttgattgaatgttcgtgcatgctggtgtgtgtgtgtgtgtgtgtatacgtgtacatgcacatgagtgcgcatgtgcttgtctcaagcttggcctgtggggccgggggctgcaggtctcaaattcctctgctatttttaggagccatatcagcccagctgtcccggagctggggtgtgtgtccataggcaagtctcaccctccctgtccttgccctaaccccctaacactgcctgccccccaccccaatggctttaccctaagagccttctccttcccttccacacacactgctgtatcaccctctccctcctggcatacctgatacccgaagtcctccgggctgctggctccaactagggctgggcagctcgggacgggaggggccggggagagggcgggaactgggcggggccacagcctgtgctattttgagctgctaacggagccagagcagcatcagagcggagtctccttgctctgggctgctccaggccaggccatgcgggtgagtgtccctctgaccccccaccccggaaatgtcccaggctcctcatgctatttcctcatttaggaaaggagggacctttttgtgatttccccagatgtggctgaagtaggtggggagaggggtggggcagccttggggctcctctccgagcttcttggtaagaagggagttactcagccccggaagcctcaaaacccctccgtggctaggagcagggcatcctgggcctgactcatgacttcaggagttttggaggggcactgtcttctgaacctcagtttcctggggttgcatccacccccaaggctgtgacacgccttccccaccaaccattagtgcttttttggccttcattccttagaacactgttttcttccaaagccccagccccacagcacccaaggtcctcggtagtcttgtctctgctttgttgctggtatagctctttcctctcttcctccttgagaggggatggtccttggagttgtcaggg

SEQ ID NO: 85841 - DNA, 1036 bp, Homo sapiens
tttgagatggagtctctctctgtcgcccgggctggagtgcagtggcgtgatctcagctcactgcaacctctgcctcccgggttcaagtgattctcctgcctcagcctcctgagtagctgggattacaggcacatgccaccacgcctggctaatttttgtatttttagtagagacggggtttcaccatgttggccaggctggtctcgagctcctgacctcaggtggtccgcccacctcggcctcccaaagtgctgagattactggcgtgagccactacgcctgcctggcccctctttgccttctcttacactacttcttcaccctggaattcccttcctacctcattgccacattataacatttctctctttcattggcctagctccaagctgtctgtaagctgtctacttaataccgtaactggaacagatctttgcctctgaacttccctagactgttattgacgtccctgacttgaattttaattattggggtacatttgttatctcctctgctgatctgtacatttttttaaatcaggaagtatttagttgaaaacaagaactaaattatcttctttcactcagtcactcaaacgtgcctcatattgtctctgagcagggcccagtgctaggtgagtgctggggatagagcaatgaacaacacacaacctctgcctcaggaagctcagtctgtggtggggaagctgaaaaagaagcaggcacggtgcttccccacagtgttcgccttgaggtattacagttcacagctagttgaataagtgaacgacttcctccagccctcagagcctcctgtctggccttcccccagctctgcttagccactctgcctggtcaagtgcctgaaacagagccaaggaccttccactcatccacgccaccaatgtgggagagcagagcagttgaagttgtcaccacacatggagatccccttgttccccactctattccagcccgtttattgtgcgtgcaccgttcagatcagttggttaaatccatatggattttcgtggaac

SEQ ID NO: 85842 - DNA, 1070 bp, Homo sapiens
caatttctacacctcaaccaccaccagctctggaatcctaatgccccagggccagcaggtccctggctgtgtgccaccacaactggggcagcgcttcctttcctcgccaaggatgtcttctgcccagctttgtaacacacaggtactcacatgccccagtggatttggcccaggctgttagcacagaggtggtgggttggtaggcaaggtagaggcttttgcttcttcctgtttctatggacatagggtttgtgctttattttttacttcagagggttttagaaacaggcccaataggggctccagaggtgaacacacagattctcaaatatttattggatgtccagtgttacgaggaacctgaggcttgtctagaagaacttctctgactttgagaataagcaccacaggcctccatctctcacacccaggaagaccttactgatattttatttaaattgctgtggctgacccttaagctggcttccttttttttcttctgtggaaatggagaagagttgtcatttatatgaaaaagagaacaatgcttcattatgtttattccctcctgtctaccagagggggtggataggagaacatagtgcatgtggtacatttaggagacccagaagtgacccaagtcctgatgagatgtggggcagggctgtggaggattttgggaaaggatcctcaaggctggctcatggctttgggccttgggggagcttggcaaagcagaggcaatttggaagtccccgggggccatgaggaaatccccagcagctgagagacctcagagagcagcaggcctgctgtcgggccagtcaggtggtccctgcagtcggccgcatatgcctgcctagtctttggggattgactcagggtcttggcagagaggacaagcccaggcgtccctacttgggctctgtgcccgaaaaggtgtggtggcacatggctctgagcaaactgatgggtgtgccaatgcagggactgggtgggtgtaggggctggggggagtgtcagagccccaagcctcggcgaccacctctggggcagtgatctgtggctcg

SEQ ID NO: 85843 - DNA, 1564 bp, Homo sapiens
agcaaacacaaaataatagtactttccttgtaaggttgtcttgaggattaaatgaatcaatacatataaaccacttagagcagtgcctcaaaatagtgcctagagtcagtgagcattggccaggcatggtggttcacacctgtaatcccagtgctttgggaggctgaaatgggaagatctcttgaggctaggagttcaagaccagcctgcgaaagatagtgctactttgtacaaaaagtaaaaatattagcccagtgtggtggtgcatgcctgtcctagctacttaggaggctgaagcaggaggatcgcttgagcccaggagtttgaggctgcagtgagccatgatcacaccactgcactccaacctgagtgacagaatgagatcctgtttaaaaaaaaaagaagaagtgaacattatcatcatcctcattaatctgtctctggtacgtcaggaagcactggtgcctggtagcttggtacccgcaggaatgtcacaggtgctgttcctgttaatggctcagctctgctcacggggagtgttggagaactgctttattcttgtccccacgctgatgcttatgcccaaagtgcctttcaggtagagatggggaacaggcctaagcttactcagggctgcacagtaatcttagcgagggattgctttggcctgagtttccaatctggtctgaagtttgattccagtttttaaaattgggctgctttctctgtgactccctccagtcagattcttagctgatggcaagacctctggagtaccaggtgtctttctacctatttgttttccatttgaacaaactcaccctactttttggtctttctacaatttattttgtttcttcacacctgtcttgctcctgacagcccatttagattaggactaagcaggaattgaggcataaaacagaaagacagtcctgacctgccagttccagagtctgtcctctgctccttccaccacccatatgagcatgcctagactctcccacttgtgatttttactgcagcaaaacctctccagtgaagtctctgtgacggaacacaacagtggtcagacccgccaatctgttcctttgctcttctgtggatgcggggctggggggcttctctgagcctcctctccagcatgtcagatatgtccagagtccattctccaccgtgtcctccccttcctactcctcctttgcttcatctagttggtgacacagggaggtgtccagttatgggcctcactgctccatggcagaaatcctggcatgccctggatgaggcttcattggccttatttgctgttgaaagttcaggattctgttgggacttctgattctataggagtactaacatcagataagtcctgcagcgggtggcttggggaagccctcaggccactgcattccagatgtcttactcgtgcttggcccagagaatgcagaaacaaggaaccattgtgtgattgtgcaggcactgaggggctttctcccaggcctgggacgccttggggtgggagtaggtttccattcagtcttggcttctgctcccagctggg

SEQ ID NO: 85844 - DNA, 1133 bp, Homo sapiens
accaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgtgagtgcttccctgggcacctgggctaagcagggatggggaatgtgggcacctcctgcttgactgggtaatcggggtacccaagagctgttatcagagcctagcagtgtgtaagtggggaagccctgctgctctctgagcctgtggggaagcatgaactcaggagaaggtgccccatgctcataatcctctgggggtgccacccctacaaacagcacccccaccaggtttaacctaatgaagaaagacaaggacattaaaggagtcacaccttcgtctctcaaccttgtctgggagctgaggacaagtccccaaaggttcactgcagtagaattctgagcagtttggccaggcctcatggttttatggttccctcctgtgttctgtgtctgttggattgacctaactgaattcagcggaatgcctttctcaacggtgctgggatagaccaagctctgcctgaaccttagtttcagccctggagcccttgagagagctctgctgttggttagtaattaccgtgaaagtattcagcttcttcattacaaggacaggtgaggggtttgggcaccatatttcctgagccctaaattggggtgtataggctaacatgtgtcacttccagatataagagacaatctggacagtaaaatacaatatttccatggtatttagatcttggggataaaaaaggacaaatgatttcaaattagggccgtcatggaacatctgagatgtatagctggtatgattatatctttgggaaagatgacctcaggccagagcctcctcttgcccctgagtgagcaaggaaatatcaggtgaggctgcagagaaagcaggggcagatcataaaggaccttgtaagtcacagttggaattcagatttcatcccagtgaaatgggactattgaagggtt

SEQ ID NO: 85845 - DNA, 1037 bp, Homo sapiens
agctgcgccgcgctgcgctctgctccatccctgaccgggccgaggctgctggatgccgcgtctccgcttctgctgcctgccgggcgggctccggtggccggtgagtgccggtcggcggcggcggccgctcggtggcgggcccggcttggtggggcggcggggcgggctccggccgggagggagggcgggcgggcggcggggcccgccggctcctcctcctcctcccccgtcccctggaagcagcggcccggactcccggctcccgtccctggcggcgccgtggagctcgacgcccgggggtgggggccgatcgggagcggcggggaagggggaaccaccggcccttccagccaacctggggggcgcagggaggcaggacagggtggccttcagtgtggggggatttggggcttggaggcgcccaggtggcccggagctgcggggtgggggctgcagcctcgagggtggggggacttctcctgcccccgtccaggccccacgatggagcgagcgagagagcggggcgctgaggaaggcagcggggaaggggagcacctctaccgacccttttatccctcccagcggccttcactctttcactgccgggcagactgcgggctcctctcaaaggagcagctgctagacagctggcaaaacaatggagaccccgcttccctgggccccctcctcttgggacagaagatgagagggtgaatggtggcaggctttggggattagggagtgcaggctgtgccctgagactgaatgctcacctcacctttccctgcagaggggtggggtgcgtgtgggaaggtcggacaagctgccccaggcctctggagagaccgccccgacgccccgccctgctaacctgtcatgccagttgtttcgccaatgggaaggggaggtggtaggggtggctgccccctcaccctgccccttgttagtgggggtgcgctccttggtcccaaacccggccaggagtgtgggtcatgttcctgggtgcgataaggcccgcagggacaggccaggcattg

SEQ ID NO: 85846 - DNA, 1043 bp, Homo sapiens
ttaagggtaccagatattttctatactgcaggatttctaatgacattgaaagacttttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttataggcaaattgtgttctttatcacttctgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattatgggttgacagatttttaaaatagaatttagagtatttgtgtggggttttgtttgtttacaaataatcagactataatatttaaacatgcaaaataactgagaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtatacaataatttagaagtgaatgtttttctgtaccatctatgtgcaattatactctaaattccactacactacattaaagtaaatggacattccagaatatagatgtga

SEQ ID NO: 85847 - DNA, 1031 bp, Homo sapiens
gtgggggaggaagggaagaaggaagacaggcaggtgtgtattaggtttcttaggacagatattcatggccctcctcctggctggtattgggcccaggaatgatgcatgtcaactctgtaatatatttttccattctgaatctctgaataagcaacatttcccaggtcctgctcccataccttctccctgctcgtttcttgggggcccatgcccatcccccagccttagttgctagggcagtggttattgctatataagtgactcctcttggggtgacaagagaaggctgtcttccgccagagttccccactcttctccagccaccctagaaggctctacacactaggcaggagaactgggccctctcctgggcatgtctctgcagggcaaggagaggaagggcaagggcaccctgagggccttactcacccagctcctgctgctcagcctgggtctccatctggtaccacttgctctgtggccctcctctttatagccctgcggcctctggcctctggccctgtcagcactctgctctccctctgcctttgttcctcatgatccccagagctttggtggctcagcttgctggggcctttgtttaaaccagggatacagaaatccagagaggcccctctgttgtgggcatggctggctgctgcaggccttggctttcttaatctctcagagcagctagggggtgaggacagaagtctctgccatgagtacttgtctcttgtccttctccaggttcctcacaccaccttgggatcttcctaagaccttaagaccctgggagaccccatgtcatatcaaacacatcaaaatgcacctcacttccatacagatgtgcatttcttgttgtttaaaaatgtgaaagaattattgtaattctgaactcaatatgagaaaaaatggttcattgtattcttgggaatctttattatgctgtatttatatataactatgtaagggttgacttcaattatagttgactagcagacatgtgtctctctgtagctattttatta

SEQ ID NO: 85848 - DNA, 1017 bp, Homo sapiens
aaagaccagaaacatcccagcctgatgcattattgagtaatacttaagtgttcagaacaagaagattattatcaatcagtgtagatcgatactggaagacttgcctatttcgtcagtcattcccacttactgaaaggttacttcagcattttcctgtttctgcagtaaaaatgttacacagattgaaatttaactggccaaggatttactttttgctgcagggtaagcactttcactcatttactagtgtttcacaagtttactgggctcttgagtatccacttattgccacttgtaagacccttagttttagcttaagggaagtaccacctggtggagaaaaatcaaatagcaggcttagagaagaaagtgatgttttctctttttttacttttgtcttttttcctgccacattcagcataactgatgataaatagcatgaacgtcagtctgtccacaccctcttgtcccatccctcatatgcacggaagtggaaatttcagagactcacagctgaacagatggggcggaaggacatgagacgctcaatgtggtaggcattactcccactccaggcatcccagcgagggtattctcctctctccaggataaactgttgcccacagaagctggtatgctcataaccaatccagctgccaaagacatgtagtgtttgttcatggtgttcaaagcctatatggccttggggagaaggcatctttcgttttagataagtcaatagtggggtaaaatatcaagccaatcccagtagagctgtacaaagtaatttgtcacaagagttgaggaatgagttgacaggtatactaagcaggttagtgaatgtaatatttgtttgggggttatcactgaaaaggtctatctacttcactggtctgagtgaagtgtattagcaaagccaatctaaaattatatttcctggctgggtgtggtgtctcacgcctgtagttccaacgcttcaggaggccaaggcaagcagatcgcttgagcccatgagtt

SEQ ID NO: 85849 - DNA, 9298 bp, Homo sapiens
ggttttacttagatagttcccacactggttaaaataaattttgacttcatttgctgggaacagcaaaagaaaaatccaagtgtttcttttaatattggattattggtgacaagcttttttctttggctgctgtattcaaatacactgcttttgtaatcagtagaagtacataaaacccttaagtgaactcaaccatctctgatctgcaggagttgaggccctcactggctagaggaccctgtacttggaattcattggaattccaaatagctacttccaggttgagaaactggatcatacatgtgttggtacaaggaggaaatgggcttgaagttttgttttcataaaaaaattggtcagtttaaatgatggttatttgggattgttattggaatacgggcattttgagattctagaccttatttttatttatttttttaacctttctagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtgtgaggaaaagatggagatattaaaaattagtaaatgaatgtgtataagacattagtattcagagaatgaacttgtatttattttgtgccatttgttttcattacacagaaaaaagtcaggtggtttaaatccttaaaagggtagtattgaaaaatggcactaagaatgaaattatgacctatttttttaatagctatgaagatactaattatgggtgaagatttctttttaaatctgttttgattattgtaggcttctgtgtcacataccactcttgtaggtgtcctcaataatccccttttcccacaaaatacacagggtgtattatctttctctttattcacccccactttgctgaactgaagttaattacatagcctttcttctaacctccttagtaatgaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaagtgctgcattgtttttacaaataacagtttgtagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatcccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttctgaggtgtttgttatcttttgtgtgctttaattttttaaaaagtctttactgactaatcttaaattcagctgataaaaagtaaaaagaaaaacaa

SEQ ID NO: 85850 - DNA, 1240 bp, Homo sapiens
tgagggatatggaaggaaattagaaaagcaatagctttctaaagatgtttaatcaagtgttgcttctaagttaaaaagcccaattcaggtggggtctgggtttgttttttgttttttccttttcaaatatatactcaattcaacctctgtatgtcacaaacccagaaagtttcttgtgagttgtgagacggaagaactttaaaattccaggcaagcaaaatggacatttaaaaaaggggactagagaggggaatctggccctaaggcgacaagtggttacacaaggcaattgaacacacagcagaactttaaaacctgtaaaacaaactggagccttttttccctttaatcaaccttatatgtctttttttttaactttttgaaaatttttatttaaaaaaacacaaaaacacagacttttttcacttcagttatgtggtatgttgcattttccagtttgttcaatgctttaaagctcaaggatgcctctgctttcaattgtacatgggcctgaagcatcctagcttttggcaagcaggcaggagactcaacaaaaatcaaaataggaacaaggcagactaaatgcagggcacatctgtaaacatattatacatttgaaaattacaatatcagtcaaagtgatacagtttacaggtgaaatgaaactatctggaactggcctaccacaagtttctgaacctggactgatacaataagttattttatatatatatatatatattatgtataaaaaaaagttttgtttacatcaagtggaattggcaatccatgcttatacttttaaaatctaagcagggcagaaatccagactaaaaagatagttactctactctatgttgagtccaacagcttctttcatgaactacttgttttaaaagcctcaaataatcaacaaaacaagaaaacccatccatactacagtcactcaaaactggacatttctaggggtagagccaaagtagttactttctccccaaataccccaggggatccagtctacttttatcagaagactacaactctttatataaatgccctgatattttaacctgtatttgacatacatggatatactaatttctgtgtgtgtgatgtgatgctgtgtcaggccagacaacttgttattatgttactaacatcacccaatctcaattggacccttaatttctgcacacacacacaaaaatttattttagcatgctatacacaagctgcagtg

SEQ ID NO: 85851 - DNA, 1032 bp, Homo sapiens
ttttacatattaggaaagtgaggcccagtgaggttcctgtaaactagaaagtggcaggactagaatgtagcttcccctgatttcccaatgttgctctttcttccggagttactttctgtgtatcttaccaaacaaatgaaaaaaacatagactagaaaatacaccctgcaggctgggcacggtggctcacgcctggaatcccagcactttgggaggcggaggcaggtggatcacctgaggttcaggagttcaagaccagcctggccaacatggtgaaaccccatttctattaaaacagttagccaggcgtggtggcacatgcctgtaaatcccagctactagggaggctgagccaggagaatcgcttgaacacaagagatggaggttgcagtgagctgagatcacgccattgctctccagcctgggcaacaagaacgaaacttcgtctgaaaaaaaggaaaagaaaatataccctgcaaagtagacctacctgtttttactgtaaaatggccgttaactcttaggaatgagcatgttcttcatggcagatttccaatgggtggccctaggagtcccagaaaggatattattatattatctctggactaaactagattgattcttagctgaagtggacttgagtttttctgatactattttcaggcctttaaaattttccattgggtgaccagttgtattgacttgccttttttttttttttttttaagcatgtatacttgaaaaagttcttagggaaggtagaaattatatatgtgtgtgtatatatataatataatatatataataaaataatatataataaaaacagttccctggccgggcgcggtggctcacgcctgtaatcccagcactttgggaggccgaggcgggcggatcacgaggtcaggagatcgagaccatcctggctaacacggtgaaaccccgtgtctactaaaaatacaaaaaattagccgggcgtggtagcgggcgcctgtagtcccagctactcgggaggctgaggcaggagaatgg

SEQ ID NO: 85852 - DNA, 1225 bp, Homo sapiens
taactgtaatctaaatccttagagcaaataatgaggtttaacgatgatgtttatatccttttgcttttgagaacagtgggtttcagtcttcccatctttcctacctcttcctcctttctctaacagaaatgtatgctccatgcatgcatgtacacacttaatacatagtgcacattcccattttaacagtggctcatttaggcagtgacttacaattgcagggaaaggggaccataccagattgtgggaattgggtaattaccatattctctctggaagaaatactgcctcagggatgaataacaaagtgatttgtgacttctaagcaaatttcctagtctgcatacgtttccttatctgcaagctggaagacattgagtataataaatagatgtccttttaatatcattttacttccttaaaaatggaagtagtagaattgcttaatggaagtttaggaatcctcacagataacatttacctgatttcacttattctccagctctgctctttgaaggtaaatacaggagttggttgtttttagcaatgttagggcaaaaagataaatgcttcgttttttaagacatgtgttatacattagttaacctctgccaggagagttgggttttttggtattgttttctgtgccgtctgccctctagagactattactggaaaatgtttaccgaagtattttgcactggcgatcattgtgtgagcctgagagggtatctggttgtgttgtgttctcttaccacctccaaaatattctgggaggcccagtgtggtgggtcatgactgtaatcccagcactttgggaggccgaagtgggaggatcacttgagctcaggaatttgagaccagcctgggcaacaatgtgtagtcccagctacttgggaggcttaggagggaggatcacttgtccctgggagatccaggtctgcagtgagctatgtttgcaccactgcactcaggcctgggcaacagagtgagaccgtgtctcaaaacaaaacaacaaaatgtgtaggatatgttccattaggtaactggttaatagttcttatgtacaatttctattaggtggaattgcaggccatttttaaattggaatgttaacctgaatttactctttatgcattttccctatccatgggctagctgaatatgaaatcagtggtatttatataagctgaatacccctatatgggtgcagttatatttagtt

SEQ ID NO: 85853 - DNA, 4060 bp, Homo sapiens
ggcattagccactgcacccggcctgtatatctgtttctaatgacttgacctcaagatgcttttatgaacatttcataaaaaggtagataactaatagcaccattttgttacagtggaaaactatttgaatcacctataatagaattgactttttatggtagttgaaggtttttttttcttttcttcttgaaagagggtctcactttgtcactcaagctagaaggcagttgtgccatctcagtgcatgttcactgcagcctcgacctcctgggttcaagctatcctcctccctcagctcccccagctgggagtataggcacatgccccacgcccagctaatttttgtatttgtagtagagacagggtttctccatgttgcccaggctggtcttgaactccagcagtctgcctgccttggccctcccaaagtgctatgtttacagacatgatccactggcagttgaagacttttaattaaacctgaataccataacactaaaaaattggattctttttattgttgttttgttagtaaatattttctcattgcatcttttgagtcaaggcagtattacatagtgataggaaaccatggattgcagatagactggcggtcagatttccagttctgtcactttgacttgggcaatttacttcatctctcttaaagtctttttatctaaatgtaaaatgaagaaagtatgttttataaaggttggaaacattggtacgtagatattttggtttcacgtattaacaatatccaatatctgggaaatgtcaaaatgaaatttaagaatactttagaaaaagttgacaagtgttagatatttgtctgatagatgccttggaaactgctgatagtgactaccagctatttatggttttgtagaaatgaagtctttaatttccttgtaataattactgtttcaataaaacttgatttttgcccagagggcatctctgctctgaattgtaaagaaaattttaggccgggcgtgtggctcacgcctgtaatcctagcacttcgggaggccgagacgggcggatcacaaggtcaggagatcgagaccatcctggctaacatggtgaaatcctgtctctactaaaaatacaaaaagaattagccgagcgtggtggtgggcgcctgtagtcccagctactctggaggctgaggcaggagaatggcgtgagcccgggaggtggagcttacagtgagcggagatagcgccactgcactccagcctgggcgacagagtgagactccgtcttgaaaaaagaaaattttataacagccttgtgagagtgatgggtagattgattctgttagatgagaggtatttggcatactgcttaagaggtcttgtcttctctggcctcagactttggtttgaatcttcgctgagttctacctcttgctttgcttagcagtaggttgcatttcctagtctgtaaaatggggctgacaggtgtcttctcatagagatgtgaaataatataaagctacagctcatagcatagtgtctagcatacagtaaatagttcttaaatgttaggtattagtgtaatttacatgttgtgatttttttttttaatcctttttttcccctcccctaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacccatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaaggtaactcatttgtttcctatacaaagatttttattggccaatttagtatattgtttatattaagagaattttaagagaattagttgttcatattaagagtattttaagagaatgacaatgtggataagcagctggtgtcaaactaattcagggtccttggaactagtatgattaaaatttagaagaaatgttcacttttccaacttaaaaggatttttaaaaatacaaacataattgacctacctggttcaaagaacagaagtgaggagaacttgcttaaaggtattgatgttatattttctcttgactgagtgcttgaaaaaaaattttattgaacatatgttctccttccgtggcttttttgtctttgcttttttgttttgttttgtgttttttttctttgagatggagtctcactctcttgccaggctggagtgcagtggcgtaatcccggcccactgcaacctccacctcccaggttcaagtgattctcctgcctcagcctcctgagtagctgagattacaggcacgcaccaccatgcccggctaatttttgtatttttagtagagacggggtttcaccatgttggccaggatggtcttgacctcttgaccttgtgatccacccacggcctcccaaagtgctgggattacaggtgtgagccaccacacccatttgcttatttgtttttgagacagagtctcactctctcaccca

SEQ ID NO: 85854 - DNA, 1034 bp, Homo sapiens
ccggccggggttgtgtaacccggtggcggcgcgcggccccgggcgggtccctggggtgaggggcgggggcggttggggtgggggagggaagcggccacgaggggagcggcctgcgcagggccccgcgcgccagcggccgcgtttcccgctcccgggtgcggcgggaggcgcgggcagtcggggcggggagccggcctcgaagcggagctgagagggaaggaggccgcgggcggcggccgcggcgctcctagaggcaggaggcctgggggggcggcggggggattcatttcgggtagaggcggtgcctgaggccgggtggggtacccagcgggaacccagctccccggtcacgagtttctctgccacaggaacctcgtctcctgccaggttcgctcacgactccgcctctgaggctttcacttgggccttttccttctagcagctcattttctacaaaaaaaaaaaaaaaatccaaaaaccttgttccattcccctcccgacccagcacttaccttctgagcttgggtagtgtctttgaggtgagggattttaaaaaatgttaggatggggaagagtgcgagctttttgacccctctttcttgtccttaagggtgaacccaagtggctcatccatgaggttagactactaccatcttgcctcggatgaggcttctctccgtgttaaaaagaaaggtgtttttcgtattttaaaatcgatattgatccccaaactaatcttaataaacgagaaattgagggtaaaagtcatgtaagaaagtatttcacgagaagtgagtttaatagtttataacccacgcagattttaaaaaataagggctctttataaatcgaagagaaatgaagcgtaagaaagcgtatgttaaacccagcgtatcaaatttgatagaaggaattgttgagagctggagaaatactaagtgcttttttattgcagattgtaacttgaagactgaaattagaatgtcagattttccattttgggacttcgtagggacccgatagtatgcaataga

SEQ ID NO: 85855 - DNA, 2002 bp, Homo sapiens
ttgggctgggcggcttgctggggctcgggggtggggggcggcgatctgtcgccgggccccctcctcctcctcactcctcaccctccagggtagcggctaccggagcgctgcagggggctgcgcctgcctgctccgccccagacctgtcggcgaaagggtaagggcacctctgctttgggaaagggggatatagaggggggcggggaaattcggcccactcgggcctgtgtgtggaagaagggatgtgggagtggggtgggggagggagaaaaggagggtctgtgattctgtgggtggggtgaagaagctggtgagctgggcgccctccggttttaaggggcgagagcaattccattcctttttcctgagggtcaccggaaggggtggtggaagggggatgtttcgaggaaggtgtggccctcacagggagactgggttgatgtgcaccccggtttaaaggcgcgaggtccccttcccctctggtgcctttgctcctcttctcctttgtagtgtctgtgtattcttgggaagggagactgctctgggtggcttgctgggtggattccaccccctagcacaggaaatctatacccctcttctgtaggggcgatggaagcgtttctctccccgtacccttcccccttccccatcctctagtctactgcaatgctgcagaagtccaaggcagtttcttcatacacagacccatgtatacacagaagggagggggagcaggagagggaagtaatggcgcttcccttgaaaaggttactctttttcctttggttttaaatcgacgacagtatcgttttaatactcttcccctgagatctgtccatgggaagtgtatctgttctggtgttattgttgggggatatggcctctcgagagggacacctctcctgttagaacagttttgatgtctctctttttgagagatgtctggattgacattttttgtgagcaggttggattttagttagaattcaaataaaataattttgtacctcctcatcctcatttcccttttctttttctatgacttttgtagttcatgaagaattattggcctggcgcggtggctcacgcctgtaatcccagcactttgggaggccaaggcgggcggatcacgaagtcaggagatcgagaccatcctggctaacacggtgaaaccccgtctctgctaaaaatacaaaaaattagctgggcatggtggcacgcgcctgtagtcccagctactcgggaggctgagggaggagaatcgcttgaacccgggaggcggaggttgcagtgaggcgagatggtgccactgcactccaacctgggcgacagagcgagactccgtttcaaaaaaaaaaattattaacaattattacatacagacagcctgtctgattcagggcatttctccctaagctgtgaatttttagggttgatactgttgtgtataatattgaaattggattttttttaaaatggtaaggttacaaacctttctgcagctgtttctttgttcttattaatctgcctaattattctatgatctattttctgtagtcagtcatttttcacttcttttgctacctgtcatgtttgtctgaaagcagatcatcttatctggtttacagtagtacttgttggttttgttcttagttgagtagaaataaaaatttaaacattctggaaatgtgctgccaagtgctttttgtgaccaaagagtagttttcaagtctccatgtactgatgatacatttttttcaagtgtttagtaaatactggtgatgtgatttcaaaatattccacatatgactattaatagaattaattttttcccaaagtgaagaagaagactaaaatgtgtacagataatgagttgtctttggtgtatttagtgttttcagctctacttagtgacttatttttaaatacttcaaatgccatctacattttatgttgtcattaaatgttgtccaatagagcttttttggtgtgtttgttgcat

SEQ ID NO: 85856 - DNA, 2125 bp, Homo sapiens
tgatatgtagagttttctccattatggcaaattatgccaggaagtctgattctccgtattatggcttgttgttgataattatttcatatatactagcatgtgttgatcgaagcatactgctcagtaaggagtgactgcttttaccttgggaagttgtaggcagagaggatttatcaatagaggctacaaaacttaaaggatttacatagggtgtaggttaactatttacttgctatatttcagcatgctataactaaggacaactgaaaaaaaaacaactctcttttttcatagctggtaggaatgttgcctaaaagtggaaaagtatgttcatgatcaattagataaatacattattaaggaaaaattgcctgagggttatttcagatgacctctgatgccactgtcagaaagaaaatgctgagagctgttagtctgagttgattctagattagtatggcacttcttatgtttctaaatagttcatctacaaaatggcagtgtacatcacttcctgttctttcacaactggctctttcactggattctcttttaatgacttaatttttggcattctgatatctgatttgttaatttggttataattctcatgttttataggtggaagaatttctgagaatcagctggatttaaaggcttttaatagtttaagattatcttgacagtaacaaaacattgcttccaaactaaaggatagtattgcaaacaaatttaaactctgagaggttttaaagaagtacagcaatgtacagaatcagaagtatgagggcactgaatagaaaataattatcgtattttttataatgtcgattttgggagaagtgaggatatggcaagtaattgaatgggtgttgatataaaataaactttctgtataacaaggtgtatacatgatatttgggcccatgttacgatgccattttaacagtaagaaagcaactctttagttacaggatactagaaagactggatgctcataactaaccatgagtatgatttattttaataatttgccagtttttttttttttttttttttttttttttttttgagacggagtcttgctctgtcgcccaggctggagtgcagtggcacgatctcggctcactgcaagttccacctcctgggtttacgccagtctcctgcctcagcctcctgagtagctgggactacaggcgcctgccaccaagcccagctaattttttgtatttttagtagagacggggtttcactgtgttagccaggatggtctcgatctcctgaccttgtgatctgcccgcctcagcctcccagagtgctgggattacaggcttgagccaccgtgcccggcaaatttgccagttcttaatagacatgaatatttagtaaatccagaagatatctaggggtcagttgttggcattgaaattagagttgagatcaatctgtctttcgtgtctttcacctggaaataaagtctgtgttttgcatttggcttatttgtatattaaaatcacttaatttttcatttgtatctctgttttgttttcactagtctctgttacttataacaattaattgcactcatactaatttaatcttttagaaatgaggagcatttttggtacatattagttgagggttgctgtttggatgaggatcatatgtgaacgaatcccttcaaaaaagtgttatttctgggctgggcaaagtggctcaggcctgtaatgccagcgctttgggaggctgaggtgggaggattgcttgaggccaggagttcaagagcagcctgggcaacatagcatgaccctgtctctacaaaaacaaattttttttttaattagcatgggctaggcatggtggtttatgcctataatcccagcatgctgggggctgaggctggaggatcacttgagcctaggagtttgaggccagcctgggcaacatagtgagaccctgtctccaaaagataaaaaatgaaaatattagtggggcgtgatggtgcgtgcttgttctaactacctggcaggctgaggtgggaggattgcttgagcccagaagatggaggctgcagtgagttgtgatcatgccaccgcactctagcctgggtgacagagtgagactg

SEQ ID NO: 85857 - DNA, 1040 bp, Homo sapiens
tcactctgttgcccaggctggagtgcagtggtgaaatctcggctcactgcaagctccgcctcccaggttcatgccattctcctgcctcagcctctcgagtagctgggactacaggcgtccgcaccatatctggctaattttttgtatttttagtagagatggggtttcaccatgttagtcaggatggtctcgatttcctgaccttgtgatccccccgcctcagcctcccaaagtgctgggattacaggcgtgagccaccgcacccagcctatggacgtgtatttttatttctactaaccctaagtcttctaaattagaaactttgggattatttttgatttgtttaatctcttttctcacctatattcacacaataggttatgaagtcgtgggatttcttcttttgaaatgtgtttcattctttgttctcttttccaagtatctgtaacattcttgtgagagggtgtatgtgtgtgtgtagccttattttaggagtaggggatgtaaggatgattgtgcagatgatatatttgctcagtgaggtttaaagtcaggtggggatgctgacattgaatttataggatggggaaaagggctattgctgttggaagcactctatctgtaaaagtatcattttagtccctgttttgttctagtcttattattgttgctatttttagtttgtttttgttctgttatgtattcacggatatgtatgtggtgtaaagtggtgaaaaagtttatcgtcatggatgttctcattgctgtgtgagcgggcaaagcacttaatctctgggcctcagttcattgtctgtaaaatgggaataataatactttccacatagtgttaaaaggattagatgcattgttacatgtatagctcttagttttgtttttgttttttgagacggagtttcgctcttgttgcctaagctggagcacaatggcatgatcttggctcaccacaacctctgcctcccaggttcaagcgattctccttcctcacactcccgagtagctgggattacaggcatgcacca

SEQ ID NO: 85858 - DNA, 1051 bp, Homo sapiens
ttgtttttattgttttttaagattatctttgattgacccctccatatctatgcagcttgcttttccttccttccttccttctttccttccttccttcctctctctctctctttctctctctctttctttttttgaaacaggatctcactctgtcacccaggctggagtgctgttgtgcaatctcagctcactgcaacctccatctcccaggttcaagcgattctcctgcctcggcctcccgagtagctgggactacaggcatgcgccaccatgcctggctaatttttgtatttttagtaaagacggggtttcaccatgttgaccaggttggtctcgaactcctgacctcaagtgatccgcctgccttggcctgccaaagtggtgggattacaggtgtgagcccccatgcccagccgatacagcctatttctgattactgcccagcacactttgcctatgtttatgatgtctcttttagtgcccttttggtctcatctcttctttttctctgtccattcaagtcctcttccatgaagttgtccccaactgcttcagcttatactgtccttgttcttctctaagttctttttggctcatttatcagtgtcccagtttagtacttaatgagatattttcctttttttgtaagtacttaattgtcttagcttttactaggactatggttattttgtgtccctcccatttaatgcctagcataggacatacagtactaattgttgaatagaatctaattgaatttttaaagtttaagttctttaagtgttggatagcagctagcagttataatagagaatttggcagtgaactagggcaactatttatacaacgaaagtaaaaagcacagcatagcttcatgaacccatataaatgttgatgctattccactgtattagaccgtagtagaatcagaaatgctgaacccatgggaattgcttgtgtgagtcttgcacgggaattgcacagtaggtctttgaactttctgaggttgtgtacaaatttggtatgaatatgcacatgtgcatttttctag

SEQ ID NO: 85859 - DNA, 1025 bp, Homo sapiens
tagtacactagcatacggtatctgaaaagaaaagaagtttcctgttgtcagaaatactgtgggcacatcttgcgttattgtgtatttttaaaatagtctcttttatattatcttctctattgatgagatgactgcatcagaagtggatacatttttaagtattgacttagaaaacctcccaagatacaaagattatctcatttttttaaagtgctgtatagtaggaatctgtttttgaagtaccatggtgttcatgatgatgaaacaggtttaggagctactgcagtagtacccacactgccttttcagtgaaattctagacatgagataaatttgtagatcagtatatgaccttatactaattattcttagcagtttttgccttttctgactttttttttctatttttctacagtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgtaagtgttagtggcttgatgtcagtgactaaaatttacttaatgtccactcctgacagagcaaaatatagtaatgaaaagagatataggccatagtcattttatagtcacttgcatagggggaagagagagagcgcgagagcgagagcgtgggtgagtgtgtgtgtctgtgtgtaaaattcaaatatgaaaatagttttatttattgaacttcttggattattgaaaaaatgagaaagaatattattttgtgggccaggcttggtggctcacgcctgtaatcctagcactttgggaggcaaggttgggtggattgcttgagtccagcagtttgagaccaccctgggcaacatggtgaaaccctgcctctacaaaaaatacaaa

SEQ ID NO: 85860 - DNA, 1024 bp, Homo sapiens
gaatataatttatttaaactttttaattttgacattttatctaaaaatgaccatattttgggaggccaagacaagtgaatcacttgaggtcaggagtttgagaccagtctgagcaatgcagtgaaaccccatctgtacaaaaaatagaaaaattagatgagcatggtggtgtgcgcctgtagacccaaatacttgggaggctgaggtgggaggatcacttgagcccacaagatggaggttgcagttagctgagattgtgccactgcactccagcctgggtgaaagagcaagaccctcccaataaataagtaaaaccaagcaaagttgcatgttcttgttaactcttctaaatttagtaattacttttattcttatataactttctgaggaaaagtcctgttcataattctttaccttttttctccccacagaaatggcaggatattattaaggaagtcaagtttctacaaagaataaaacatcccaacagtatagaatacaaaggctgttatttacgtgaacacacagcatgggttggtatttgttctccccttgttgcagttttagctgattttggtttataatgaattaattcagaatatctcatactggttgtgtaaatgcatgcaaaaacacctgaaatgttagttcgtactgaaagaaaacaagcaatatttcctagaacttgtaggcagtaagagataatagaacttttgcaagtctcactgcagagatttttcagaattctgttgacctttgtatgtatgataaaatgtcctatgacagttttagtagtaccattcaaacattgtgaaaacaatcatgttacttgaggttgaaagttagcatatgttttcttgacataaatgtactgtaatgcatttaaccagaaagatcatgatgaaatttgggtgaatcctggtgaaatttgagctgatcacgattccttggtcgaataacactaaagatagagaattgttgcactttattataagaagtagaaatttattttgcccttttgtta

SEQ ID NO: 85861 - DNA, 1044 bp, Homo sapiens
atcaccaaataattatttaatatcgttagctaagagaagaattggctatgaactgtactttaacaactgacacaactgcatacaagttataaagtttaataatctttatcatcttggaaaataaatctcttcttgctaagtatcagtttttaaaaattgccccatgtattagatatgtatttttttaacaaaaatgttctgtgtattaattattttgaaataaattttaagttcacaaaaagccattacaagaagtggaaatagcagcaattacacatggtgctcttcagggattagcctacttacattctcatactatgattcataggtaagtgctttggaaattatatattgataagtaaatggcttgttgcatataccaactttagaatttattaactctaaagtttttattggttaaagccaaataaaataatataagctcatatttttttagatttttcatgtcctaaaatgaacatagttgtatactttatctcactaggataatttttatctttgcctatatgtgctgctggaccttgtaaaaatatgtatactttctagatttgtggtagaaatttagctatagaatcatttaatttgcaaactggaatgggcattagagaatcatacagtttttctttctcattttaccggtaaaatcactgatgtctcaatttgtgactaatttcctaaaggttgcaaagctgagtagatagagctagaactaaatctagatcttttgtcttcttggtaactgataatgacatatttattccattgattctatgacatggacgaataaaagctgcttaaggccaggcgaggtggctcacacctgtaatcccagcactttgagaggcctaggcaggtggatcacttgaggtcaggagttcgagaccagcctggccaaccaatatggtaaaacctcgtctccactgaaaatatgaaaattagctgggctttgttgtaggcatctataatcccagctactcgtgaggctgagagaagagaatcacttgagcccgggaggcggagttt

SEQ ID NO: 85862 - DNA, 1073 bp, Homo sapiens
ttgggaggccaaggcgggcggatcaccaggtcaggagatcgagaccatcctggctaacacggtgaaactccatctctactaaaaaatacaaaaaattagccaggcatggtggcgggcgcctgtagtcccagctactcgggaggctgaggcaggagaatggcgtgaacccgggaggcagagcttgcagtgagccgagattgcgccactgcactccagcctgggtgacagagcgagactctgtctcaaaaaaataaataaatacaataaataaataaatacataaatctcacactatatatgcattgctaaatatttacctcacaacctgtaatgcacttagttcccgttataaaaattcttatgtccagatatattggctagaattcaaaccagtgatctccatgtagatgactgttacattctcaaaggatagaatactttttaaaaaaaatctttaatttaaattaacgttttgttctaggatggccccagaagtaattttagccatggatgaaggacaatatgatggcaaagtagatgtgtggtctcttggaataacatgtattgaactaggtaagcattgttcttcattactatggattaagttttgatcaatgttttacctcaatttctgtaccaatctataaaaattatagatttttatcttaaatgtcactttataaggggggcaatacatttattaaggttttcactttggttatttggtaagttttatttatattagggttacctatattatatttgctctgttccattatatctaaaataattttccactgtggttttaattaagtttgaggaatctatgtctaacattaatgagtatttgttaaacacctagaatatgtttatgattaccagatttaccagctatagaagatctgtaagccattcataactagctggggtagttactactttttttttaattagggatgaaattagatgtcagactgtcatacctacataccattttgtaacagtttgatatatatatatatacatattttttttttttaagacggtaaggccgacttcattcaacaggggcc

SEQ ID NO: 85863 - DNA, 1046 bp, Homo sapiens
acagtctaatgaatggtgagtattgttaatatatatattgctcagtgttgaataaatgaaatgctttttcataatctgttatcaaagtgatttaatttcagttaggtaaaatgtatcaccttataagatattaaaatagatgtattttacccttttaaatatatttattctttatcatgtttccatttcatggcatacgtataactgagttcagaaaaggatggatgatgtcacatgaatgcaaaaagtattcattttacaagaatttgtattttactttctctttaaatttaggaatacctaatcctaattaaataataaatagcatttaagcattaatattttataactaaaatatatgtattattacaacctatagtgatatttgattggagggatggtttataatttatatgatataaaaatataagtaaaatgatttgactttatcaaaattaccaggtaattaaaaatattgggatcactctaattatcatatttgttattcagttttatctgatattccttctaggacttccttgatttgttaaaatttagttcattcatgtaaagaggtttatggacaacagattgacaattttagaaaactaggatttttatcaacagtataaaactgtagtagaaaattaattcctcaggtgtacctagcattcgataaattctagggggatatttagcatatttaataaatattttgaaattcacagacatataaattaggggtacttaattatttaaagagtacataattatggcacattcatataagtctttgccacttaagaatgtgccatataactctagtaaactaataatgctaaaactctgtgccaaaagattctttctatataactctactttgtgtttagaattatatagaacgaatcttttgacactgagtttagtgttatggtatggtttagtacattttgtgctgctgtaacagagtatcagaggcttggtaatttataaagaacagaaatttatttctcactttctggaggctgggaagtccaggaccaagg

SEQ ID NO: 85864 - DNA, 1048 bp, Homo sapiens
tactcaggtataaaaacactctctccagagcagatagagtgatattctgaaacatgctatatagaagaagatccaaggggcaaataagaaagagcttattataagaaaggcttagcaaaaaggaaaatagaaaggaatgttatcttgggtttgaaagaaaaaaaaaagtagataggcttccctcattttgcctcgatatagtaatatgagttgtgatatttaaatatgtaggagcaggattttaaagtaatctgtgtgaatttatctttggaaaatggtgaacattcattggttgctttagatagatcttcatagacttatatgaaactgtatagtctctgcttttttttaatcattccctttccatttcccctcccaccaataggcacgtgtcttgatttgtgaatgtatttttaaaggaaatagcaatgtgttcacttgatactttcctttacaataggtctgattattttcgcaactttgtagattcttgcctccagaaaatccctcaagatcgacctacatcagaggaacttttaaaggtcagttctattatagtttatttatttattttattttaagacaaggcctcactttgtcacccaggctggagtggcagtggcacaatcacgtctcctgcagccttgacctcccaggctcaagcgatcctcccacctcagcctcccaagtagccgggactacagacacatgccactgaacccggctaatttttgtatttttgttagaagtggggctttgccacattgcccaggctgatatcgaactcctgggctcaagtgatccacacctgcctcagcctctcaagggcttggattacaggcatgagccaccagttccattatactttaaatttgttcttacccctaagaaatgattgtaaagaatgtgttttattatttgattctgaattaggattaagtatactctactagtttttaataaaatactagttttttatgccgttgtttctgataacttttcttagatactaaatttttgtattttgtttttcaaattgattagctgc

SEQ ID NO: 85865 - DNA, 1049 bp, Homo sapiens
aaagaatattgttcacgcagcatataaaggaacccaatatctagtgtctaaattcatctttcataattcaccatcattaaatacattcctgttgaaacaaatatgactcagagctgaacatgtcttttgtgtgaaatcatcagttcttagaatatgtaaaccttgagagctctgattggacttaattcttagtgtttagacccttcagttattttaactctgcatttttagttggccaacaaaaatattatgttcaaaataaagaaaaagaatagttatgtatgcacagagtatatgtatgtaaatgataattttataaatagaagaaatttaacagaattatatagctatagattacatgcattatctatcataggatattatctctagggtctgagaaggagtaccttgtcactaattgaaaaaaaaatcaaccttttaccttctaccctatctagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggtaagagataaaaaaatgactccaatattgaattttcacttttggtttctttccttatgcagcttgccctgccataatttaccttatataccaagggtttccaggttgtattttctcaacactggtcctataaaatcccagttaggaataaaaaaaggtccttttttcttggagaaataagaaaagttaaaaaaaaagttttttttaagtctttaatcatgttagattgcatgctctaaatccaacccctttatggtacacaatgtcataatgaaggttctgagaagtccttcgttaaagaaacttgttcatctttgtttagtctaggccttctctaatttcttgaccactgaacctgtttttttattttttaatttttttgtttattttgagacggagttttgctcttgttgcccaggttgg

SEQ ID NO: 85866 - DNA, 1167 bp, Homo sapiens
ctacaatgaagtttctagtactttatttttttttaaatgctccttatggagcagggctacgccgtaggcactgtgcccagaatagccagtgctttttttttttaaaaggagagatttgtattaaccaagaattattgagaaatgagcaggatctctatatataccccatgagatgtactgtagaaatggttattttaaaatatcaagcaatttagataaaatattgtactttgaaaatcacccaaatctgatcagctgactttgttttagacagttggttgaatttttttgtgatttacttgttggtcatttttgtttttcaataaactaacagttgataaacttcctggtcttggaaaataaaagcaatttctcatgatagaccaactttctgagactgtctgccaagtggtatgctaggtgcttatagtcaagaattcagaagagagagatatatattaatatttgaactgaactgaatgtccttttctcttaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagtgagtatttggatttcaatgaaagaaattcaatgttggtaaactgttttcttcatctgttagtttaagagaaggaagaaggaagataaggaagtttcccgaagtttggaacatggctgggctcagtggctcatgcctgtaatcccagcactttgggaggccgaggcgggtggatcacttgaggccaggagttcaagaccagcctggccgacatggtgaaaccctgtctctactaaaaatacaaaaattagctaggcatggtggcacgtgcctgtactcccatactcccacctacttgggaggttgaggtgggagaatcgcttgaacctgggaggtggaggttgcagtgagccaagatcccaccactgcagtccagcctgggcgacagagtgagaccctatctcaaaaaaaaaaaaagtttggaacattttttaatggaaaaagccttgttaactcctaacctgtta

SEQ ID NO: 85867 - DNA, 1033 bp, Homo sapiens
aaattattcatcaacggatgtattaacaaattgtggtttataggccaggtgtagtggtttacgcctgtaatcccagcactttgggaggccgaggcaggcggatcatgaggtcaagagattgagaccatcctggccaacatggtgaaacaccgtctctactaaaaatacaaaaattagccaggtgtggtggcacacacctgtaatcccagctactcaggagtctgagacagaagaatcgcttgaacccaggaggcagaggttgcagtgagccgagatcatgccactgcactccagcctggtgacagaatgagactctgtctcaaaaaaaaaaaaaaactgtggtttttacatccagtagaatattactcagctataaaaaggaatgaagttccaatacatgctgccatatggttgaatcttgaaaacatgttaagtgataaaagcctagacacaaaaggacaaatattgtataattaaacttctataaaatatctaaaataggcaaattcatagtgacagaaagtaggttaggagttaccagagactgggtggaggtcaaaatagagagttattgctaatggatgcagagtttctgtttgggttgatgaaaaagttttggaagtaataggtgatagctgtacaacattgagagtataattaataccacttaaaatggttaaaatgggctgggcactgtggctcattcctataatcccagcacttggggaggctgattcaggagtatcacttgaggccaggagttcaagaccagcctgggcaacatagggagaccccatctgtttaaaaaaaaaaaaaaaaaaaaagaaaagaaaagaaaaacagccaggtgtggcatatgcctgtggccccatctactcaagaggctgagtagtggaggcacactgagtagtggaggatcagttgagcctgggagatcaaggctgcagttagccttgatcataccactgcactgcattctgggcaacaaaatggagaccctgtctcaaaaaaaaaaaaaaaaagattattccca

SEQ ID NO: 85868 - DNA, 1077 bp, Homo sapiens
aaataatttcttctaattatattgaaaataaagttggacatattggcttccacctgtcatcctagcactttggaaggccaaggagggaggattgcttgagcccaggaattctagaccagcctagtcaacatagggagaccttgtttctaaaaaaataaaattagcctggcctgatggcccgtgcctgtagttccagcttctcaggagtctgaggtaggcagatcgtttgagcttgggaggttgaagctacagtgagctatggtcataccactgtactccaatctgggtgacacagtgagaccctgtttctaaagaaaaaagaagaccagcatttctactttttggctttgctttttaaaattatgtctttgagattgattgatcaagttgtctttaaactttaatttccataaagattcaaacaaactgttcaccttacataatattgtctttttttttttttcctaggaggaagaaaattacagagaagagggagatcctagaacaagagcatcagatccacaatctccaccccaagtatctcgtcacaaatcacactatcgtaatcgagaacactttgctactatacggacagcatcactggtatgtacttacccgaattagagataaatatatttttcatgtgggaccttggcaatataaactcaagtatagctatatattgttttgtatttgggttttattttacgaaatactcatttaatatttaagtgcctattaagagaaagatgttattcaaagaactctgagaaatgttaaactaacaatgtcttcatgacacgtacacaaaaaacgagtatgttagaatatcttaaataagataactacaaggcactaaagaggaattcagataacttttgattaggagcataaatgaagtatttatgaaatagtttgagtatttaaaattagttggatttaggcacagcagggagaggagaaatgaatggtatttccatataagaagaatgtgggccgggcacagtggctcatgcctgtaatcccagcactttgggaggccgaagcgggcggatcacgaggtcaggagatcgagac

SEQ ID NO: 85869 - DNA, 1024 bp, Homo sapiens
cttgactttcttggtagaaaaatcaattgaacatatgtggatctctttctagtttttattctatttccttgatctacttagcctatcttaaagccagtatcacattgtcttgattactatagtgctgcatatcctccaaatattttttttcctcaagattgttttggatattctaggttcttttatatccccatataaattttagaaccagtcaatttctttaaaagacttgttggaaatttccttggaatctgctaacattgggatattttacactaattccctacttagttaatatagaattgtctaaaatgcttttcgaagaagaatgttttattttcttcttttccttacattatttgtatgtctaggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgccatggagaaagaggtggcttattcagtattattactttgcttattttaggttttgaatgtctcagaattaaccaacatggcagtttgatgttagcgtatctgttcccgtgaaccaagcaaattggggaaaaggagaagcatttatgtgacttatataaaggtttctgtaaattgatattacaagaaagggtggcacctgtgtgttttatctctcactaattttgtgtgtgggtcatttaaaacaaatcagtcttaaaactgttcattggagtagtccactttatagtttttgtaatagccaacaaaattttgagtctgaaaaattgatgtgttttaatatcaagtactaggtctgggaactaataagacatgggaccatttcctgattattgatagttttgtagtgtcacaataggtaagttactcagt

SEQ ID NO: 85870 - DNA, 1203 bp, Homo sapiens
cctgttagccaggatggtctcgatctcctgacctcgtgatccacccgcctcggcctcccaaagtgctgggattacaggcatgagccaccgcgcccagctgtgtccgtgttcttaatcactacactaaccagagtagactgcgtgtaaaataattgaatagaatactctgaagaaattgaaaggataacttaggagccctcttcaaatataaaattaggaagtatacaaaagaagaatgttaaacctcttgatatagatttagtcttaagctaatggtaataaaataatatgaataaatagtaaatgaatataaggaaatttgtgctactaattgcccatttaaagaggtaaaagtcacaaccctcttatttactatgcaactataattgaataacagggttaattacatctgtttactggttattctgttaattaggacttttttctggcattatacagcagtaagttatacctttgtcttttgtgttatggattaggagttaaacaaaagacagactcagaaggacttagagcatgccatgctactccgacagcatgaatctatgcaagaactggagttccgccacctcaacacaattcagaagatgcgctgtgagttgatcagattacagcatcaaactgagctcactaaccagctggaatataataagcgaagagaacgagaactaagacgaaagcatgtcatggaagttcgacaacagcctaagagtttgaaggtatggttagcctaagctttttgataacagggaggagaatgaaaaggtatccatgtaagcaggaaaagtcttaagatgatgtctagtcataaagaaattgactaagcttcttttcatttttagcatctttggttgactttaatgttaaatgcctgttgctacagtcttttgcttatgtatttctcatcagagtacaaaaaagtggccaaaacttttaaccatgggaagtgccagtagataagaatcaagattcttgttttaaacttatccaagggcagggtgcagtggctcacgcctgtaatcccagcagtttaggaggccaaggcgggtggatcacctgaggtcaggagttcaagaccagcttggacaacatggtgaaaccctgtctctactaaaaatacaaaaattagttgggtgtggcggcacatgcctatagtcccagctactcggggggctgaagcaggag

SEQ ID NO: 85871 - DNA, 1169 bp, Homo sapiens
taggaggttgaggctacagtaagcaatggttgcaccactgcactccagcctgggtaacagagtgagactccatctcaaaaaaaaaaagaaaaagaaaaagaaaaaatgtaattctctgtcatgaatatgcatagtaatcaaagctaattttaatatctactcaggtcactaactttattagtgaaacaacagatattgttacaagtcctatcataaatggggctgtttatgccctaatgttttaaatgaggttttttgttgtaaaactgcataaaattcaatcagcagtttggccaaatagccaagtgcaaaaagtacctgcaacctgatgatctgacctgcttggctttcctctcatttttttcctagtagcctttattttcatgtatgtaagcataccatataccaaatgcctttcgttacaacttacataaatgtatttttttttcttcccagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccgtgagtttgctttttttggggcaaaacaaatttagtgccccttttcttccaccacctgaacgaaatcacagcaattaaagtactagttggaaatgatagctctcctgaagcttgggaaatgtggtggtggttcattttcttcctgttctcaacattgcttgaaaatgtcatgatgcatgtagaattctcattgatacatttagacatgaggttctaaataggctccctgccagcacagatcctaacaccttattgagattagaatagcagctttgggaagcagtgagcaaaaggtatgattataatgggaataaaaatggttgtgtttgagtacaagtacaaatttttttttttttttttgagacggagtctcactctgtcacccaggctggagtccagtggcgcgatctcggctcactgcaagctccgcctcccgggttcacgccattctcctgcctcagcctcccaagtagctgggactacaggcgcctgccactatg

SEQ ID NO: 85872 - DNA, 1027 bp, Homo sapiens
cacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcaaggaggttgcagtgagccgagatggcagcagtacagtccagcttcggctcggcatcagagggagaccgtggggagagggagggggagggggagaggggattctaggtttttcttaagaaaaatatggttattcaggcatcttccaaatagcttatgatagctttatcttcataccgatattggttattctgcatttctttttcagagatgtttactccaagatacaagagagaaaaattgtctaaactaaaaaagagtagtctgtcttctaacactcctcctcctttccataggtcatgaattgatagctaacattaggatatatcttttttttttctctctctctctctgtctcagctgcgtttggatgaagcacaggaagcagagtgccaggttttgaagatgcagctgcagcaggaactggagctgttgaatgcgtatcagagcaaaatcaagatgcaagctgaggcacaacatgatcgagagcttcgcgagcttgaacagagggtctccctccggagggcactcttagaacaaaaggtataagtaatagaaggaaaaatcattgttttcgaattagcttttgtcagaagcgttttataaatatattttcatgttggcagaggtcacattagatttctttcacaataccacatttcctgaattctagttatggcagcagatttttctttaaaattactgattcactgatgaaccttatcattaatgagctccagaaatcaagggaatataattaagtagtaattgctagagaaaagatatgggtgtgtgaagacagtcagctgaatttgagagtagcagatatggctctattttcctcacttctgtgttcctagcttgctctacctaaggaggttggagaa

SEQ ID NO: 85873 - DNA, 9467 bp, Homo sapiens
agggtttcaccatgttagccaggatggtctcgatctcctgacctcatgatccgcccgcatcagcctcccaaagtgctgggactacaggcgtgagccaccgcgcccggccttgatttttaaatgtatatccatagcatcaaataatagacactagagactacagaaggtgggagggtgggagatgagtgagggttgaaaaattacctattgggtacagtgttccctattcaagttatgggtgcactaaaagcccagacttcaccactacgcaatatgtgcatgtaaaaaaaatctgcagttgtacccccgaatatataaaaactttaaaaattttttaataaattaaagggaaaaagtttaaataaaatttgaaactcatggacaaatatacatccataaaataaccacttcaaagctgaataattattgcttcctttctttatagacttaaaaataataaattggctttcatttttcttccaatctccaacagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgcagtactttacaaacttctagttcgttgagacttagtgaccatttggcatcaagttaacatcacacaataggaaacaccacttccacaagtctcaagcctcagtgctaaagtactactgaaaaggaactaggaagtttggccaattaaaaaaaaaaagtaaaataagttatagtggtcagggaatctcttgacgaaagctaactcttatttttcagggggcacatgttttgttttgttatgttttgttgtacaatgaaggatgaacccaatgctaaaaagtcagttattttcttggttttccatttcttgtatataaattgtgttggaggtgggtaggaagctgtgagtatgacttgaagaaaaatatccttttcagtgacaaatcagagtttcttacaagttattgtcctgctcccttccaagttgtcttgaagaatccttgctgctaactctggatcctgcttttcctatagtcagagggctccaaggtagaactctctaagtccctctcaatggcactctttgcctagaccaaactaatgaccaaacagtaatcaatctatcactgttgaagtcctggttttctcaaccaaattttaagtctttcccaggtatgtcagtcgagttgccatgaatcctcacctgtaggagtttctgggattcattttaaggaaactggaagaaaattaatgttttaatgtaaatgtttttaaaaccaagatcaccatagagttcacacaaaattttaggcagtgtttcaagaagcactcttatgtgttgttctttcagcccatgctccaggtcaccggtttttaggtaaacatgacatgacatgtacttgtaatatcagtgaaaggggcttttagtcgtctcagtatcttttttgcattcaggtattatagcgtttccaacaaattgagaaattacttatttggtgtaaaatgacgagagagctttagaatttaataaaatgtcaaaaatacaatttgatacccttaaaaattattcatagatctggctgctctgtactactggatgggtggaatagggaagcagatcacttttgcatacaaaaactctttcaaacccaaaatattattggtggtacattttaaagtccaattgtggacttaaattagtcaaattgagagttactgagtccattcagatctccagtagggttttgtatctaatgtatttggccaccagttttacatgtaggtcatgactatacctggattttatcattaagttaactttaaagtatatacagtttgcaaaaaatgattcaaattaattggtttgtatatgtttgtgagatctagcttctgaggaatctcatacatagtaggaaccatcatagagtaaagcttgtagcagaaaaattggaagggttttgagatatcctagagaaagagcaagcactttctgaatcagtggggaaatatcaatatttgatcaaattaacactacctccttcccagtgttggtgttcactcactatatgtctttaagaaaattaaaactatggaaaatttgtctagcatatcagaagttgtaaatgctatatctggtatccagaggctggctgtaaaaagttccttggggtcactctatctcacattttttttggttagcattttaaaaatgcaaagccacatactttgaaatatattattccaaattgagctcccttccctttgcacatattttttcctccccttattgaagtcagctctaaccccaaattctagtatccaaaagtatttttatttgtataatgctatctgaaaaatgtgtttatattatattttcagagctgcaattcttattcgccatttcaatacctagagatagagagtcttgtatttgaagccacacacactggtgtaatatgcttagtactctaggtcaaggatttgttggtaaatggaacattttagcatagtcatgatttttggttgcctagacatcaggtaaacattcagtacactaaagaaactatcctggacactccctcctgcttccaccaatttttttctcacccccttttcaaaaattgaaaactctatgagtgtctttttgagaccataaagcagactttagtaactttctatttctgtaagtactaaatgtctggcattttaaacttttgtagaatacattatgttggacactggaataatactatttattttcacctgtgaaaaatgacttcattgtacttgaaacacctcctttgcatttctccatttgtgccattcactagtggaaataaattgtattataccatgatctactggctttttaaaactgtattaaatatgcacatttttggtatagctattatcatttgtatgtatatattgtatatacatatgagtgtctgtatgtgtgtatagatggatggatgtaactcatactgtacatttccatcagggcacttaaaagttctgttatttttgtttggttttgttatttcagtcctcagttaaggcaagaatgcatgtgtttcttaagaatgagtactctgcgttgatgtttatgagaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaa

SEQ ID NO: 85874 - DNA, 1050 bp, Homo sapiens
catggactgcttggccttcaagctccctggggaagcagagggaaacctcagggctgagcgagtgggctggggaccaagggcagcccgcagcctccgcctcttggcaccactagaagagggctgcctgggcccttgagatgtcacctctgtgccagggggccgccagctccgcagagcaaaggccagagccagggcctaaggagaggagagagagcaatcaccctgctgcccctctcagagaacccgagggccaacaagcctgggcccagcgtctctcacctgcacacaccctcttcggcacagcctccctctaccgggagttggctcggagggagcaggccctgaaaggctttcacagtagatccatgccttcttcttcctctgcttcctcctccgcctcctcatcagccagtgggcagcccaggctggctctacccaggccatctccagcgccagcccccatgcagtcagcaccaggggctacgagaggaggtaactgttagagctacgaggaaggtggggacaaacaagaggaaacccttgaattttccattccctgcacacggggccatagccttctgccagggccaggcaagcgcctttcatcagctacatacccgatcctgcgtgaggctgaagtcaggggtgagggaagggttagccatacaagcataggccaggagggcaagctggagcttcagccagggatgggcacaggggtggtagaggaaggtgacatcctcagcctggaggaaaggcacagagacatcaaagcaggcccagagccctcccagagaatctcaagttctcccatccaggggaccagtttaaaggtactcccaggatagctggatggctcttctaccttcagggcccaggaaaggacaaagggccctgggtattggcatgtacccactcttgcctctgagtgttcctttcacccttcctctccatcaagtgccacccttcaaagctcacagcatgcctggataatcctgccagactcagaccacactctagccatatttccctgcaggtgtaacgatggct

SEQ ID NO: 85875 - DNA, 1054 bp, Homo sapiens
gcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctggtgaggagttccctccctaccctacccgaggcccccgccccacctcgcgtcgcccgccgccccccgtagcttccctgccctcccgcccttgactgctcggcgcccggcccacagctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtagactctggagttgagcttgtgcatctgccgcacagagactcccacccggaccctcgtcctaggccatggaggtggtgtttgaggcagcccgcccccgctggccaacctgtccctggacatggggctttaggaatgtgctcgtgggagggtggcgttatcgtcatacatgttagctttgttattcgcaaactaactcttccactagacagacgttcccagcacaggggcttccctagggcgggggtcctggggcacttgcagtcacccttcatgtctgccacctccctccagcccccat

SEQ ID NO: 85876 - DNA, 1010 bp, Homo sapiens
ggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttcc

SEQ ID NO: 85877 - DNA, 1020 bp, Homo sapiens
tgccgcagggtccaccatgacgctcgctgtgctaacatccccaggagctagaggacgacgccatctattcagtgcacgtccctgctggcctttaccgggtaagcctggggaaggcgtgtccatcttagccagtaggttctgagccccagggggttctgggctctgtgctgaattcggggcttaagatgattagactgacctggtccctgctgcactgctggtgagcaggggggcagtggggcacactgactccatccagcgctgccctgggtttcagatccggaaaggggtgtctgcctcagctgtgcccttcactccctcctccccgctgctgtcctgctcccaggagggaagccgccacacggtaatgtttccatgcccagtgcccacagggtggctgggggccgtgtgggctaggggcagtgtgggtccaggaacacggcgctcacagccccttccctccgccctccagagcaagctttcccgccacggcagtggagccgacagtgactatgagaacacgcaaagtggggacccactgctggggtgaggctccctgggtctccagtccagcctgctcacatgccgaggcggggaggttgagagggcccccagtgtgtgaggaccaaggcgggcggctccgaggctggaacgtgtctttctctatatgtatctttgtctctgttttctggacctgggcctcaggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacaggtactgagtggagggggaggtgagggggatgcagttcctgttggcttctagggtgttgcagagagcatgaggggccctgggttctgctgtccctgggaacctcccttgagagccccctgctttatagcctcc

SEQ ID NO: 85878 - DNA, 1028 bp, Homo sapiens
caaagctgctaagaagaagctgcaggcggtaagtctgctccaacagtgccctgacacttgaagctggcccctctctgatcccccaccctctgctcttgcttcctctgcctctgactcgatgaccttttccaagtctttgacctgtcccctcactggcctcagcagtcccctctccctgacctccctacaaggggatggactggtcccttctctcccaccttggagtttggaacatgatccctttccactttcccattctgagactgtaggggctgggcagcacaaggaaggccaccggttccccaaggctcacaacatgctggggagctggccttggcactgggagccgatgcatctgacaacatctgggcccctctcttcctccagctcagcaaccggctttttgaggaactcgccatggacgtgtatgacgaggtggatcgaagagaaaatgatgcaggtgagtcagggagcaggagtgtctggcgtggaggacccgagcggcccaggcatgggtctctggtcctttactgggctaagaaggggtgcctggggttggggctgctcagaggcctgcagatgagcccctgctggctgtgagcctgcctgggcagcatcccaggctgggtagagtgctgagggggaggcggctagcgtgctcctcccccagcctcagactggggctcctcttgctctggcagcctcccactttggctgtctccctggtaccgctccacccccctgcatcactccttcctggccacagccggattccagcccaaactctgggtttggatgagtggcactggccttgttccatttgtctgtccccagccggccacgcccagccttgccctggcccggcctagctctgcgtgcccaaagaccacccctgttctgaacaccagtgctcagtaggcgtgggggcagctaggaaggctgggctcagtgcttccccacccccaccttgggggcctggccaccgtggctgatctgctcctgtccgtcccctacagtgtggctggcta

SEQ ID NO: 85879 - DNA, 1021 bp, Homo sapiens
gagcaggctatagaggcagagggacagcagcaagtgtggacatggcatggtctcaggcatgaaagtgccacatcctggcaattctactcattagcctcgcatccttgaataagccctttaacctctctgagccactgtttcttcatcacagaggtagcatgtcctaccttgcctgacagttgcaagcagcatcacacataatgtacccagctggtacctagtgggtgcccagtcaagcccagctcctttgctctgtccatcttccttaagagggctccagcttacaccctcagtgatgatggcaggaggctccagcatgaaaggacctcacctgctggcaggaggccagaggcaggacctgtggacgggtgtgatctgtcaggcatgtttcaacagcatctggcatgcagcagcatctgggttgcatccccttggggatcccttcctcccttcgggacgggctggggcagagacctcgtttcctgggaaaaggctgagagactggtagcagtggctgcagggcaggaaactgtgcctgctgaatgggccctggggactgcatatcccagaggggtaaggatgtaggaaagggcatggctctgtcagcccccagctgtgagctcttggggagatccctcactggtaacctggccgtagtgatggtcccagctcctaggctgttggagactgagtgagtgaatgtgtggagagtactaggcttggcacgggccagagcaggtgctcaggaggtctggcccatcatctggctccggctgacccttgccctcaccctggcagaccctggctgggcatccatcagcaggggtgtgctggtgtgtgacgagtgctgcagcgtgcaccggagcctgggacgccacatctccattgtcaagcaccttcgccacagcgcctggcctcccacgctgctgcaggtacagggctcagtcgggtggttcttccttcccctcaggcagagtgtgctgagcatgagggcgtttccccctcacccacatacaccccc

SEQ ID NO: 85880 - DNA, 1023 bp, Homo sapiens
cagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttggggtgtgtgcctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcgggtatatgtgcaggggaggaggagctatgtgcgcaggggaggaggagagatgtgcccaggggaggggcctgcaactctggtcactagaggtttggggcatagggtttgggaaggccaggaagcgtaaaggggcttctgggggtcccgaagtagcacgggagggtgg

SEQ ID NO: 85881 - DNA, 1025 bp, Homo sapiens
catgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaacgtgtacttcatcagatgcaacaaaggagggaggtgctggagaaggtgggagagtcagaagaggaaacacagtgaacaccagtagttttcaatgattgatcccagtcatgtcaccctgaagagagagctgagtccccagaaataaatgaaacacc

SEQ ID NO: 85882 - DNA, 1377 bp, Homo sapiens
ctcttctcccctccactgtgtttaatgttcactcactgcattaaataacaacaaagatgggacaaaacccactaatactgtggggaaaaaaaattttcaagagcagaggaaagtctttctgcctttttataattactttttttatcatttaatttacctgcctaaataaacatcttctacagaatatctgtcattcaaccatgccaaggagtttgtgccagccttttcagactcccagaattgggtgttcctgggttatttacatagctgagcagtgtccaggggaggtgcgcagtgaactgtcaaggactttccagactgtcttctcttcagacttttataatctccagtggcatctttcccttttcttttgttcatgacctgacctgaagcagcagatttgatagactggcaaagatgaataggaaaaactttgactcttgcccagtgcctgcctgcctctctctctctcctctctctctctctctttttaaaccaccatagactctcacttattttggaggagtgtatgtgcatgtgtacacatatgtacatatataaaaacagttgatgttttggtgtatggggtaaaagccccaggagcatacagaacttgagctgaacctggtcagtagaaagggaaaccccaaccctttcttgatttttggagacacccaggactaatggatactgtagtagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgact

SEQ ID NO: 85883 - DNA, 2531 bp, Homo sapiens
ctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctcaaaaaagtcattttcagagaacacctttatcaaaggcaaattgctgtttttcagtcagctgccacctgcttctcattttgccctctgagaaaaggcatggtttcttaattgagggaaggaagcagattcggaggggtggagataaagctggggattggagatgttcccctgcctttgtgatgatggtttggtttccagacctgaggcatcgaatgggctaaaggtcagccagaagtcagagggctctcagccttcatccagccgcagccctttagagttcctgaaggaggcaggttccgctttgctttaaaagagggtcttccggtgttccagagtgtatcgttacagtaagacatgataatggccggctctgcaaatttatcatatagtttttttcccaagaaaattatttttgaaattaaaacaggaccccaaatgaaatccaagtggtcttctgtagaggaaagcatgataagaggaggaagacataaagttgggggtggagaggctgctgcccagaaactgctgggttggtgggatccacacagatgggcatcttggctctccctgccagaaaaatgtgctctgcagtgtcctcccaactgaaaacaacagtgacatgtttgaaaagcagcaatcgaaagtcagtgtgttcttgtaaaatgaatatgtatgtagggttttaacccttccattacttgaataattctttgggccttctgagtttaatggccatattttcttccagtttattttccttccccatgctgttgtccccatgctgcctatttttttaaatttcatagattatatttgaattgttacatatgtttaacatccattgaatgcaacgttttatttttggtattatcactgttaacacttttttttccttttcctggaaggtttgtcatttctctaaagtttgtacacagtatttatgtacataatattgtcactgtcttagtgtcttgttcatgttgtagggtaattttgatttattctttttaagaaggagtagagttgcaactggaaaacacagacaccagaaatgaaagtgttgggtgttgataggaatctgtacaatatgttgatggtggctgtagttgtttaaatggagacttccaatcaccagctcctgccaaattatgcattagtaactttttcctcagagacacccctaaaggctcccattaggtcacagcgtgactgaaagctgatttctctgtgagactgaaatcccagaacattgtttgccagtatctcaaccacagccaggaagtatatgtgagttgcccagagtggaagctcctagtagaggctgaaggccacaggggaggcctcagccaggggcaagtgcccacagtgactccatttaggatgctgtcgttttgctactgttgtggagatccttaacgcagcagcgcctgtcataaacaagcctcttgtagcttcttacagaaaacagatttagtctagcatgaaacacctctgcatctcattgaaactgaagaggcttgcagatttgctttcgttgatgtccacgttactgaggattgactgagtatagactggagacaggtttttggcttatcacagcactgaggaaaatacaaatgcacagactgtcagcatgatgtcagaggccagagtttggtgggggcagatggcagggcgacccaaaagatgcagaaaaggtagactggggccactgggtcttaagaggagctgtgaagttgtgtggaagccaaggctgggtct

SEQ ID NO: 85884 - DNA, 1032 bp, Homo sapiens
actgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctg

SEQ ID NO: 85885 - DNA, 1031 bp, Homo sapiens
cggtgaaaccccgtctctactaaaaatacaaaaatagccaggcgtggtggcgggtgcctgtagtcccagctactcaggaggctgaggcaggagaatggcgtgaacccgggaagtggagcttgcagtgagccgagatcgcgccactgcactccagcctgggtgacagagcgagactccgtctcaaaaaaaaaaaacaaaaaaaaaacatactttggaggattcttgggatcattaaacttctcattttgcctgttctgttattagaagagtgaaaacagccaccccctgagaggtcttcccagtgatttgcatcccaggcattgtcctactatggtgggtgagagaagctggtgcaggtttgaacatcctcatgataggtgagggatagaaattggggaatacactcatatttatttcaggaaacaaggatgtctgcatataagagaagaaactttaaaaggaaaccactggcctcagttggtcataatgtacaacttaggccccacctatccaaacagtcagcttgcccctccccacagccactcacttgagatgcgtgatatgttgtctcctcctaggggtggctggagctcatgcagcttggaaagggtgaaaaccccatcttatacccagctgattgattacagcttgtcttcataaaaagattgacctgctccttcccaggaaagcacccctttgctgtgcaggcatgagtcagagagagccccacccaagcagcagacaggcagggggagctgagagcaggtgcagagttgagaacaaacagggggtcacattagtgcaggcgcctgagcatgactcggcagagcccaggcgtggcccggagcccagggcaagttgttttgggctgagtttcccattccaccctgcggtttggtaactcctcatcagcttgtaagtcatggagaccacacccccaaggaccatacttagtgacctgtttcctgggcagatgaacctgaccaacaaaagggccaccgttctctttttggctggggttttgggaactg

SEQ ID NO: 85886 - DNA, 1124 bp, Homo sapiens
tagtagagacggggtttcaccatgttggccaggctggtctcgaacccccaacctcaagtgatccacctgcctcagcctcccaaagtcctgggattacaggtgggaaccaccacacccagccccatactgcattttaattgtatgtttctcccactgaatcctatcctttaggataaaagctgtatgttacttacctttgcatcccagcactttgcacattgccttacacatattgtaaatgcctggtaaatgtttgctgaatggattaaagaagcataatattaacattgaataattagtagtgagctgcctcactctaccctacccacacatttgattataaatgtatatgagtgtaccaaagtggagagattgcatagcaagaaaatggaagagcaggacaggacacttggaaaaatctagaaaccaacttttaaaatatccccactattgtattttcctctattctttacctcaatcccccaaacaaggaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaaggtgagtcagtgactttctccaattctccctccttttaagttccctaaagcaagatgaagtgtccttctctgtagctacttctcaagctgatttggatgtgatattttttcaaaaaagacttatttctctatcaatccagttttcaaaacataagtgtaagcatttaagatttgcatgggctggccgggcacagtggctcacgcctgtaatcccagcactttgggaggctgaggcaagcggatcatttgaggtcaggagttcgagaccagcctggccaacatggtgaaaccccgtctctacttaaaatacaaatattagctgggcatgatgatgggcccctgtaatcccagctacttgggaggctgaggcaggacaatcgcttgaacctgggaggcagaggttgcagtgagctgagattgtaccatgcactcc

SEQ ID NO: 85887 - DNA, 1063 bp, Homo sapiens
acgcctggctaatttttttgtatttttagtcgagatggggtttcgccatgttggccaggctgatctcgaactcctgacctcaggtgatctgcccgccttggcctcccaaagtgttgggattacaggtgtgagccaccacgcctagcaagaacagactttttaattagacaattgacaactccttgtcaattgaatttttaagcagctgtttcaggaagacatatttacataataaatcttttactattctggcaagatataccaaccttttatcttacacaaaagtatatgtgattaaatttacatataattttcttcatatgcaaataaagcatttaattttcaagtggaattttatctacctaaactctggtggtggttataaattttgttttatcacttccatgctatgaatttttttctgttatgataagagatttttgtaatcagccacacgcttatttctggtccccttgtgaccaacagaatgtcacttttttgataactgaggggtcataacctggggccatggaataaagaggattgattgtaccatccagattatctgccacgagtctctgggagcctgtatcgcgcctattataatagtatttaatagtagtctcgggttgggcatggtggcttacacctgtaatcccagcactttgggaggccaaggcgggcggatcacttaagatcaggagttccagaccagcctgggcaacatggtgaaaccccgtctccactaaaaatacaaaaattagccaggtatggtgacgtatgcccatagtcccagctgttcgcgaggctgaggcacgagaatcgtttgagcccaggaggcagaggttgcagtgagccaagatctcaccattgcactccagcctgggcaagagagcaagactccatctcaaaaaaaaaaaaaaatagtagtctgttggcctaccttgtacaatttgttccatcagaaaagtttattgacatttgtgtttcaaataggaaagcctcttttctcttatatgtgaatttgtgatatttatactatatgtgagtttgactcctggcc

SEQ ID NO: 85888 - DNA, 1008 bp, Homo sapiens
gaatgcaccactgcactccagcctgggcaatgagcgagactctgtctctttgaaaaaaaaaaaaaaaaaaaaaaagatttggtaatctgggtccttagaatagggttttgttttttttttttttttttgagacagagttttgctcttgttgcccaggctggagtgcaatggcacaatcttggctcactgtaacctccgcctcccgggttcaagtgattcccctgcctcagcctcccaggtagctgggattacaggcatgtgccaccacgcccggctaattttgtatttttagtagagatggggtttcaccatgttggtcaggctggtcttgaactcccgacctcaggccatccacccacctcggcctcccgaagtgctgggattacaggtgtgagccaccctgcccggctagaataggttctgacatccacattttaaaacctcagttagattatatgagtacagaaagaataggcaccttcctctgttttgcatgtattacacctttgagttaaaatctgtatctagttgattaaattataatttggtctgttgtagcttttgctgtcaccaacaggaaaatgtgggtcctgtgaactatgtggaattaactgactgagaattcaggaagaggagcttatataggacctaagagaggctactgtgcctgaacaagagatttcccacatcttttgtagtcagtttgcccagaaggtagatgtatgggagtatcccatacaatacacccaacttctcagaaaagggaagttcaagacagaacaccagatagaactttgcaagtaaatttttcaagtggaagaagttccccctagcatgaggcctgattaaaggctgcaaacaagaacaaataaggcctttcctgtggtttgtatgacaaatgtgggctttctcacctgccagaagagctgccctaccccccaccccagaatcactttggtcctttataaaaattgaaaacacagaataatatcattaaagaaaattttc

SEQ ID NO: 85889 - DNA, 1047 bp, Homo sapiens
ggatcaaatcttattctctggacttactccaccagttatttcctagggatagcctgtggttcatctttaacgtaaattatcttttcattctccagcagccatgttttacacaactactgattttagaactagggaaattcaagttcctgaaaactgccttctcatagatattttttaataatggattacttaatttagctgagagtcaaagaaatttaatattacctgcttgccagtttttcactaacatcctattgtaatgtaatacagatgaatttgtaaaattcacttgtcttcttttgatcgaagctggcttcagatttcccattcatcttttccttgttactgtgttcaggaaactgaactttctttgtctattattggtttaaaatggtagtttcagaacttatctgcattattgttcatttgactagagcccattagtatattgtcatatccgttgaatgggggataaggaaggaagtcctttgtgtaaaagcattctctgcagctgttcctccctaatgctgtaagtttgatgcctggcaggaaatgatatagacatgtgtgataacaaaatgacataaggaagaattgcctgtaagcttccctggcttgtccaggatgattggctggcagccggtagatagattaagggagatttgatatccaaatctgaggattcacaagtgtaacttaagacaaaattgagatggtggaaaaaacctattttgagaaaagtttgggcaaaggcagatggtatgaaaggcaatagccatgtaaatagaccttttttgaccctgctgggtgactcaaagccttgcaattttttagagacaaggacctgtcagaagaatcaagaacttcaaagaaaaaacattctttatgaatgcaagggattttcacatatcaaaacatttctcattgttcttataatttgaatatcttcatggagtaaatttaccattgtactaaaaaataaactagacaaatagcccccatggtatctatattctctttattctcattagctcagatcagaccacc

SEQ ID NO: 85890 - DNA, 1205 bp, Homo sapiens
atgggagtcctcttaatctaccatatgttaaactgccttggggctaaagaacagtgatgtagatgttatcacacaatttctgaatctttcacatactttacaatttctaaggtggaaagaaaaaatcagtatcctatttttagttagggttagagttagctttgcatcgttgaatgatacaggatggttgctgtataactaacataattaagtttaccttaaagaaatatgctaagaacatcaaggcctttttaggtgttcctgtaatttggaaagggtgtagccagtaatttataaatagattgttcttgttgcacaccaaagggcaaatctgggctcaccctttttgcatgttgtgtgaatttaacaacttgtgttttctgcattaatctatttttagaggggtataacccctcttttagtaattcgagggatttggcttagttacacttggtaaagctacaaaatccagaggtttgaatcactcctaaataaagagaagcctcagtattagccaattataagctttctttaaaagttgtaacaatttaggtttccagggtagaagaagtagaattatttgattttttttggtaatgaactaaactatttaaattgttgtatatgtttgtttgaggatggtacctgcctcatttcaggacattttggatatcacgtgagataattattcacaagaaataacaataaaaattccagttatggttgttacttttatcatctgtacttaatatttatccatcaaaatttacatggatattcgtgatccataacaggatatttcaagtcctgagcgttctaattgtggactttatattgattgtcttctgtagtgactgcggaaaagtttatgctacatatggctttatctgtttgcaacttaagcaacactttaagcatacttcatcaccccagcaaaaagctggtcaggtttatgagcttggcatcttattggtgcatttttgtctctgctgttctctgaattttgtgtcataaaaaccagttagtctccatgagggctaaattgaatgagagtttttttcctctgattttaaataaatatcacttacaacagagctcttgggagatgccatttcttcaggactctcctctgacccacgtcccttttaagttactctttctcttaatgttaatatacacagttctcatgaacatcaaaagtttta

SEQ ID NO: 85891 - DNA, 1002 bp, Homo sapiens
gcctccgcgcgacccggcgggcccgcctccgccgccgggtgcacgcgcagcctgcgcctcgtgccggagcagagcagaggccaggatgcggagttgtgcactttgagccggccccatgaccctgagcacgttggcccgcaagaggaaggcgcccctcgcttgcacctgcagcctcggtggccccgacatgattccttacttctccgccaacgcggtcatctcgcagaacgccatcaaccagctgtgagtccgccgcgcgccctccgcctccgcgaacgctcagaaagtttgctctttcagcagccgctttccccagcatcctggggagcaaacaatcaagcgagggcgagcgcgcatcctgcttgcctggaggtctccgtgcgtctggagggaaggatgctggggtagaacggtggggggattcatggaggcggaaagtgtcccggggtgggggtggacggaagaatcctttgggagaatttccgtttaactttgagggactttgaaagtgcgggttgtccctcagaagttgtggtgaccgagtgacagctgagctgtttggcacttggaagacttgggtgaagggtagtcgacagaatcggaagcgggagtccctgtgggtcctgctggtgagcagctttccgtgattatgggttttttttttttaaagtttctattgctaaccatttacaaaaagaaggaccattcttcgctcctgctggttgtagtctggagtgattccagaaggctagatttcggtagtttctattttatctcctcctgtactactggtacgtgctcacagcccaagcctgcacgcacaccttcattcaccaaagcgcaaatgcatctttaaatcgtcgctgtttttgaagtctctagagagttgtcattccactgtggtttagctgtttctgagaagtgtgtgtgctgaagcttgtggttaatatcacttcacagttatcaagtagaggaacttttcctattcaggttccatcctta

SEQ ID NO: 85892 - DNA, 1134 bp, Homo sapiens
cattaaagcactactgcttcatttcctttcccatttgtggtttccactagtctggttctacatctctatcttgaactaattaaactggctcagactggagcagctataccaggcataataccaagaggagagcagaactggcctgggtactccttcactgactgtatttactctttcttgcctgacccctatgtcttaagggcatgtccttagctcccatttcttatgtatattattacctttcactcatttattcttttaaccaatatgtgctgagtacctcctatgtgctagacactgcagtggttgctgaggatatggtggtgcatgtgataaaccataaacatgattcttccctttgaaacttatactctagtggagaaaggtgggattaaacagctaattatgcagtgaaattttaaattatgatcaattctgcaaatcggaaagtatacaatactatgagaatatagcaatcagggacctaacctggcttgggggaaaaagtgatgttaaggttcatggtcaagggaaagctttcttggggaaatggtattttgagttgtactctaatgatgagttgaagtcaaccagggaaaagttaggtggggaagacacgaattaaaaacttacagatcaggaaactggcacattcaaggaactgacagaaggtcagtaaggctggaacaaagaaaataagggagaaaataactcaagctggtgctgataaagtcagcaaaaggccagatgctgcagccttataaactaagtcaaaaatcttgatcttggctaggtgcggtggctcacacctctaatcccagcactttgggaggccgaggcggaagggtcaccaggtcaggagatcaagaccatcctggctaacacagtgaaaccccatctctactaaaaatacaaaaaattagccaggtgaggtggcgggcacctgtagtcccagctactcgggaggctgaggcaggagaatggcatgaacctaggaggcggagcttgcagtgaaccgagattgcaccactgcactccagcctgggcgatagagcgagactctgtctcaaaaaaaaaaaaaaaaaaaatcttgatctttatttcttggacaacaaaaagccactgaagagtttt

SEQ ID NO: 85893 - DNA, 1026 bp, Homo sapiens
catagaggggaacacagacaccagggcctaccagagagtggagggtgcaaagaaggaggggatcaggaaaaataactaatgagtcctaggtttaatacctggatgatgaaataatctataaagcaaacccctgtgacatgagtttattcatataacaaacctgcatatatacccaggaacttaaaagttaaaaaaagagaaagaaaaaaaagtgtaagaggaacccaggaaaggaggtcagattgatgcgttaagagaactcaacccacctttaccgatattgaagatagaggaagggagccatgagccaaagaatgcagatagccactagatgctagaaaaggcaaagaaattgattctcctaaaaatagttagggctaccataacaagtataagccatttaaacagactgatcacttaaataacaaatatttattttctcatagttttggaggctgaaagtcaaagatcaatgtgttggcaatgtgttgatttcttctgaggctgaccttcttggcctgtagaaggctgtcctctccctctgttttcacatggtctttcctctgggtgtatctgtgtcctaatctcttctctttttctattttatttatttatttttttttgagacagggtcttgctctgccatctaggctaaaatgcagtggtgtgatcatagctcactgtaaacttgaactgctgggctcaagcaatccttctgcctcagcctcccgagtagttagggcgacaggcatgcccagctattttgtttttatttttttgtagagatggcatcttgctatgttgctcaggctggtctcgatctcctggcctcaagtgattctcttgccttggcctctcaaagtgctgggattataggcatgagccactacatgtggccctaatctcttttcatgagaatatgagtcatattggattagggcccacctatattggattagggcctacccatattggaaccacccctaggttactaaacctcattttaacttgattactctttaaagg

SEQ ID NO: 85894 - DNA, 1039 bp, Homo sapiens
aagagcaatcataatgtctaatagacaactgctttccaccagtgtttttccatttaacaaaatcaatcaggcttattaaaggatttggctgaaataagagttccctatgttgtattaaggacagtaactcatttcagtgttctacaatgtaattattcatctgttgttgaacatttgagctgatatatgtaatataagaaaaaatagggaatatttttgtataaatatttatacacctctctatttctttaaattctgtaatcgactaataggtcatgaacatctttaagatttttgacacaatgtcatattactttcagaaaaattttactattttacactcccagccattagtatgtgagagttcctctttcacttttcccaggtttggaaacatttataatctcttatctttgccagtctgaaagatgaaagtggagcttgttttattttgcattttttattaattaagtagggcatgtttatttttatgatttattttcttatttattttaaaaaatcaaatgaatcagaaagcactaatataaatagaacagtgtatctttattccacactgacatgaaaaagaattgcctacaaatggctgcaagagagtatattttcaaatcttgttgtcttgagagattagatgtaaacttacaattctgctatgaatatctcaagctctaaacagtattcagtaggatgttaacattctgagtccaatgttccagaacataaatttgccagttctctgaaaacactggaacagaaatggaaaattcaatagccctacttcagtgacttccttacaatccaccaatgggcaaaatgcaggcaagactgccagctgctctgtatctgcaaacatttgtgcagaactaattttaagagcagatgttggaaataaagagaaaaaaaaaaacaattgcagcctcccctctgagaaagttagacctatcccgtgacttctcagatgccccataaccctgttagccagagtttcattccaaaaataccatattttgcttccttactt

SEQ ID NO: 85895 - DNA, 1101 bp, Homo sapiens
gcagattgacccaggaatatgcatctttacaagcatccacaggtaaccctgacacaaaaaatactgcttttggcagtgaggaacataaaagttttatgtagagatgtaaggtcagagttacaatttagagtggattgttgcagttgccaagtcctggaactaacatagactcaaactaaggcagttgtggttgggatagacaggatgagatagattacagaaatatataaaaagtgaagtggtagaggcctgatgatggattatgaggtgaaataaagatagaagactggttaactcttgaagactttgagcttggttgggctgagtagatggcagatgatattaacaaaagtacaagaagtaaagctttagtgggaagatgagttcagttgcggaccagctgaggtatgtaatcctgtggaatatgttagcaaacatgttccaattaggcagtaagatatccaagaagaccagtgatgaaaatatcctaaagtaatgtttgtagtctcttgaagctgtgagagagatgacatcactcaaggaatgcccatggagatagatgccaaggacagaaccctgaaagcccccatatgtaaggggtaaaagtagaaaaggagaatttgacagactgaaaggagcaatcagaaagcaatttgtggaagaccagtagaaaatagtgtgccaaaagttttaggaagaaatcaatggtccaattctgtcaaatgcaactgagaaattcgataatacaaagaaaagtgttatgagttggtagtgtggaagccacctgtgactttggctacagtagtttcagtggagaggtgggacagagaagcctgattgaggtaagttgaagagaaaattgatcaaacaaattgtgaatataggccaggtgtagtggctcacacctgtaatcccagcacttgtggaagccaaggtgggaggattgcttgagcccaggagttcgagaccagcctgggcaacatagtaacctctctcactcatcatatatatatgtatgtaaagaaacagtaaaaatagagtattcattttcacaagagttctcatgaatagaaggagaaaaaggattatatctagatggag

SEQ ID NO: 85896 - DNA, 1044 bp, Homo sapiens
ctggtctcaaactcctgggcttaagtgatcctccagtattggcctcccaaagtgctgggattgcagtcatgagttaccacgcctggcctcagcatagtttctttcataatcttcacatatactaatctgcaaaaactatattgtgttctgtaaggtcatcttagtttttataaaagataaggaaatgttttcttcacattaaattacattaaaataagctgaaagcacttatttattttctaaaattagtatttagtaatagcattccctaacctgaactgcagaagaccatttaaaagtagctctgttccctctactatgatgaccaggtttctgctcttcaaagagaaagaaataagaacaaccaacattggcttactctgtgctaggcactattctgaactctttatcaatatgatctgattcagtcctgacaaccaccctctgaagatgtgtactattaccatcctcattttacagatgaggaaatagaggcacagataaggggtaggacaggattagaatccaggcaatccgacttcagagacccttgtcttgaaagcacgtaccaaagattggcctgccttacccttcttgtcttaaactccagtcttgaattccatgtcatttttgatgggtctaggaaataggacctaggaaatacacctaaagtactctgttttgtttttgtttattcttactaaagctcaagtttatcctctattgatcctcactaaataatttcgtagttataatatctaagatgtacaaaaatttctatgcctgctccaagatttttttttattgtgttctatgctaatagcttgcttttataacactactactgatctcaagtattaagttgttaacaaaatatcctctataggcatataattaaataagataggtggccccaaagtagtataagctgcatgatgttgaagaaattacattggctcgataggagagccattcatctggctttgctaccacttaactctggctctggtcaatcttttcatctttctagtcctggttttctta

SEQ ID NO: 85897 - DNA, 1131 bp, Homo sapiens
agtactttatgctagtttttggaaagtcattaacataccatcaaaccttcttaattcactccactagtaaactctttggtttgtggttactaggcctgattttgaagaaatcgattgaaagttagtagagtcatgcaaataaactagaaatcagtactatagtaacatttattttccttgggcactgttgaaaatagcttatgctatgataatatatgtatatcaagttgtcatcatactaatttacttgaagtgaatgattagtatacagtaagaccgtgtacacttgatatgacttcattagccaaaacttgagttactttagaatcttgaggtatgttaatagtcacttttgacataggtaattaaattgatcatgtaataagctcagttgttgagcaaaatcactaatatttctatatctactagcctggttatttcagttgtttatacttggccctgaatgcaaaggaatcctaaggctggtgtaacaatcagcatcattagtataactgataagccagcttcctttctctttaaattgtcttcctattggacttcatccagaattgtgttcagctgagttgtttcgaggtccttgtactctagcatttggctgctgtctgacctccatatattttgctgttctatctcttgctgtatgaataggttgggttgtttgttttaaaatagagagcaaaaagaacctagaggaccatgaaagaagagatttaattttgtgagactggaaatttacatttttttattaatcactttaagtacgctgttaatacttttacactataggatgcagggcattttaatactgccagctctttagtgttgtttcattaggcattaaacaatatgctaggtgtgagtgaccattgtagatactaagatgtataggaaattgacctgttcatcaggatcttgcaatctggggggctggggcattggaggaagaacaaacataaggtaagagggaaaagaagaagaaggggaatgatactgtaggtacctgaagagtttgtgatggtcataagtattgtctgaattcagattaagataagttcactaatggcaatgttaataataagagtataacaatatctaacatttcttgggtcc

SEQ ID NO: 85898 - DNA, 1020 bp, Homo sapiens
tcctttctcctacagattttgaggcagccggtgggctccgaaacaaaacagaggtcactggatccgattcccagtaccatagaagtgactcaaaccagcgattcaaccgacaagcaggatccgggccacccaaagccgcgcgagagtttacgtgacgacatcggcgtcagcgtcacggaggcgtcggccacgttcagcggacacgggagcaagatggcgattccgggcaggcagtgagtgatccgggagttagggtcaggctgggggatgagaaactacggcgactgtatctttggccgaggagttttaaatgcgctggaagtgaagggactgtgtcgtcaagggtagagacgggaaaaaacgagaagtcctgaggaacatagattcccctcccccgtacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtgaagagagacagttcctggcttccttagagggccttgttctccttggcagaagctcaagtcctgattcccgcccttccttctcgttttaggaatattgttctgagaagccacagaaaaagggtaggcatataggaaattggggtatacgttgccgcaaaagagacaaatactgtacgtacttgaaagttttacctttgatgtgtaatccttacttttgatgcggcctcccgtgatctccgcatcttaaaggccaaaacgtgagaaactaaaggagttggatctgatgggatggttctctcagatgctccgaggcaaagcacatgatcttaataaagtgtaatgcgaacttgccccatggctacttgggtttctcagttatcttttaaaaattttcgtgagttacactatccagtcagttcttagaaactgtgtaagtac

SEQ ID NO: 85899 - DNA, 1063 bp, Homo sapiens
catgtgaacatgaatataaagcaaactgaaatatgaaaaggaaactaatatactgaggattcctgtgtgctcattatactttatttgatcttcaggatcactctgatgtattattattcccattttacaggtcagaaaattgaagctcaggttaagtaatttgttcaaggccatgtggctgataaataagtgtcaagattgggatttgaacacaggcctatctgaccttcaaacctatactattcttctgtcttgccttgttttaacagtagcgttacagaatgtgaatgaaatgtagagaatgaaatgattcactttgttgcaggaaaatcaaggcaggaataagcatttaaataacattcaaggctggtttagatttaaataggcaaaaatagaggtgaaataatttcatttgggagagaacagcaagaaatacagaatggcatacaagtacaaggcatttttgtggaataatgtggctggagaagagggtatataggaaaaaatgttgcagatacggttgtaacaggattgggccagattgtggagtaccttaaatttttcgtataaaatttcaactttatattttcaagtagtttttgagtaattcggtgatatcatcacacttttgggaagataactcttgaattgtaaaacaaagaaagggagaaatgagagatgagtttaaaaatgcttgttagaaggcttttttagtagttcaggtgagagatctcaacctaggttgaggtcattgggaattaatggggaaaaatgtgagcgataccacagaaataagtaggacctggcagccacattgaatatatgggaaagagatggagtcctgatgcaagatcttttttttttttttttggtcatcattttccctcattaaaaaaatatataattcacacactgtatactttacccttttaaagtgtacaattcactgtgtgtgtgcgtgtgtgtgtgtgtttttttttttttttgagacggagtctctgtcactcaggctggagtgcggtggcgtgatctcggctcactgcaactgcaacctccacctccc

SEQ ID NO: 85900 - DNA, 1056 bp, Homo sapiens
acacattttatctgatagaagactaggagagaaaatattgggacattttaaaagcatgaggtagatgaaataaggatacaaaattgaatacttagggttgtacaatgctataggtgcacagataagtaaaaaataataaatgaaaatgattactttttagcatggtagtgtgagttttttttcaaaatcatattattattttgttataattttgacgaatacaaggaagtgagtgcttaaaaaaaaaaagataaccataattgtgtattcccaaagtaagaagcattagcaagttacaggattacataagtgtatacacttccattcctttcactatttcttgatatttctcctctttaatctttttaaaaattttcttgaaaaagtaagttgaaggtttggttttcctaatgaaaaattaatcttattttagctggaagcctgtttggcttactattggtaagaaaaagttaaaattttaatctgtctgaacattatagtacatccaaatcaataaaatgttttagttgtggtttttcatcagttttaatcagataatgccttacttctgtagatatagtctagtatagttcaaataaaaagacagttgtacatagataagacaaagcatattgtgaaaatgttgggaaatttaggttattttaatgatggctgagaatttgtgaacttttctcatatgctattaaactgaattactagtaaatttatggtaccgagtatatcaaacagtgagggatttaaagtaattttgcaatttgctaaaatttcatccttaacatactggctaagagtgaaaaagcaagaagagagaaaaggaaaaggatggaactaagacaattctattagaagtggggagatggcaagaaaattctgtcctccttatttttctttttcttttttaaaatatttcattttgagacagggactcactgttgtccaggctagagtgcagtggctctgtcacagctcactgtagcctcaacctcctgggctcaagcaattctcccacctcagcctcccaagtagctgagacta

SEQ ID NO: 85901 - DNA, 1307 bp, Homo sapiens
attgcttaggctggagtggagtggcacaatcttggccctctgcaacctctgcctcccaggttcaagagattctcctgcctcagcctcctgagtagctgggattacaggcatgcactatcatgcccagctaatttttgtatttttagtagagacatggtttctccatgttggtcaggctggtctcaaactcctgacctcaggtgatctgcccacctcggcctcccaaagtgctgagattacaggagtgaggccactgtgcccggcaacataagattattttcgaactgcatccttcatgacatttatatgtgtatttgcaactgtatgtgtatgtatatgtatagacacacacatccctatgtctatatagatatatctgtctttctggaagtacgacatctcttttacaaaggaaagaactgttatgcctatgcatacaatacacttcttttttgaaacatgttcggagaattgttagtcatgctcctcatttcaaggcgcacactcctatcatcagcctagcctgcacaaagctcttttcttctttattaattttcctcttctgatcccctctcattcccctttaaatatatatatgtgctgcttggatatccgtgtttgatatatgtgctgatgtgtttgacatatgtgctacctggatatctgtgtatacttttaaattatattttgttttgagtacatatgattttgtaaacataaatgttactgcattatctcatttttttagtcaacactgtgttacagtatgtatacctagttaattgtttttaactacagcatatacgtctactgtattttatctatcccattccttctgagataaacacttaagttaccttcagttccctgctaccacagtgatattattttaaaaaattctcatacatgtcccagtagaaacccttgtgaaagtttttatggggatatatattcaggggtgggatttctagatcatagggtatgtatataaattattgcactaaggccgggcgcagtggctcacacctctctaatcccagcactttgggaggccaaggtgggcggatcacgaggtcaagaggttgagaccattctggccaacatggtgaaaccccatctctactaaatatacaaaaattagctggacgtggtggcgtgctcctgtagtcccagctacttgggagactgaggcaggagaatcgcttgaatccgggaggtggaggttgcagcgagccgagatcacgccactgcactccatcctggcaacagagcgagactccatctcaaaaaaaattatttcactaagt

SEQ ID NO: 85902 - DNA, 1087 bp, Homo sapiens
aaaaactgaaataagttcagattttctttctatcaactcttgttctttcacaagcacaggctgatttttaagggcatttgcatctgacagttatctactagtagagtgatggtataaaattatattaagctactattttaaatagtcatatttctactaaatgtgaaaaactagcaggaacttttctgatttttttttaattaagataataccagaaaaaagaaaaaaattatatttagtttgatgttttattaaagttaaatcgcattataaacaatttctatctctgctacacctaaatttttatggaaaacagtttcaatattaatcttgctagtaagtttatattgaatgtagggaagacaatcttatttgggccaatcatttctatcttaatgaattcattataaaaattataatattaacaattactatttttttactcttttcctaaatcttttttatttccttagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaaggtaaaatgaaagagtgggaaaggcacaaggaaacagtagcagaatctctcccctgtggttagctgtttgctctgtcactgaactttagggttatgagtttgtgatcataatttatatataggaattcaagacacaaggaatatggtattatatagcagtataaaacagaaaggaaagtttaactaaaaacacagttgaactcttcagtaactattatttctactagacttttctcttagttctcattttgtggcttttgccttagaacatgatctgaaatgtaaaaacatttattacaaagtataacgccatggcatttgtcagaaacaatataaatataattttaaaccctagttacatttttttgggatgagaaaataatagagtaacaccactcaaggaggat

SEQ ID NO: 85903 - DNA, 1062 bp, Homo sapiens
agatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattga

SEQ ID NO: 85904 - DNA, 1049 bp, Homo sapiens
atttaacagatgcatttgtaatcccgttaactaatgtagtttaagatgtatgatgagttaataccaaagatgagtaaaatgtctaacttttttctccttcctctgtgtgtctttccaacagagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggtcagtatcacaggctgcgagtagaggctgtgacccagggtgggctgtgacccggagtgggctgtgacccggggtgggctgtgacccgggtgggctgcgacctggggtgggctgtgacctgggatgggctgtgacccgggtgggctgtgacctggggtgggctgtgacccgggtgggctgtgacctggggtgggctgtgacccgggtgggctgtgacctgggatgggctgtaggtcctcttgagaggccagaagacagattatgtcttttcagtcttcactggcgtaagactaggaacatgatgacttagactttcgagctggtagaaaagtcaaatctcgccaggcgtggtggctcacacctgtaatcccagcactttgggaggctgaggcaggtggatcacctgaggtcaggagttcaagaccagcctgaccaacatggcaaaaccccgtctccactaaa

SEQ ID NO: 85905 - DNA, 2404 bp, Homo sapiens
ccatttatttatgtttttgttgcatttgcttttggggtcttagtcatgaattctttgcctaagccaatgtctggaagagtttttccgatgttatcttctagaacttgtattggtttcaggttttagctttcagcctttgaccatcttgagttgatttttgtgtaaggtgagagatgaggatctggtttctgaaggggaatttgtgttggcctagtggagcctgagatgcaggttaatcctccttatggaaggcaactattactaggatgggtacccgatgacaccacactttttctctcagctgagctttcaaccttaaatggggcattagtgccggggcacctctgtatagtcctaacccactggagaggccttcctaaggagagcaggttaagcagatgtctgagtcttctagttccgcctgatcgtcatcgtagatttcctcctaggaaaacaaggactgttttatcatttgactcccacactatcatctgcaaataagtgcatacctaggaatgatgacttggccccatcagaatgctcacagcagcccgcctggttgttgtaggagtgtgtgatagaaaggaatgggggagaacagccattgacactggtagggtaagaaaggaactgggatgcttgcccttctgaccctagagatttatgccctaggtgtggctgtatgaatgagaagtttttctgcctccctactagtatacaggtcatcactcaccatcaccaaggcagcggaggaagagagcatcagtacaggatctggtgttagccttaggtccaaggcccagctctgaacctcaccatgtgacctgggcacatcacctagttactcaagacccggttttctaatttttctaaaaatagagccatgcctgtcctatctgcttcacagaattgctaataagatttagattaaatgaaattacagatgggaaagctgaaaaatatgtatgaatattagttttgtaaaaggtttatcctacaaaaagggtttctgctctttgtcccttgccctctggactcataagtcttctgttcttttctccaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaataagctgatttatgtgatctgtctgagaagtgtttgtttatctacaaaagaaagcagccaggtggctcatgttcttgaaagtgaaaaaacaggaaaagggcttccctcttcagcttctctgcaagatgtgtactctttcccagaccgccgattctcaccggcatctgcaaagggcttccaagcgcctgtttaagaaggactgttcccctaccgcataaatgttctacccagatccagggtccctacaagggtggggagtgaggctctgttgggcccagccttagaataggtcagtaagttatcttactgagattgggccaccctttcaagaacaagggtaaaatagaaaacattttcacaaaaaaaactgaattt

SEQ ID NO: 85906 - DNA, 1057 bp, Homo sapiens
ttggagagagcgcctaggaagcccaggactagagggcgtcaggaagaacatggtggtaaatagtggaacagcagagcagacagaaaatgggtcaaggagaaaggctgttgggttggacttaaggtagtttttggaaacttcaggaggggtcagggtgcaagcccagctgtcctattatgctccatcagcagcatgtcagtacttcgttctttcaaaggctatgtatagtggggttgcaaggaattgaagctgggacaattaaggctgtaaatcttggccccatatggtgtttgtaacctattgtaagaataaatatgtaaaacataaacacaagaataagcgcagagtcacacacgggataaactgcaagggagatggtcagtgactggaactgtgaggcctccttagggattcttcaagggtgaccctctttagggaggatgttagggctgtggctttttttctgaaaagggagagggaggccagccagagaaatggtggctgagaagtgcagctcttggcatttggagcatgcgttgaacaggtcagaggagtgaagccaagaaataatgtggcttgccattcacagagcttttgaggagtgaccgacaagcagactttgtctgaaacaaataggagtagcgatagtttggggtgagagaaaagtcattgagtttcagtgggaaaacaagacccttggatggcatctaaatttgtgctttcctctccgggttcaccctcagagatcctggagagctgtgtgtgccctcagggctgcctagctcatgctcattggtctagagaaagaagtcagccgggaggtgaacaggcttcttctgggctccttagtagaggggcacttctcaggctgtggacacttctgctgactgaactttgtggtggtttaatggtttaaaaaatacaaaccacaagccaaaacaaccccttttctctaccacattttccaccctgcatttttcctagtatatttactagggaaacggtaccttctaacctttgtttctgaaagaggccgcaagtaatatccggctataag

SEQ ID NO: 85907 - DNA, 1107 bp, Homo sapiens
taagtgaagatatggaggatattttctaattctgcaatgttcactgaaggaaaatacttaccttttaaaaattttgtctctcctggttttcattttgaaccaagatgagttttccatttttcacattgcttttgttcctttcagatacatgaacatttgaaattgtttttaacccacatttttaatcttttcttacaagtgagcctctctgttcctgatttctttcattttagtaaaattttcagacttccttctagaaaggagcctctaaatggtttcagttaaagatactttggcatgttagagattagaaagaaacatgttatcaattcagactatatgtagatttctgctgcttcctaaaaaccaacattatgacctttaattgtctcaccagcccaactgccacaagtgattttggagatggtatattcaaagctaggcacaaaaatcaacatattcttcataaaatgctatgttgtagaaccaggtgagttgtggagagacagttactaataattaattcttgattttagatgctgggcagtaatttaactcattgtagtgtcacatttctatgtcaataacatggacaatttgtttctttatgagctcctacagtttgtatgtagccatcaaatgaaataatgtatgcaggcatttttcaaactgtatattgttatataaatctaaggagttatgaacagcccatatttctgttggaggtactcaggacataaagctacagggcatcttgcttcgtgagaattcaaagttcactaatgtatttgtatttatttctcctcatgacatcagagtagagtaactcaggatgtgaacatgggtgattatacccaggttttatgtgaagaaactaaaacttactgacagttgtgtcttgtttgggttgcacagaatcagagatagaattggaattcaaatctcttaatttgacacagacagcttccctaaaattccctatgtattacttacaaaagacaatcagttatttgcaggtctgtttgaggttcagttctggatctctagtacaataatggaaactaggcaatgttgggccagacttgctgaaacaagagtgaattgtag

SEQ ID NO: 85908 - DNA, 1377 bp, Homo sapiens
aacagtagaagtgcctggcttttgtttatgaaaatggtctttttacttttgctttgccattcagtctcttctttgaaattcaatatttgtgtaactggatcagtaaaagaatgcatttgggagagtatcattatttggtttccccaagtagaaaatcaggcagtatgatgagtttgttttgttttgtttaaaaaagactctgaccaggttttagaattattcctaaaataaagtaggatgcatttgctttaatcaatattgattgattaaaagcaagaatccccagcttcaaatgtttactgcttttagtaggttaatatagtttttcttagtcaagtagcatttttacatgcctattttatgtatacaatagaatagaaaggatgaaatagtatttattgctttgttagtttattatgtttttaccccaagagattcaaattccatttctactggagtatccctttagtgatcgtaggaaatatatagccctgaccaagtactgtttagagcaggctgcctgtatagagcaggctgcctgtatagagcaggctgtttctttcaagtggctacagaagagctaaaattatatgacacctcagcagggagaatctggcttcagactactcaccatcatccacttttttgcaggatgatcaggatggtgctttcacaaaatggagagtggagaattcatggggtgaagaccatggccacaaaggtgagctcagtttggtaatactaactccaggtgactgggcctgctctactctgcctgtctgggtgtcaagctgctctagtgtggaggatttctcagtaattggctccactgactagattattctacagaaaaatctgaggatctgatttgcccccaggattctcctgaccattatggcatgcctgaactcccaggttggctctgagactgctatgtgctgcatttgttgcaaactgtgttgaccctcccctctttgtagaccgcttggctagtgaggaggttgagtgcccttgccaggacacttgctatatggcatttgatgcattttctttttcttttttttttctttttttttttttttggacagagtcttgctctgtcgcccaggctggagtgcagtgacgtaatcttggctcactgcaagctccacctcccgggttcacgccattctcctgcctcagcctctggagtagctggggctgcaggcacccgccaccactcccagctgattttgtatttttagtagagacggggtttcaccgtgttagccaggatggtctcgatttcctgacctcgtgatccgcccgcctcggcctcccaaagtgctaggattacaggtgtgagccactgcgcccagccttgatgtattttcatct

SEQ ID NO: 85909 - DNA, 1037 bp, Homo sapiens
tcgagaccagcctggccaacatggtgaaactccgtctctactaaaaatacaaaaattagccaggcatggtggcgcacatctgtaatcccagctacttgggaggctgaagcaggagaatcacttgaacctgggaggcggaggttgcagtgagccgagatggcgccattgcactccagcctgggcgacagagtgagattctgtctcaaaaaaaaaaaaaaaaaaattgcttttggagcagttcttgctagtaggaaaaacaggtagatgcacctcctaattgtgtctcttacgcgaattagaataagcaaggacctctctcacatgtattttgccaccttgtgtttctttgttacttaacaatgtggctgtagtacttagcttgtaggcagagatgatgagcttgatggaaacatgaacctagaggagagctgtgtgttgcttgacattcctggttttgtgccctaattaatgtgttcttgatcttgatagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggttggtattgtttctgtattttgcacattggggttaaaacatcttttacttctttggtataataggaagatggggtttatgttgactttcttcctctttcttctgtttctaggctgtgtggtttggctgtgatgttggaaaacacttcaatagcaagctgggcctcagtgacatgaatctgtgagtgcaggaaatttaaaatggaaagtcatttgtgggttgttgctgttggagtgtgctgttggtacaaaatgactctgccgaggttcatccaaagatgaaggttgacctaagggcgcgtctctttctttgcatcctttagagtttgaggactcatagcagaaactccacatacttaaacactctaacccaggacatcaaaatcccac

SEQ ID NO: 85910 - DNA, 2147 bp, Homo sapiens
ccactgcactccagcttgagtgacagagcgagaccccatctcagaaacaaaaaatttttcagggtatattttggaagtgaagctgtcaggacttgctgatgaattggatgtggaggacgaggaaaagtattgggataatgtcctgggatcttgaagggtgaacttacagataggaaagaaggctttttggcaattagggcagtgtgagggaaccaatgtgtagaaaagggtagcaggtgtgaatgagagaagtaataattgaagaagcaaggttttggaagagggaaagaatagatgtggtctaaagtagtgccatcagactttaatgtgcacatgaatcaccttgggatcttgttaaaatgcagattgatctagtaggtgtgggggtggggccagatagtccgcatttctgtttctttctttgatataaacacctctagaagtaatctcaagatcattatttaactattagttatcatctatatgagttcattccctttaacatcacagaagtgcacatacttttagagtgtacctttttatgtctttctgtgcccgaaaacatttaatgcctccagaaggcatctgcttttctgcctgcttaggtgttttactttaaaaaaaaaaaaaaaaacaacaaagaaacaacaaaaaaaaaaacacagatctttgcccttctttcattccctaccagaaagtagtagacagctgtcttcccttctcttcttcctctgtgaataaacagtgaataaacagtcactaaggtaggttccttactccttctctcctataactagctcatttacccacagcactgaacttttttcaaagttgagctgttttctgtgactgctttagtgttcttatgaccattctattctttgatcaataggtcgttttacctttgagactactttctccatcagtaaaactaaaaaaagttggggtaggctgtgcatggtggctaatgtctataatcccagtgccttgggaggccaaggcaggaggatcacttgagcacaggaacttgagaccagcctggccaacacagagagaccccatctctacaagaaaatgaaaaaattagctggatatggtgatgcgtgcctgtaattctagctacatggtaggctgaggcaagaagatcacttgagcccaggagttcaaggctgcagtgagctgtgattacacccctgcactccagcctgggtgacagagggacaccctgtctcttaaaaaaataaaaagaagttggggtaaatgattgtagggttttgcatttttatacagtagaagtaactaatatttttacagtgctttagactttactgtactactttctcaaaaacccagtattgcaaatacaaatgaagactaagattctgtctcttctgcagtggtttcaagcactgaaatcttctagccttaacagtggaaaggtaaaattagacacagataataagaacttagaatactagcatgagagtttgccccaattcaataggcaatgagaagtcaggaagatttttaagcagaagaattatatgaagttttgctctctttcaagcagtttggttgttatcttcgaactaccttactgttctaacctctccttcattctgtgtctgcctgtagctgccttaaaaactgttgaaggttctcacgcttctaagatttataactgactctcaactgctgcatctttccttcttcctctcacttgatgtctgtcatgggcgtgggaattaactaaggcccatatcatttgtctttaaattgggatctacacattctttccccttatttcatatctcattcttttacctttctctcctgattctgtttcttttaccatgctacacttcagcaagtcatttaaaataaacagatctctccactagggagatttgtttttttatttttttgagatagtatcttgctttgttgcccaggctggagtgcagtgttacgatcacagctcactgcagcctcaacctcccaggctcaagttatcctcccacctcagcctcccaacatgctgggattacaggcatgagccactgcatctggcctgaaaatatttttagagatcagttacaatggagctcctttataaaatgagacttgagaggtaggacccttcttta

SEQ ID NO: 85911 - DNA, 1014 bp, Homo sapiens
gctacataatttgcctttatttagggttagattaagatggtgggggccaggcacggtggctcatgcctgcagtctcagcactttgggaggccaaggtgggcggatcataaggtcaggagatcaagaccatcctgaccaacatggtgaaaccccgtctctactaaaatacaaataattagctgggcgtggtggtatgcgcctgtagtcccagctactcgggaggctgaggcaggggaatcacttgaacccaggaggcagagcttgcagtgagccgagattgtgccactgtactccagcctggtgacagagtgagactccgtctccaaaaaaaaaaaaaaaaaaaaagatggaggtatagtaggaatgaaggttctgcaaacagttgtggaaaagggcccagataatacttgctgtagataataagcatccttttggcttttgatgtttgctttaatgatctttgaactaatgatgtgtctaagattgatgtcctcatcattggtagagcgtggtaattggctggtaagaattagggcagatatgtttcacatatttttttcctcccctactcctgcctcagagaaatagtagatccaactttaccaaatcctgagtatgaatgttttataggattatttacttaatgattctacctaaactatttactacagaattctgtgtgtaagggttttttcccccttagagacagagtcttgctttgttgcccaagctggagtgcagaggcgcagtcatagcttactgtaactttcaactcctgggctcaaatgctgcttcagccacccaagtagctgggactacaggtgcatgccaccatgcccagctcatttattaaaaaaattgtgtagagattcagtctcactatatttcccaggccgatctccaccacctgggctcaagcagtcctcccaccttagcctcccaaagattgtgcatattataaagtgtgagccgccatacctggccctgtgtataaggttttaaaatttttacaat

SEQ ID NO: 85912 - DNA, 1136 bp, Homo sapiens
aatttggatttttttgtgacccctctaaggaactctcagaatattcccatctgttaaagtaatgattaggaagctttagtcatggcaacgaatgtttaattgaattgaaaattacttattttacactgaaaaaactgagcttaaaacttactttgccttttagtgtaggacttggacttggattttctaattcgtagtttagtggtctgtataatcattcttttatcatttcataaatattaaataccttctatgagtttggcactgaggaaacagatgagaaagacatagtcactgctcttaaagagctcagtctcttgggaaaaagaaaacacatctataatgatgataaatcctatgctagatgtgtaaaaactgatttggtggtcatagaggagggagtgactagctcagtgagctgaagctttcatagggaagatagctcttgaaagagtagtcagaatttaccaggtagataacaagaccattctaggcaaaaggaattgtatgaacagtgccataaacaaagatagaaccttcagggaatcatgtggctgaaacataacttttttcagtatgatgggtagcaaattaagctagaaaggcagagatgtaagggatgttggatcgatgccagaacatttggcttctttctgtagaaataaagacggagctattgatggttatatttgttaatgtatgtaaaaacattttagaaaatgtaaaaagcactaaaatatgaggtggtaatattatttatgatcaagacagttaagaaactttattattaatactatccatgtccagaatgaatatgcataaaactgcaattggtttgaggaaagaataaatgtttccgtttgtcagccagtaggccctttattaggcttcctttcaagactgtatggagttaaaatggcctactttttttcactgcgatggaaaacactaatgcttcacttgtgttttcctttaaatcttagagatgcagcatagtggagcagtggagtgtgtaatctctgaagtcaggctatctgagctctagtcttctcattactttatatcctgggacaagttccttaagctctaaaggctcagttcatatttaacatgtctagcctagtgcttggcacaat

SEQ ID NO: 85913 - DNA, 1053 bp, Homo sapiens
actgcactccagcctaggcaacagagcatgaccctgtctaaaaataaataagtaaataaaatatatattacataggtgttcattaaatgttttgttttagcattggaatgtaaacactgtacacatatacacaatatattgggatacatacacaggtaaaagaagaaacttcagatattctgatgaagtcagatactgatgtttatttaccaattttagtttaaaaatacttattatggtgcttgtttcagcatcgtaagtccccaaactggggtgatacagaaaagattagcatggcctctgtacaaggatgacatgcaaattcatgaaggtttcatgtttttaaaaagaaaaaaaactattatgttgattccatggtaattccaagactcccattctgttgataatgccaataaaattattgacacttttttcttttaatgttatttaactttctttactctttaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttggtaaaagttctttctttaatggaactgaaactcagcatgattaagtaagcctgtagttaggcatgggccaattctttggtggttgtgtacagagtagaattggtctccaagaaggatatatagttatttctaaggacctttagttcacattctcacctataaagtgccttcttaaatgaggattaaggagagagctactgtgaaggatgggttggagaagaaaaggtagtattaaggagaactaattttccatgaaaaaattgttttcttctccattgatgtaatcaggaaacacattaaaactgtagctgtgttaaaatgtcttcaaaacatcttttggggaaatctcatcatgctgagcactttacaaaagtatgatagatacacttgagcttgaccaaaaggctgagaagtgacaaagtatagtagataaaaaggataac

SEQ ID NO: 85914 - DNA, 1099 bp, Homo sapiens
tatttgtaaataccaagtaaatatttttcttgtatatttgtcaagttttgtgtgtgtgtgtgtgtttaatagtgtttaatatgcattgataccttatacattgttatgtaagctacctatctttttcacttaccaatatattataaacatattttcatattagtaaaaaggttatacccaatacaagtcaaagtttttccctcagaattttccctcagaaaagagataatttccctgtatttaagaccttaaaagacttttctaatggcgctctcagttaatttattttgaagtagagtacaatttggagaaggcattactctgaaaaatggattctttatttgatacgtaaagagtgtttttgtgttaaagatattaaacctttgcatatatattgctaataataattaccacctttcttgttttgtttttaatctttctgctctttctgatttactctttctgaattgtccagatcgtgtcatgagttcattggtgggaaatacagttggagcagtgcagtctatgtgaaccctcataatttcttgatgtgctttcttgtttcagggcgatgctggatcttttcttgtctgaatgttatgaggcttccattcatgaaaaagttaaatattgaagaatttgagtttagccaatcttacctgtttttttgggacaaggtatgggacagatctggcaagattctttttgtattgatatcagccttggtagggactgcctcttcttttgtagcttttccagttatagcctgccctttcataataggtgagacaccttttattctgacttccagagtatcaaaagttgactctttcaaaggcagaactgtttttggttggtaggtggccatttttttgcaatgaaataagtttactgactcatcttactgcttgcttgtctatttaaaattttaaattttatattcaatattcaattcaatatatctccctttttaacatctttttaggttatttgttcttttctaggacctaatttccctctcaagaacttgtctgaaaaacagtaaataattttatttgattgtttatttgtttatttatttttttgagacagtctcacc

SEQ ID NO: 85915 - DNA, 2124 bp, Homo sapiens
gctcccttttggcttctcacaaggcttcctggggacgattccccgatgctagagtactgggggtctgggcccacagggaacccgtcagcctccctccttggagcgggcctgatcccgggagggcgcccgcgcggcccggaggcgggaacctagggggagaaggcgccggcgccgccctggcgcgcagaccatctgtgcggtcctgcgcgggggcaggcgcggcctcagcccccgggcgctggcggacccagcgcgtcagctaggccgcccccgtcggccctcccccgggcggggccagccccgacggcgctgactcagcaacgcgaggggggagttttgtccctccgcggaccccgtttctcccagcctcagcctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggtgaggtgccgccgtcccccgccgcggtcctctggaggagctccgcggtccccgtgaggcccggcggcggggaaggccgggggctgggacccttggcgatggcggggagggagctttcggggcaggctggatcggcctggagggagacagctccttggaggaggatgccgcttatgggtttccccgctgcagcgggcaccccaggatgcgcttacgaagttagattcgggacgcgggagccccagatcagccctttccccctctttttgcgttaaaatcctgtttggtctcccaacaggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcaggtgtgggcttccacttctcccatacgttccttgaccttcctgacagcgtcccattttggtgtcttatttaagagtggtcttaaattcgtactgaaagaactggtcgtaaattcgtaaagaatgaggcacaggtacaggcaggtctaagaacattacccatgtggtttgttttgctgttctgtggcttgttagtacatgcggttagagtacaaaagtgacatgtccatgagtatacgtttgagtgtaattgactatattatgttccaatgctgtgtggtttgtagcccgtgtcttggagatgtatggtcttggtcacaaaacagaacatgtgaaaatgttcatatctttggaggactccccagaaatgccctgaaggccctatactatgaaatagaaaagatacaatgtaattacattaaaatgtcatcagatgttacttttaaatatgcttcttggttacaactgaagctaatgtgctgatgggctcagttcccaccagtagatcagtttgtaatacagaaaaaagttctgttctcatgccttgctggtcaagaagtctcgttttgctatctgctttctagcaccactctcagaaaaaacaggtatagtgaaagattggatatccagcaatctaaataaggagcacattctcacaacaaaattgtactaaacggattttttaaagtctttctatacttaaaaacgaccccccagtctatctatacggacaggaagcacatcagtgcttgtttagagtcggttagaactcacaaagcacacatttaacgtgagtacattttattgtatgtacattatacctgaataaagttgattttttaaatgttaaggaaaaagtcaagaccttacaataattaatgttttgctttagaagaaagtgcttggagtggtgtgggctctcaggctacagatgatccagttagtaatgtcacagtggtcctacatagtttagattgcagtgacccgttagggaacaggtcaggtcttacacattttgcagtgtcacttttacatacaaaagatccaaatagcatgtgagttgtgtagtttattttcat

SEQ ID NO: 85916 - DNA, 1023 bp, Homo sapiens
gattcccgatagtcctcttagccacggagggacactggagcccaaaaatggcagatgatattcccaggatcttccccttgcctatttgacagaagctgatttttctccaatttttacctctgactcagcttaagaagatatggacttagctggagaacttgcacagatctgtgagccgcttcattttagactctgaagggtttgtgatgtcatttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtatgttggtgtacccagttaaactttacaggaattgttcccactggcaagatgtgtgtgggctgcaataacacggaccatctctgtggaagaggtagagcttgagctatctccagagatgggcaggattttcagcaaaaaggagaggaataaaataagagggaactcactccagatggcatagtgtctgaagtgagcaggcatctcttccccttttctagcatcagcttttccccatttttgtatcttcataaggcttttgaagcaataactgatcattccatctggattaaaagaagatttctgagggactgctaagataaagaagtttccctgcgggacttggaatcatttcttctacaagatttcagtcatatatagaagatctagaaaattcttgagtgttaggacagttcctgagtcttttcgtcttctatcttttactttactcctcttgataagctctcttgtagatatataatttcacatagactttctgggaggatttttttttcttttaaatacgatcgtgtcatcacctctgaacatctgcgtaagaaatatgactttgacatacacttattgacagagctgtgatggccagggctttttggagatgatacaacaaatgcaccgtttgcattgct

SEQ ID NO: 85917 - DNA, 1011 bp, Homo sapiens
aatgtcaaagagaggatgtcaaagatatgactttgaggattttgagcttggattagaaagaatgggagtgggaaaaactaattggatggtggggattgggagacagcaagcgagtgagcatgtgtgtatgtgtgtgtgtgtgtgtgtgtgtgttcgttcaggtgaaagaggagtgaaaactggaaatattaatagtacttgatgtactagtcacaagtacccaatgggcagttagggaataggttctagagcttgggagagaggtcaagatgagaaagagatttagaagttttgagacatttggaaagcatatggcagtgtagatgattttgaaaattgaattaatagtgttttctggcataatttaattgcgtggagctagaagttcaaccagaacatatatataaatgaacagatgggtgctttttttttttttttttttttacctctaaagtgaatgcatttcgtactgggatgttttccttaaggaatgccaacaattcagatattaattctcagcctgatcatattttaaaggtacagttgataatcaaatgtgcattagtaaagtgcttttggtcttacctgatcttgcacattaaagacctggttgaggctttttcttccctttattttctcttttaaaatctgagtgctgcctaatttaaaaggaaagcaaaaaggtaaaacaatactccaaaacagaatatttgcttggagtcacgagttggctttagtaaattgaagcataacctagtataaagactgacctttaggagcagtgcagttgtgtactttgtaacgtgataataggcctaaatgaagagaacctaacactcctttaggatttggcccccagtctttagatctaatgtgtataaattggatgtacttttttcttttccttttttcctgtttaactcaggtggtagagaatgggagagtacatttaaaaaaaaaaaaaaggaaaatacagttcaaagagctatgtgggagacagtgttaaccaag

SEQ ID NO: 85918 - DNA, 1030 bp, Homo sapiens
gtcacatagtctaatagtacaatgggatgtgaagcatagttgtagcattagaggaaggacaatttttaaaacttgaaaagatattcagctgtgtaaagcattgccttaaagctaaccgaataccagagtagaagaaacccattgctctgtaaatgacattttgaagaactgtcttatcagctttctaatatattaaatgaatggtttcccacctcccctggaaagctttctggaagctcactttgataaggatttaattgataacctttaatcttgagctttcctacttgaaaaagaagttggaatgtcagtttgataagacactgcaaagaattgtgtaatttatcccttctttgagtactgtagcagtggttacaatggagtaacaaccacatctttcaacatgttctttcctttgagtgtaatttttttggtatacattctagtgtgtggtacttgagaagatttggtgagagaaatagttgttcaatctggggttctttgtgagataatgtcctaaaactcttaaatttacacatctctctttatttagtttgagttttgatagatcgctaagtgtaagaggatgaaaaggctactgtgcttttataatattaaagcattgtatgtcttaactataaaccatttactttttcaaatttttttttcaggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtaattggt

SEQ ID NO: 85919 - DNA, 1010 bp, Homo sapiens
aaatgagttagggaggattccctctttttctattgattggaatagtttcagaaggaatggtaccagttcctccttgtacctctggtagaattcggctgtaaatccatctggtcctggactctttttggttggtaagctattgattattgccacaatttcagctcctgttattggtctattaagagattcaacttcttccacatgaaggtataggtgttttgcttgtatcgcaagcatcaaagtgccctcacatgaacacgttagcttatcaatgctgataagagataaatttggctttttactaggaatgttgcttaccttttgggatctgagctgtttagaacttcttcagagtgactaattttaatttttatcttttaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggtgactattcaggagtgaagtatgaaatttctcccgagggtgaaaagatttttgtgcgtacacgtggtttttgtgcagtgattttggaatacactctttaaaatttcaattcattttagtatatttaaccagtttgtatattccaaggtgtttaatatatttatctagaaaattcgtgaatggaaatgagtttatttgtatatgtgaggaaaagttgaagaaaatgattgaacaaggtagtgatattttgctcttaagggttagtggtcactttttacccgtgtttaaaaaagaccagcataaattggatacacacctaatcattggccaagtgatagaaagatgggctgtggagtgaatgtttttattctttttcttgttgccagtgatttactgtgaaatgattaatttccttttgtttggatatgtgtggtggccagtaggtaaagattataagaaatatactaatgttaattaggataatca

SEQ ID NO: 85920 - DNA, 1007 bp, Homo sapiens
aaaattagccttcagaaatattttaatgaacatttacattgaactttactctgaactcctaaattcctgtttgttccatttatttgtgttgacaatctgttattttgaatatgacctcccaagataattagatgatgatgtttattattgaaatctggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatggattgctgcgaagtttagggctggttatacctttgactctcctttagtggcagatagagtacacgaaaaaaaaaaaaaggaaagattcctggggtaaatattctagttattgcttagttgactcattgtgacatgcttccaacctggacattaaacaagacattttagaatacacatcaaatcctgatcctcatggccttaggttttttatttaaaaggagagttaggctgaagtaattctacagtcagttccaattcatagtagaatttattggaaatgtgttcaagatagtttttcctttaaaggagtaacagaagtgttagttgatgaagcacaaagaacatagaaaatgcatagaaagaacatttctcgttcttttaatttgctaaatacaggtaagcccaaagcaatgcagtctatttaacatgctagtaacttttttttttttttttttttttttttgagacagagcttctctctatcgcccaggctggagtgcatggcactatctcagctgcctgcaacttctgcctcctgggttcaagggatg

SEQ ID NO: 85921 - DNA, 1987 bp, Homo sapiens
atatcacccacatgatggtttttgtttgtcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagct

SEQ ID NO: 85922 - DNA, 1906 bp, Homo sapiens
ttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaa

SEQ ID NO: 85923 - DNA, 1087 bp, Homo sapiens
ggaaagcagccagtggagaagagcgcatacgccaaagaacgtggatgatggagcacaggcggggaggtaggatgaaggaaatggctctgggaagaaagggtctctatgtctgagaaaggaagaaattggctgaagatacaaattagagacaaggtgagggaaattgagggagttgcctgaggatgattctcctcccagtcaagtaggcacctgctgagagaaaggataagccgagatgagggagatgatgatggtttggggcgcagaaagcgggaatgaaagacaggagctaaagccgaagttttttctctctcgctacttaaaagctgtaagataacgaattgatcagcaggtggcagtgtccgcggaggctcgcatcccgtcggccctggctctcaaggcggaaacacgcaccatggtgactttccggcctgcatcgcctctgctcccctatcccggctgacgttggacgacaaagatggcggcagggaccagcagttactgggaaggtgagggcgagaaggcctccgggtgcgtcctacgagggtgagaggggctgagtgaggacagatcttgggagaagcagcacaggaaagaaccagactcccggagcggccgagctgagcagcggggcttgcctaagtgggatccccggggccttggggataccgaacggtctggggtaggggtctggcctggccggggcgtgtgagcgggacgtggggcaggggttgggcagagtggacagagcggggatgtagaggaagagggctctcaatcgcctgggtagaattgtgttgagggagtaatggaactcggacgaaggggcttggggtacgaactctgagaggaaacgaatgttgagggagaagatccagagccccggagactggaggagtcagcgcattggagctgaggtcactattggaaaactgagtgggaaaagagaaggaggaacttgcattccggtccgtcggaggaagtatgaagagaataggagacagaatgtctcttattgggtctccatgacaactacaggttggggacttccaggactgggtgtttgaaggaggagaaaataacttac

SEQ ID NO: 85924 - DNA, 1089 bp, Homo sapiens
tcttgccccctctgaagtttataagtgactaatctgctttgctgggcaagtccttggtttccttcttttaagacttttattttcctttttttgagacatagttttgttcttgttacccaggctggagtacgatggcgcaatcttggctcaccgcaacctctgcctcctgcgttcaagcgattctcctgcctcagccttccgagtagctgggattacaggcgtgcgccaccacacctggctaattttctatttttagtagagatagggtttctccatgttgatcaggctggtctcaaactcccgacctcaggtgatccgcccaccttggcctcccaaagtggtgggattacaggcgtgcaccaccgtgcccagccaacacttttctttatgggggtaacaagatcagtatatgatcattttcatagtttgttttctttagaatggtgctgtgatttttgtgtctactttttatgtctaattatttgttgttataattttgttaaagatctcaggaaacaggctcgacagctggaaaatgaacttgacctgaaactagtttccttcagcaaactatgtacaagttacagtcatagcagtacccgagatggaagacgcgacaggtataggtactaccagattctgtctcctatgccttaactgtgtttttaaagcattaaaaaataaactaaaatatataacttctgtaagttggtctattggtgaatttttggtgttttgttttgccattcattgttttattttttagtgacttattaaaattcttctgaattctcgagactagcatttatttggaatccttaggcaaagattgttacagtgtcagaagaaacctgctagaacttcagaataagtttgtatcaaaaatataagtgtctaattcagccagtgtagggaaaaggtggctgatttgcccgtgtggcatgtatttcttgtgtttttcaattgctaaatggacctgtggatctacccaggtgccaggtatacatactgcttttctggtgtttattgtattagagggtatctaatgcactgtgtatccttgttattaattatcaaagctatctttaa

SEQ ID NO: 85925 - DNA, 1091 bp, Homo sapiens
ttaaaggactgatttgagtaatggatcctctttaactgaacttctttttagttctgatacaacaccccttttaaatggatcaagccaagacagaatgtttgagacaatggcgattgagattgaacaacttttggcaagggtaagtgctttctgttaaatggctattttgcaaataactgtatacttgttacgtaggatcctggattatattgagacagacatgtttattgaaattatccattccattcaatatgtgtacctccccacaccacttgaattttgatgacagccattctcaggtgatatgatgttattttggtctttatggattatgtgggggaatgctgaattcttacttgctctcttgtttgttttttgttttgttttgttttgttttgttttgctgtcaaccaaaagggcatataggcaaataatttgcttttagctgtttatagtgcttagtaaaatattttgattgttttttttttctttatttctagcttacaggggtaaatgataaaatggcagaatataccaacagtgcaggtgtcccctccttgaatgcagccctgatgcatacattacagcggcatagagacatattgcaggtaatatattgggctcgagatgttttcattatcacaggagtttgggtttttttttttttaatccctgcattggatatgtgcacatatatttaaaaggacaaagagaaaaatctgagaaaataaatgccatgctaaagggacttgttttacttttttttggggtcaccattataaaattctgaaaatatctaatagctcttgctatttcttggcgaagttgagtaatattcatcactgggtacatatacttccactatgggagacctagctagctagctgtaacagtgaaatagccaatggtcatgtatagacaataacgtggtgggtaagcgtgtactttcagctagctttgaagataatatggagggggaattatttactatacttagtatattgtttaagaaaacagtaaatgtgtatgcaccaataaaactaaataaacttttaaagatttaaatggaggatatgttaaaaatatggtag

SEQ ID NO: 85926 - DNA, 1778 bp, Homo sapiens
atctcttcataaattaagggctggttgtgtattcacattttatgatattttatatttcttttctatttttataattataattccctttcaacagtttttcctgattaaagatattttagtagctggcttctttttaaactctttttaaactttttaaagtttttaaactttaaattttaagaagcttttgtaatatgtgatttgtctgtttatgccttattttgtttgttattttgaagcaaacataggaagtggcttactgccttgtataaaaagatatcagagaacagtggagtcatttggaaaaagcgcagtggtaaagtggcttcggaagtgattttttccccttattttctggcacagtgctttctaagatgatgttgctcactgtagttttctttcacttttaaaggcatgatggttccaggcaggataatcttaaatggtgatttgtcatctttttttccccttgcagcattgctatggcaacaaaagaaaatatgacttcacagagaggaatgttgaagtcaattcacagcaaaatgaacactttggccagtatcctttttgaatgttcgcagtctgtgttttgagggtagaggggagaagtgtctgtgtgtgcttttatagggggcaggttgccatcatcagtagcagtagagcccatcagtaattgcataatatgaatatactgtgcattcctactttgtgaaagtttatgctctttagtaccattcctaaaagactgcacctcagaagtttcttactactagatgtagaagaaaaaaattataaatgtgaatttaaaaattatccaccaatttcttctacattttagaaagcttttaaattcatgttagaactccacactatacattattcttacctaaacatgataaattatatgcctttgttgtttttcccatttagagataagtcagtggcagatgcttggaagggggaaggaaggagacagccacccgtgcagatgagctatagctactgatggagtttgtaactctatgcacaggctgaattctaggatacattctccacttgtttgttgtaacctctactttaaaatgtttcagttttctgttttaaattaggattattaatacttcccagaaacccactagggaaccagaaaagcctggcactctgagtcatttcattcagcgaacctctgaaaagacaagccttctaggcaaaaagctttcctccccaactgccaaagggggaggaacctagaattttcaaaagctgagtatcttgtagtcctagataatttgagttcacttttagtttgatatgtctttgcctaaggaaaagactctcctgatgtgtgctgttattctccagtccactgtgaattttgttcttgccttgtcaccctaagtataaaaccacatgtctaaaatcacattttagatagggctataaaatttacagagtgctgttatatacattatctcattttactaaactatgaactcaattgccagccagaaaagctgatcagtgaatttaagagtttgtatttagtgaaacttttgaaactttgaaatagaagtgtgagtcagatagctgatgatttaaaacactaaagcctttctcaattgttcattagaatttaccaccactcttctttgtgacctcttctctactgctctgtaagcatctctcccataagttctctctctctttttttttttttttttttttttttttttaagacagagtctcaccctgttaccatccaggctggagtacagtgg

SEQ ID NO: 85927 - DNA, 1129 bp, Homo sapiens
attcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttc

SEQ ID NO: 85928 - DNA, 1023 bp, Homo sapiens
tggacgcagtggctcacgcctgtaatcccagcactttgggaggccgaggtgggtggatcacaaggtcaggagttcaagaccagcttggccaagatggtgaaaccccatctctattaaaaatagaaaacttagccgggtatggtggcgggcacctgtaatcctagctacttgggacgctgaagcagagaactgcttgaacccgggaggcggaggttgcagtgagccaaggtcgcaccaccgcacttcagcctgggtgacagagcgagactccgtctcaacaaaaaagaaaaagcacctacctcatagattgttgtaagaatgatagatagatataaaataattagaacagtgcctggagtatagcaagaactcaatcatggttgctgtactatttagaaaaaaacaattgtggtgagattgctctttttaagctagtggctgttaagtatcattcatgttatatttttaaaagtatgaaatgacctttctacttcatttacagagttgaaactgtgggacagccagacagaagagatagcataggagtgtgtgcagaaaaacaggatggatatgactctctgcagcgggatcaagctgtgtgcattagtacaaatggtaagagataaataactgtcattctcttggaaatatattaattattttagtaatatgtgaatctgttccagttccatacatttatagtaggagatgagaaaatttaggtatttttctttttctttttttttttttttattatgaagtctcactccatcactcaggctggagtacagtggcatgatcgtagcccgctgcagcctgaaattcttgggcccaagccatcctcccacttcagcctcctgagtagccgggactacaggtgcatgccactgtgactggctaattttttttatttttacttttttgtaaagataagttgttgcccaggtgagtcttgactcctggtttccagcaatcctcccaccttggtggcctcccaaagtgctgggattacaggcgtgagcc

SEQ ID NO: 85929 - DNA, 1050 bp, Homo sapiens
aatcccagccactcaggaggctgaggcatgagaattgcttgagcctgggaggcagaggttacagtgagctgagatcgcgccactgtactccagcctgggtgactgagcgagactccgtctcaaaaaaaagaaaaaaagcataggccgggcactgtggctcatgcatattatcccagcactttgggaggccgaggtgggcagatcacgaggtcaggagatcgagaccatcctggccaacatagtgaaacctcgtctctactaaaaatactaaaaattagctgggtgtggtgaggtgcgcctgtagtcccagctactcgggaggctgaagcaggagaatcactggaagcctggaggcggaggttgcagtgagcagagatcgtgccactgcactccagcctgggagacagtgcaagattccgtctggaaaaaaaaaaaaaaaaaaaaaaaaaaagcaaaaaaatttactggccaagaatttgttttgtcctttgtgaatcattaacagcaagtctttgtaagagacaacactgtaaacatattatgtatatgctactctctaaagtaaaactgaaagcaagcctcccctaccactaattaatgttgtttctctacccatttctttctgtaatggaaaagtttcttttttcttgttttcatgttatctgagatgtattctttatagtcatgtttctgaatagctcttcgtagaaactaaagaccagttttgacttagagaagtaaagtttgcctgattttcaccatactcaccttagtgtaacaagctctcctctaagttttaagtcttgagatgggattttattgtgaatgcttgacccaagttccttttgttctcaggcccttattatttaaggcatggagaatatctgaatattttatctaagccagtgttgctgtattcctctccagctaagtaatttgaattgtcagcggttgtcagattatactagtttgttttgtctaatttttgacacctcaccccttaatgaagaatgactcagtaaacagaaaaataccaacaaagagagagag

SEQ ID NO: 85930 - DNA, 1015 bp, Homo sapiens
taatggaatcttttattttattgaacttgaccatggcccctaagagtagtctcccatttccatgttttatttaacgtgtctgtattgaagatatccctcaagagattctaacagttttcaatatctttgctttgaaaaagagtggacagctggttttgaggggtacagtctgagcagtcgaagaaatatagcacttcggaacgattctgaatcatcgggtgttctctactccagagctccgacttatttctgtgggcagacattaacattcaggcaagtagatattaaaacatctcacctgcctcaggaagcagagtgaagtgcatagagcatacataagctttgaattcaaaacatcctgagtttattccgtcatttataggcagtgttactgtgggaaggcttctttatttcctgtagctgtagttttctcatctgtattcacagggttattacgtagattaactgggaaatgtatataaaatgcttgttatttaatatgtttatatctcttttcctcttggtaagtagaggtaagtagagtatctctcaaaagtcaatcttaggctgggcatagtggttcacacctgtaaccccagcactttggtaggccgaggcaggtggatcacctgaggtcgggagttcgagaccaacctgagcaacatggagaaaccccatctctactaaaaatacaaaatcagccgggcatggtggcacatatgcctgcaatcccagctacttgggaggctgaggcaggagaattgcttgaacccaagaggcagaggttgcagtgagctgagatcatgccattgcactccagcctgggcaacaagagcgaaactgtgtctcaaacacacacacaaaattaaaaagtaaatcttaaaaatttagaggcctggccaggcacggtggctcacacttgtaatcccagcactttgggaggctgaggcgggcggatcacgaggtcaggagattgagaacatcctggctaacatggtgaaaccccatctctact

SEQ ID NO: 85931 - DNA, 1059 bp, Homo sapiens
gagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatggtatgctgctaaccttttctctcctgaagcctaactatatattagaatacctgtattctgtgctaagggcagcacactgacaaccagctattctaagcatagatcctgaattgataagaacaacatgcaccatgtcttttactcagattacctcatgtgatttttgttttcatcagttcttcagagtccaaaaaaaatgctggacaagatttttagcctcattgaaaaccaaagattgaaaatattatgtagggcactgatattcctttttattcttttttttatatttgaatgttatttagttagtttttttgagacaaggtctcactctgtcgcccaggctggtgtgtggtggtgcaatcatgcagcctgacctctagatccttctgcctcagtctcccaagtagctgggaccacctgcatgcacaccacacctggctaatttttta

SEQ ID NO: 85932 - DNA, 1011 bp, Homo sapiens
tttacacctgtaatcccagcacgttgggaggccaaggcgggtggattgcttgaggccaggagtttgagaccagcctggccaacatgttgaaaccctgtctctactaaaaatataaaaattagacgggcatggacctgtaatccagctacttggggaggctgagacaggagaattgcttgaacccaggaggcagatgttgcagtgagccaagtttgtaccactacactccagcctgggcaacagcaagactccatctcaaaataagtataaaataaaataaaaaattatccgggcatggtggcgtgcgcctgtaagtcccagctactcgagaggctgaggcaagagagtcgcttgaatcggggaggtggaggttgcagtgagctgagatcgcaccacagcactccagcctaggggacagagtgagactctgtctgaaaaaaaaaaaaaaaagcgtttcactgcccattaccactgttactaatgaaatagttgtgattataatccttggtatagtattactacacattttttcaatccaatatataaaagaattgttaaattttagaaattatcaatgtattgttgaaatggagtcatattccagtaaaccagatcttttggcttaaactggacagttatgatcctaccaattttctgtcttacttatatttatttgaaaagagaatctttgtgtaacatcttgcaaatcccctactgccatgagaattaattactgggggcttcaggatctttcaagcatgtgactgctctaaaatatttcttgtattttttaactctcagttagaggtctcataacacatgagctttgtttcctcagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggt

SEQ ID NO: 85933 - DNA, 1054 bp, Homo sapiens
caagaagtgtctttagccaatacataatttacagatttatctgggagctcttttaaaatagtgttctatggccgagcgcggtggctcacacttgtaatctcagcactttgagaggccgaggcaggaggattgcttgagtccaggagttcgagaccagcctgggccacatgatgaaaatccgtctcgacaaaaaatacaaaatatagctgggtgtagtgacacatgcctgtggtcccagctacctgggaggctaaggtgggagaatcacctgagcccaggagttcgaggccgcagtgagttgtgattgtaccactgctctccagcctggacgaccaagtgagaacctgtctcaaaaaaaaagtgtcctgtaagtacaaaacagcatggtgtaatgaaagagcatagtctttggagttagactgtttctggcactgcgaagccttgggtaagttgtcttctttctcttctttggtcctcactttctgaaagtgcattgtgaagatttattgagttaacagtgaacgcatggaaccattggtaccacatcaaatatgaagaaattcactcagcagtggagctgcatttttaaattagtttcataaagtcaagcaaatgaacttgattagttacatgattggattaaaggtgactaggctttaaatcatgaaatatttcaaggaaaagaaaatgatcccatggtggtatcaagtttcaaatggcagtggttgggattctatgagcaaaagggaccaaatttacaatgagagtacaggaggtgaatttggaaattgagtctcatttttttagccctctgtctgttttgtgttcacttacttccttttttctgaggttctgaaacaaaaacaaaacgtaggctctgcaacagctgaaggagcttttgaattctttctgaagaggaaattgactttacctaaccaatgcacttcctgtgtatgctatatccgctaaagagcaagacaggacctcagaggcacagtgctcaactgcagaatttcctcttggccattcgaaatgtattacagcgttctgacac

SEQ ID NO: 85934 - DNA, 1505 bp, Homo sapiens
ctacagtgagaaatgccagtattttagtctgtgtgttgtagttcactctataaaatgactatgttggctttcatgtaccttttggtattctgattcagtatttctcaggacactgacaaaagcaagtctctgctccttcaagagcaaatggtaagatcctggtacctaattaagatactagttggtggctgggctcagtggctcacgcctgtaatcccagcactttgggaggccgaggcgggtggatcacatgagatcaggagtttgagaccagccttcaacatggcaaaactctgtctctactaaaaatgtaaaaaaaattagccaggtgtggtggaatgcacctgtaattccagctactctggaggctgaggcaggagaattgcttatacctgggagatggaggttgcagtgagccaagatggcaccactgcactccagcctcagcaacagaagaagactgtctcaaaaaaaaaaaaacactcaaaagttatttcaaaaaaccaagacaggaagtctcagtagcttagcaaagaaaagaaagctgttggccaggcgtggtggctcacacctgtaatcccagcattttgggaggctgaggcgggcggatcacctgaggtcaggagtttgagacaagcctgacccatacgatgaaaacctatctttactaaaaatacaaaaattagccgggtgtggtggtgggcgcctgtaatcttagctactcgggaggctgaggcaagagaattgcttgaacccaggagacggaggttgcggtgagccgagatcatgccactgcactccagcctgggcaacaggagtgaaactgtctcaaaaaaaaaaaaaaaaggaaaagaaaagaaagccattattgctccttttatctcccacttccccttctgttacccattttgaaaacactacaaaaatctgtgtataatttgttacagtagtagtatttaaagtgtccctattatagtattctaagaaaaggttaaatccagatacagggaaaaccaagaacagatgaaataattttttttttttaatgaagtttcgctcttgtcgcccaggctggagtgcaatggctcaatcttggctcactgcaacctccacctcccaggttcaagcaattctcttgcctcagcctcctgagtacttgggattacaggtgcccgccaccacgcccagctaatttttgtatttttagtagagacggggtttcaccatggtgaaggctggtctcaaactcctgacctcaggtgatccgcgcatctcggcctcccaaagtgctgggattacaggcatgagccaccacactcagcccagatgaaatagttttaaaataacctactacttacagacaactgcagttaactttttttttttttttttttttttgggatggagtctcactctgtcgccatgctggagtgcagtggcgccatctcggctcattgcaacctctgcctcctgggttcaagccattctcctgcctcagcctcctg

SEQ ID NO: 85935 - DNA, 1077 bp, Homo sapiens
gaaaagaaagatattaaaataccatctaacatttcagtcagttaagatgtattctatatgaccatgattattgtttttgtattagcaattaagaatcagagttgacactaaatgagtgagtttagcacctgggagtaattaatttctcttgatattggatgcattaaaaaaaatcgtgattacaccctagatggttcagtattcaattttcaaacctgtattttttcaattttatatccaacaatttaaatacaggacatgcttttctgtggtttagtttattatgagctttgttttgttttgtttttgaggcccattgtcttgggcttcagacagaaaacactaaatgaacatcgatcacaattaggttcctgatgacattgccttctgactagactgagtaataatgtagttctcttttgtgagtgtgagtctcttttgggaatgtgttttgtgccagtggcagttacaacagcatctctcgaagctaactctagtggattgtgcatgtttgggtttgtggcataagtcctctgtcaacttgcattttaaggaaggtctatggtacaaaaatattatcaaagtaagcagctgcttttgtttggtggtttggatatttttagggttccagtcattttcagaataactgtaaaatatatggcactttagtcaaggattttgcatgggagaagcatgagaagagcagagaggaagggatgccacctgtcgtctgtattttttacttgctgattttatatctttttggcagatgatttcttttctttttttttttttttttttggcgggggtgcggacagggttttgttacgtttcccaggctggtctccaactcctgggctcaaaagatcctcccacctctgccttccggtgatggaattacaggtgtgagccactgtgctgcctggcatgtgactttttttattgagatataattcacacaccgtaaaagtcatgccttaaagtttacaattcagtggtttttagtatattcatagagttgtccaaccatcaccagtgtctaattcaagtatatattcatcacccccaaaagaactc

SEQ ID NO: 85936 - DNA, 1059 bp, Homo sapiens
ccgagggagtcattttggccctctcggctcaccgtccgcgcagcctcctgaagcagccgtaaactccgccccttgcgcgcaggacggcgcgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgaggtgaggttgagtcgaggatctgttgagttccttcctctatcttttgggggattggaaggtgggtcttggcggaaggtgatcctgactttgtaaggggaaaggtgggacattgtgaggacccacagctgtgacacattgtgtgcaacagttgccagagtgtgtcgtttagagtcgtgtcaagtcctgataaacatttggattctgagatatttgcggggtcacagtaaattggggacttaagataacacggccagttcccagatcccgaaatgttggtggaacgtgatgttttggacttccgacatgtcacagaggatcccagggtcaagttctgggttcgtgatacggaatcactgaactttagcgctgaagaagatctttaagttaaactagttcatacatccacctgtgcttggaatgccactttagaatgtcactacagaaatcaagcaaggtacttaaagaaaacagtttctcatggcttagtatctgcggttaggaatcgcagtgtaacatgttcttttgggtttatcaggt

SEQ ID NO: 85937 - DNA, 2055 bp, Homo sapiens
tatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaaaataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattaggtaaggtttgtttttgttctaacgttctagtattctgcatgtattattagctggggacaaaaatgcttcaagtattggagggtatttttttttctagaacacagctgtttaaaagaaaaagaacaggatttcttttttttttttctttgagatggagtcttgctgtgtcgcccaggctggagtgcagtggggcaatctcggctcactgcaa

SEQ ID NO: 85938 - DNA, 1024 bp, Homo sapiens
gggttttaccatgttggccaggccagtctcgaactcctgacctcaagtgatctgcctgcctcggcctcccaaagtactgggtttacaggtgtgagccaccacacccggcaagtttgattacttttgaatcagtggtttgaaactgatgggaattatttttttcctcctgtttcagaacattccagaaattggagccctagttggttctttgctgtctatctatctgtctatgcatctctatctatctctctggaaacaagttctcactgtgttgcccaggctggtcttgaactcctggggtcaagcaatccttccatattagggtcctgagtagctgggattacatgcagatgccactgcaccagctctattttatctatatttaattgagattcttgtgtatgttataatcatgaaaatgtttctgaataccttatttttatttcagaatgaaattcaccagaattagtactcccaaaaaatctaagaaaaaatctaacaaaagatctgagaaatctgaagcaactgatggaggttttacttctcagattagaaaggtaattaaaatattagagagtcctataagtgccattctgtttccttaaaaaacaaacaaaaaacccccacattactatgggaagtaatgagccaaaataaaattcatgtatttcataaattggttaactacaaccctatgatatttttcactattatcctgttcctctagttaattaagatatcttattgtgaggtgaaagcaattgataaaggcagagtataatttacttataaaaagctttcttagtgagtttacatcgtgatcatttttcctaacactgccgatcttagtttgggctcctgtagcaaattaccatagactgagtggcttaaacaacagaaacatatttctcacagttatggggattgagaaatgcacgatcaaagcatcagctatgcagtgtctggtgaagctgtcttcttgttttctcacatggtagagaacagctagagagaggggtctcca

SEQ ID NO: 85939 - DNA, 1100 bp, Homo sapiens
gagatcatgccactgcactctagccttggcagcagagctagactctgttaaaaaaaaaaaaaaaaaaaaaaaacaaccttgaggccaaggtccatgtattataatactgttttctttatagtatccagcctagagccattcatatagtaggctgggtaactgtttggatttggaaagtactttgcctgaatttggtgactaaaattaaaaaatagattgccaagtctatactacagacatcctcttgggtgttttgctcacatgtaaatatatttacctggatgatttcaagtaagaaataaaggcaaactaatgataactagacacatttcaatttaaggcccctggtaagatttgaataaccatttctttgttgattatttaatgtgatttgtgattgtatttttttctattattaaatataaaatattttcttgtgatgtaaattaatgtttcaattttttgtttaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagtaagtattataaatatctgttggtataaattctctcctattttgctgtttggagtgggagaaggaaaccattataaagttataaggtaggtttgtgtgatagcttgaagtggtagagagaatatcattttcagttttgctttaaaagccttctgcttttttttgtctgcagaatacagtttgaatccttcttaagtcactcaagatctttcataagctgaactacctcttccttttttttttttgagacagagtttcgctcttgttgcccaggcgagagtgcaatggctggatctcggctcactgcaacttctgcctcctgggttcgagcgattctcctgcctcggcctcccaagtagctgagattacgagtgtgtaccaccatgcccggccagttttgtatttttggtagagacagggtttcacagtgattggccaggctggttttgaactcctgacctcagg

SEQ ID NO: 85940 - DNA, 1012 bp, Homo sapiens
cataagctttatatttagtgactaaagctattttttttttttttttgagttggagtctcaccctgttgcccaggctggagtacagtggcacgatctcggctcactgcaacctctgcctcccgggttcaagcgatcctcctgcctcagctccccctagtagctggaattacaggcacacgccaccatgcccagcaaatttttgtatttttagtagacacggggttttgccatgttggctaggctggtctcaaactcctaacttcagatgatccacctgtctcttggcctcccaaagtgctgggaatataggcgtgagccaccacgcccggcctaaagctaatcttacgttgatactgatttatgatggacagaaagtggttggtagtattgtaattaacatgaatagatgatgttggtctgttattgtgcattttattctttattgcagttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaaggttagtgataattattatcatttatgttaacataccagttttgggtttttatattatttattattttatttttatttctgagacggagttttgctcttgtcgccctggctggagtgcagtggcacaaacctggctcactgcaacctctgcttcctgggttcaagtgattctcctgcctcagcctcctgagtagctgggattacaggcacccaccatgacgccctgctaatttttgtatttttagtagagatggggtttcaccatgttggccaggctcgtcttgaactcttgatctcaggtgatccatctacctcagccccccaaaatgctgggattacaggcatgagccactgcgcttggcctattttttctttttttttagagtgttgctctgtcaccca

SEQ ID NO: 85941 - DNA, 1031 bp, Homo sapiens
agctgggaccacaggcttgcgccactgcacctagcttattttattttttaatttttacttattctcttgagactgggttatgagactggctagtttttgtatttttggtagagaccaggtcttgccatgttgcccaggctggtcttgaactcctgggctcaagtgatcctttcgccttagcttcccaaagtgctgggattacaggcatgagtcaccacgcccagcctaacgtgtcagttttgaaaaacactaagacttaaccaatgacacttggaagtgttcaccacagacaacattgcttacacttggcagggagaattgttcagctgaagtaaaagtatcttgtacaatgcaatgtgcaacattaatccccgccagtttccaaaaatgccaactcaaagatagctttaattatgttaaaatattatgtacttaaggaatgccttagataattttagcttatatagcttgtataaaagacagtctaagtattaaaatctccagcttgctttcagtatgttatatttgattcttgcctttttattttattttattttatttattttttgagacagagtcttgctctgacacccaggctgaagtgcagtggcgcgatctcagctcagtgcaacctctgcctcccagatttgagtgattctggtgtctcagcctgcctagtagctgagattgcaggcacctgccaccatgcctttctaatttttgtattttttagtagagatggggtttcaccatgttggtcaggctggtctcgacctcctgacctcaagtgattcactcgcctcagcctcccaaattgctgggattataggcatgagccaccatacctggcctatttatttattttttaagagacacggtctcactttgttgcccaggctagaatacagtttgtttgtttgtttatttatttttattttttgagacggcgtcttgctctgccgcccaggcagtggtgtgatctcggctcactgcagcctcagccttctaggttccaccgattctcctgcttc

SEQ ID NO: 85942 - DNA, 1066 bp, Homo sapiens
agggtctcactttgtcgcccaggctagagtacagtggtgttttcatggctccctgcagcctcgatctcccgggttcatgtgatcctcccacctcagcctcccaagtagctgggactacaggtgcatgccaccacccctggctgatttttgtatctttagtagagatggagtttccccatgttaccgaggctggtcttaaacgcgtagactcaagcaatccgctcacctcaacctcccaaagttctgggattagaggcctgagccactgcacctggattgcctttgcattttaaagttacaagactattggatacttggaagtgatattaatattactggtttttgttgattagtaagcacatgcacttctttaattcccaaagcagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaaggtatattttctaaaacatcccaaaagaaatagattgctttgaggacatgcaaagtggaaaccaaagcagtagaagattttgatatgctttttaaaaaattttaattcaattgtattttaattttagattttctttttcttttttgagacacagtttctctcttgtcacccaggctggagtgcaatggcacgatcttcgctcactgcaacgtccctccacctcctgggttcaggtgattctcctgcttcagcctcccgggtagctgggattacaggcacccacctgcacgcccagataatttttttttttttttgagatggagtcttgcacggtcgcccgggctggagcccaccatcatgcccagctaactttttgtatttttagtagagacggaattggccaggctggtctcgaactcctgaccgcattattcacccacctcggcctcccaaagtgctgggattacaggtgtgagccaccgtgcctggccacgcccaggt

SEQ ID NO: 85943 - DNA, 1098 bp, Homo sapiens
cgctctgtcgcccaggctagagtgcagtggcgcgatctccgctcattgcaagctccgcctcccgggttcacaccattctcctgcctcagcctcccgagtagctgggactacaggcccccgccaccacgcccggctaattttttgtacttttagtagagacggggtttcaccgtgttagccaggatggtatcgatctcctgacctcgtgatccgcccacctcagcctcccaaagtgctgggattacaggcgtgaaccaccgcgcctggctaacactttaatattttaataagattatggtggttatttttttttagggggaagggtttggtgtgaagaattttaaatgtaatgttgttttaaaagtacctctggcattttgtaaatataaatatttctgcaaatacctactgtgacattgtaacaataatgtaaatgactaataattcatatatgtttatgtcaaggaatgaataccttaattttttttttttttgctttagattctggaactgaagacatgctttggacagaaaagtatcaacctcagactgccagtgaacttataggaaatgagttagctataaaaaagttacataggttggtaaaatgtgtaaggaattgagaaatagtttacaaacttagttttactgtttttgtttcgaaattgtagttacaaagtaatatatctcatgataaaatcttcaaaaaactggtagaagtttaagtgaaaagtagccctcttttcttacatttctacttctcagagataatcattgaaaattttttgtaaaagcttccagaaaaatatttttatgcatatgttagttccttcctttctaacaaatgggatcacattactactaattcaggtccccagtccttcatcttcaattctcacatccaaaaaattctgaataatgaaagtttattgactttattacatgaaatttgttacacctttacacttagtagaatttacaaatttttttttttttttttttttttttttttcaagacagagtctcactctgttgcctaggctggagtgtaatggcacgatcttggctcactacagtcgctgcctcccaggttcaaca

SEQ ID NO: 85944 - DNA, 1085 bp, Homo sapiens
gggctgaagcaattcacctgcctccgccttccaaagtgctgggattacaggcctgagccactgtgcctgccctgccacctcagttctttttaattgctgtataccagtttctaagtgagtgtactataatgtatttttcccaatggtgtatttttatgtttttcctgttagaggctaatatgaacaatgctacagtgaatattcttacacatatagtcttgtatattttggcagaaactacttcatttaaaaatgttcatgtccatgtaaaactattttactctttagttgattcacaagcactgtggagtgtttagaaactaacaatatgccatataaagctgtactagtaaaaataacaagaaagccttcatcagttgaatggccagtggcagagaaactaacaatatgccataacttcccccgataatcattttaacataaagtctaaggcatagctatattctgtgaattatttttattatgttttcttgtggcagttggttgaaagactggaaaagaagagctgaattggaagaaaggcagaatctgaagggaaaaagagatgagaaacatgaaggtattttgtgtgtctttttttttttttttaccatttcactgaacatttttagagttacattaactaaaactttctataaaatttcttttttttttaatttttttttttttttggagacagagtcttgctctgtttcccatagtggagtgcagtggcgcaatctcggctcactgctacctccgcctcccgggtcaagtgattctcatgcctcagcctcctgagtagctgggattacaggcgcctgccgccacgcccgactaatttttgtatttttagtagagatggggtttcaccatcttggccaggctggtcttgaactcctgacctcgtgatccacccaccttggcctcccaaagtgctgggattaagcagtggcatgagccactgcacctggcctataaaatttcttaattggtattttatatttgattttctactttttttttttttttttcactctgtcacccaggctggagtgcaatggtgtgatctcggctaactgcaa

SEQ ID NO: 85945 - DNA, 2250 bp, Homo sapiens
aaaaaagtagctaggtgtggtggtgtatgcctgtagtcccagctactctggaagttgatgtgggaggttcacttgagcctagaaggttgaggctgcagtgagctgtgattgggccactgcactccagcctgggtgacagagtgagatcccatctccaaaaaaaaagatctattaactatatttcttcatataatctcatacacagtctaatgtcaattttctgttgtttcaaatgatttgttcaaatctggatccaaacaaggttcatatcttacatttgattcagttctcttaactttcttttaatctcgctaacaattcactcacctttcttttcatgtcattaatttgttgaagaatctgagtcatttgtcatgaaattcttcacattctggatttgtctgctgattatatcctcatggtgtcagttagtatagtcctcttccctatatttcttgtaaactggcagttagatctatgggccttattagattcaggttctgttctgggtctggcatacatatacaggtggcctgtgtacttcctatgacatcatagcagattatcccttgtagattacaaaatgataattttataattctcttttttgcatttattagaattttaaaaggaagcactattcctcatcaactctttggatgctttggaatacagtttataggcaccagaaatgcttcattcattcctttatttattagtacttagagtgatggtgtcctagcaaccttgacagttgaccagtgagtttttgtgtagtttaattttttaagtattattatgaactcatggatttttatatatataatatgtttcacctctttgtgtttattatttctttgttgctttggagattttctcactggttttaagtaatttgattatgatgtgccttggtgtacttctcttcatgtttcttgtgcttgggatttgttgagtttcttgcatatatgagtttatagttgggaagatcaaagttgataaaatttcaaccagtatttcttaaaatattttttctgtcctccccttttcctttggcaactccagttattattataggtattttagaccacttgaaattgtctcctggcacactgatgctttgttcaatttttcagtctttttcctctttttgtttcagtttggttagttgttattactattcaagtttacacatcttttctgtagtatctagtatgctgtcactgctataagtatagttttcatttctagaagtttgatttgggtcctttttatatcttctgtgtttctacttaccatgtgcccagtctttcctgtaggtttttgaacatatggaatacagttataacaactgttttaatggtcttggttattaattctatcatctgtgtaatttttgtttttttgaaacggagtctcgcacttgtcgcccaggctggagtgcagtggcacaatcttggctcgctgcaacctccacctcccaggttcaagcaattctcctgcctcagcctcccgagtagctgggattataggcaaccgccaccacgcccagctaatgtttttgtatttttaatagagacagggtttgaccatattggccaggctggtctcaaactcctgacctcaggtgatccaccccccatggcctcccaaagtgctgagattacaggcatcagccaccacgcctggcccatctgtgtcatttctgagttgttttttcaattgattgattattccctctttcattatggattgtatttttctgattctttggatgcctgataattctgattgcatgtcagactttgtagagtttgccttcttgggtgctggatatttatgtattcctgactgttcttttttttctaaatttatcaatcctgcactttttgtacctataactgttcgttaactttcttctgtgatgtggttaagttagttgggaaaagtttatcttcaggtcttgtgtatgtgtttgtttttgagacagtctcaatctgttgccaaggctggagtggagtggcacgattatggttccctgccacctcgaagtgggcttgggcaatcccccaaccttagccttttgagtagctaggactacagaccaccgcactcagctaattaaaagaaatttttttttgtagagggggtcttgctgtgttgtcaggctagtctcaaactcctggcctccagcagtcttcctgccttggcctcccgtagtgctaggattacaagtgtgagccgtcacca

SEQ ID NO: 85946 - DNA, 1125 bp, Homo sapiens
cgagcactttgggaggccgaggcgggtagatcacgaggtcaggagatcgagaccatcctggctaacacggtgaaaccccgtctctactaaatatacaaaaaattagctgggcgtggtggcgagtgcctgtagtcccagctactcgggaggctgaggcaggagaatggcgtgaacccaggaggtggagcttgtagtgagccgagatcatgccactgcactccagcctgggcgacggagcgagaccctgtctcaaaaaaataaaataaaataaaataaaataaataaatgactggcttaaccttctgtactggtagaataaataaatatagtaatatttggatgtacatagtatttttaagaatgaaagaaaatttctgtgtctttgatttttaactgttaagagtagaaatacagaatgtggctaactgtcttgctacctgtatgatttttagaatatttatctttaagtgcaatttgtttttgggcagaaaaaataagctcccctaagaaagttgttacatcaccaagaaaagttcctccaccatcaccaaaaagtagtggaccaaagcgagcacttcctcccaaaaccttggcaaattattttaaagtatctcccaaacctaaaaataatgaagaaataggaatgcttctggaaaataataaaggtaagacattaaattgacaaattttatattttttaataataatgacccttatacctaaaaatgtgagcacattttacgagttcctgttgctatttattaaatctcagctacactgaaggttctacatgtagaagtgttaatattttgtttccttttttttttttttttttttttttttttgagacagagtcttgctctattgccaggccaagctggagtgcagtggcacaattttggctcactgcaacctcttcctcctgggttcaagcaattcttctgcctcagcctcccgagtagctgggattactggtgcacaccaccactcccagctaatttttgtatttttagtagagacggggttttgccatattgttcagactggttttgaactcctgacctcaagtgatccacccaccttagcatcccaaagtgctgggattacagatatgagccaccacgc

SEQ ID NO: 85947 - DNA, 1050 bp, Homo sapiens
accagcctgggcaatatagtgagaccctgatctctaccaaaaaaaaaaaaattaattagctttatgcactaattagtgcaatttctaacctggtttttaaaaaattgtgtatttttcagtgttatagtattcatatttataattttgttgtaagatattctatcaagctatactgttacttaatcctaaggggttttatcaaggtttataaaactgccttcagtgttcaggttggagaatctcctataaaagtttccttgctgtcttgcacaatatacagttaataaaagaaatacatgtaaatgcttttaatttaatggtatattcccttatatttttaaagcagtttcatcctcaagaagagcatttaagataatgtgaattttagcaaaatttgtctcacttttagatactatttgtatgtattattgctgtatctatttgaactcagcagttaaccacatttctctctctgttttgaagctaaatgttgccagctacctacaaatgatttgcttaactgagaattttagaactgatgtaaaagactttgtaaccttgttaactgcaaatacttgtgatatcagaaaaagtatcctttacttacaattctggattagaagtggaggtggagttttagaagaacgaccattaaccctttatcgtaagttgatttgttattaaagaaatttctattatgggaccctatttaaaaatctgtgctatggctgggtgcagtggctcatgcctgtaatcccagcactttgggggagtgaggtgggaggatctcttgaggccaggaggtccagatcagtctgctgaacatagtgagacccctgtctctacaagaaaatttatgggaggccaaggtgggaggatcacttgaagccaggagttcaaaaccagcctgcgcaagaaagcgagacccctgtctctacaaaaaaaatttgcaaaaattagctgcgcagggtggcatgtgcctgtaatactggctacccgggaggctgaggtaggaggatcacatgatccccgaagagtttgaggctgcag

SEQ ID NO: 85948 - DNA, 1286 bp, Homo sapiens
gccacctcacctggcctgaaattaatattaggtatttatttttcttctgtgacttgcctgctcacagtccttgcactttttctgttggatggctttgaaagtcccccaccatcacctcacttaatttatctcttggtagaaataatgcttatggccaggcgcagtggctcacgcatgtaatcccagcactttgggaggtcgaggggggtggatcactcgaggtcaagagttcgagatcagcctggccaacatggtgaaaccctgtctctactaaaaatacaaaaagtagccgggtgtggtagcgcgtgcctgtaatcccggctactcgggaggctgaggcaggaaaatcgcttgaacccaggaggtggaggtttcagtgagctgaaattgcaccactgcaattcagcctgggtgatagagtgatactctgtctttaaaaaaaaaaaaaaaaaaagaataatgcttatattgtactcttaatgaattaaacacatatgtagagaactaaatgggggtatttgtccagaagatgtcaaaggatctcaggctttaaataattgtttgatacaatttgtttaatacatatatagagctaagattttcttttattttgtaggtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaaggtattttcaatgtctgttttgcaatgttgaatttatattccttttcatattcccaacattagcctcctatcttttgaatcttaagtttaacttaaatgtgcctataatttgtataagccttaggtctctgattttaacacatcctaccactttgacaaatggtgcataggcattgctctgaatgcatattataggatttagaatagcatttagaaaatttttcagatagactatttcagaaaagtggttttaaataaatgagcttctaataatattggagtatatactaaatacatagagaatttaattctccaaattaatcgtctaaatttaatttttagacatagtactattttgatatattaaatatagataaataaaattatgaggggtagtgactcagtactttgaatttagaatagggataacactatattcatacaggtagaaaagtattcaaactatgtactgctgtaacatttctttac

SEQ ID NO: 85949 - DNA, 1552 bp, Homo sapiens
tagtcagtcagcagctaatttagagtaagtcttacttcctttactttttattttttggtaataaatcgtaaaggggaaatcaatagagttttttcttaatttaaaaatgctgtactattgatcatggtaagcccttaacattaataatgtagcttctaatgagatagctaaagagaccagcttgatcgctgggaagagaaataatgagtgattggggtggatttaggtaatgcttgaatgacccaggaaggagtttggtcttgctgtatagttattgagattttttcagtatgggagtgattgatgtgttgacaggaaattaatctggaaatgtcatctggtctagaccagaggcaaggaaactaaactggttgtgattgggattactgcatttttcttgggcattaaaaattaaaaacaatgcattacttttacagcaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaagaaggtaaaggctttattaaaaacaacattttagatagctttttcaagattaatacatattttcataagatgaaaatgttaatattaaattgtatttttctttgtaattttgacagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtagagttcattaagatgaactccctatttcaagtgtttatattatatattagcttaatattcagatacattatcttggctgctaacattagtgtcactaaagttggtatacaatctcccactgctaaatttgactggctttacaaaaacaaaaacattatctggtgaattatatttttaacctaaaagttaaggatcctcatattgtacagttttttttgtgtgctttttttttttttttttgagacggaatcttgctctgtcacccaggctggagtgcagtggcctggtatcggctcagtgcaacttttgcctcccgggttcaagcgattatcctgcctcagcctcctgaatagctgggattacaggcatgtgccaccttgcccagctaatttttgtatttttagaagagacagggttttaccatgttggttaggctggtctcttaactcctgacctcaagtgatccatctgcctcggcctcccaaagtgctgggat

SEQ ID NO: 85950 - DNA, 1043 bp, Homo sapiens
cagttcataaactataaataagtttatattacataaactagttaggcattctgaatttgtagattatgtttgcatctaaaatatttacacttctggccaggcacggtggctcatgcctgtaatcctagctctttgggaggtcaaggcaggtggatcatgagatcaggagatcgagactatcctggctaacacagtaaaaccccatctctactaaaaaaaaaaataaaaaaattagccgggcgtggtggcgggcgcctgtagtcccagctagtcgggaggctgaggcaggagaatggcatgaacccagaaggtggagcttgtagtgagttgagatcgcgccactgcactccagcctgggagacagagcgagactccgtctcaaaaaaagaaaaaactaaaatgtttatacttctaattaaatcagtcttttcttttaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagaggtaaggcagttgcacctccagattcctacctgctagagctccttgtgtagtttaatcttctggtcccaaaaggaatgtaataaaatagtaaagatgggttttcttctggtacttgttactcacttattcctattatgttttccatcacctttgatttttaaaaattcaacctttagttagttcaagaaatgccttatgcatcgaaggcagatactgagaaaatcaatggtatttcattctaaatgttatagaacattatcactcttttatttataaagcttatttttcaaaatgccatcacattgtctcatttgagttttcaaaaccttgcgaaatggtcaggaattatcaccttaatggtcaggaattaccaccttgattatacatatgaaatctgtggttcagtcaagcatctgatgtgattagtcagttgcagaggtgattgattcttgctag

SEQ ID NO: 85951 - DNA, 1029 bp, Homo sapiens
ggcaggagaatggcgtgaacctgggaggcggagcttgcagtgagccgagatcggccactgcactccagcctgggcaacagagcaagactccgtctcaaaaaaaaaaaaaaaagatgattctccaagacaatttaatattgtcctctattagttcttaaattccaggaaagtatttgtgactttgcaaaggatctagtcaagcttgcaactaaccccaaaggaagtaggacatccaacttatattttgctaaattttccttttagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggtatattcttcatgtctgctatactgcctaatatttgagaacctactctagaaagcactcttctgggcattgggttgggaagtggctaagacagggttcttcaggtttagttggcaagtatatgatcactaccaaataatgagatgtacagatagtaaattggcagttgagaggagagaaaacaatgggctgtgactgttgtggaaagtttactggaagaactcaatttaggtcttaaaagagagatcctttggatgggagaggagggcattgtaggtagaaagaacagttgatgctgaga

SEQ ID NO: 85952 - DNA, 1030 bp, Homo sapiens
gccctcaacctcgaggtcttgcctgcaaacaaaactagtctggcttcttcttctttttttttttttttttttttgagacggagtctcactctgtcacccaggctggagtgcagcggcgccatctgggctcactgcaagctccgcctcccgggttaacaccattctcctgcctcagcctcccaagtagctgggactacaggcgcctgccaccacacctggctaatttttttgtatttttagtagagacggggtttcaccgtgctagccaggatggtctcgatctcctgaccttgtgatccgcccgcctcagcctcccaaagtgctgggattacaggcgtgagccaccgcgcccagccctagtctggcttctgagtgtcttcgaggtcaacagacagggaaagaaggagatggccaagaggagattcagaaattggggtccgcatttagctcacctcagactctgggagttcaggaaaggccatttttaggtactgcagacgggctgcacggagggcattgaaccagtccactatctcctgcggagagaagtgcacaggacacacacacagcagtgagatggggtgggtgggaagctacctctggtggcgggaagctagctgggcattgggtgtggggcacatatattcagcacctgcacacaccccacagctcggctcaggggcatccagggaggattgtgtcagagcctcgtgggctaacccgggcaagcaggaagcctctgacagggataaccccagagccctggaaaaggattgagtgaactgcatgggagttctgcaatggcctcggacagtgcttttcaccttctaatgcgtgcaaaatcacctgaggctcttgttaaaatgcagaggcatatccagtaggtttggaatggggcccaagactctgcattcctaacacgctctcaggtgatatgatgctgctagtcagtggaatgcactctaaggagcaaggctctaggaaatcattgtcctcagatgtcaaagattggcatttgggtggggagcag

SEQ ID NO: 85953 - DNA, 1041 bp, Homo sapiens
gtccacactaagcaaaatagaaaggccagagctgtcctggcaaacaatggaagaagggagcaaaagactcagaagtgggaatgacatattatttacatcctatcctgtcagctgtgttctgctgtttatcacaagcaataaggaatgtgctattgagagggacacaagcatcactgagaagtccaatagtcacttttctctgtagaccagggcttatagtggaagatgtttcaggagctagggtccctgatagcaatgggcctgctagagaccaggtagcagtgcataactagcagaagattaagtggcattgttagaagtggcaagatagaatggcatccaaggaagcctgacccacaggaagctatgaaggtagttagtaggatactgtgtgcctcaagatgtagtttttaaaacacaaggacagataaggaggcagctgagaggagctgccccaatagtcataatcccttgccctgtttctcaacctgagccaatttccagaacctaatgactgaggaagaccggattcccagcaagggtatatagtgatgagtccttgtcctctctgaatgggtacttagcatgggcatacttggtggttggcagaacctctatgatagttccttggcctgtggagcaagagctgtcatagtggggaaggccaaggccatacctggggaagcttctaaaactgcacccctctcacccagccaacagtcgacatttttaaaaagtggcataccctgggggaacatcagagaaaaggatgcaaatacagagtagcagggctcccactcaacaaggctgatccagctgctgatgccaccaaatgcccaacctgccagcaacagcacagatcttttgtcatttactctttattctttttcctgctgagaacgtagatcaaagcctagaagtgaagcagctattttgcaaaagatggaagctaaaggaagcttgggtccctgatacttcttcaagcagctgtacctgccctgaactgcctacctccagagttctggttacagaaagaaaaat

SEQ ID NO: 85954 - DNA, 1050 bp, Homo sapiens
agaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagac

SEQ ID NO: 85955 - DNA, 1027 bp, Homo sapiens
gaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtag

SEQ ID NO: 85956 - DNA, 1058 bp, Homo sapiens
gaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgtta

SEQ ID NO: 85957 - DNA, 1041 bp, Homo sapiens
aagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaag

SEQ ID NO: 85958 - DNA, 1042 bp, Homo sapiens
cttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggct

SEQ ID NO: 85959 - DNA, 1078 bp, Homo sapiens
accccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatatt

SEQ ID NO: 85960 - DNA, 1056 bp, Homo sapiens
ttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagca

SEQ ID NO: 85961 - DNA, 1349 bp, Homo sapiens
tggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtag

SEQ ID NO: 85962 - DNA, 1033 bp, Homo sapiens
aatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatga

SEQ ID NO: 85963 - DNA, 1963 bp, Homo sapiens
gaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaacta

SEQ ID NO: 85964 - DNA, 1024 bp, Homo sapiens
catatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctct

SEQ ID NO: 85965 - DNA, 2124 bp, Homo sapiens
ctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaa

SEQ ID NO: 85966 - DNA, 1050 bp, Homo sapiens
gatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttttaagaaataattgatttcctgattcaagcaccagagacagaaaaaaaaggaagtaatcaagtctgctttaatgatacttattgacacatatcagaaaatgattaaacactatggactgtata

SEQ ID NO: 85967 - DNA, 1108 bp, Homo sapiens
atttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtt

SEQ ID NO: 85968 - DNA, 1039 bp, Homo sapiens
taagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtga

SEQ ID NO: 85969 - DNA, 1148 bp, Homo sapiens
ctttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcat

SEQ ID NO: 85970 - DNA, 1046 bp, Homo sapiens
agtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaaga

SEQ ID NO: 85971 - DNA, 1036 bp, Homo sapiens
tgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgtttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatcttttttttttttttgaaatggagtttcactcttgtcacccaggctggagtgcaatggagcgatctcggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctg

SEQ ID NO: 85972 - DNA, 1037 bp, Homo sapiens
ccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactatta

SEQ ID NO: 85973 - DNA, 1051 bp, Homo sapiens
gaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatatgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaat

SEQ ID NO: 85974 - DNA, 1092 bp, Homo sapiens
aactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtctcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtc

SEQ ID NO: 85975 - DNA, 1050 bp, Homo sapiens
cggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacct

SEQ ID NO: 85976 - DNA, 1009 bp, Homo sapiens
tttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgc

SEQ ID NO: 85977 - DNA, 1009 bp, Homo sapiens
acagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaa

SEQ ID NO: 85978 - DNA, 1076 bp, Homo sapiens
taatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctg

SEQ ID NO: 85979 - DNA, 1023 bp, Homo sapiens
tttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcag

SEQ ID NO: 85980 - DNA, 1045 bp, Homo sapiens
agcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctg

SEQ ID NO: 85981 - DNA, 1068 bp, Homo sapiens
tagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattc

SEQ ID NO: 85982 - DNA, 1035 bp, Homo sapiens
acatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtctttt

SEQ ID NO: 85983 - DNA, 1039 bp, Homo sapiens
ctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctct

SEQ ID NO: 85984 - DNA, 1103 bp, Homo sapiens
ttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttcttttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttata

SEQ ID NO: 85985 - DNA, 1084 bp, Homo sapiens
ttttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctga

SEQ ID NO: 85986 - DNA, 1033 bp, Homo sapiens
agctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcgtgccactgcactccagcctgggagacagagcaagactctatctcaaaaaaaaaaaaaaatatgtgtgtgtgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcata

SEQ ID NO: 85987 - DNA, 1050 bp, Homo sapiens
tgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaa

SEQ ID NO: 85988 - DNA, 1102 bp, Homo sapiens
ggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggaga

SEQ ID NO: 85989 - DNA, 1034 bp, Homo sapiens
tatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgca

SEQ ID NO: 85990 - DNA, 1058 bp, Homo sapiens
attactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaag

SEQ ID NO: 85991 - DNA, 1058 bp, Homo sapiens
agtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaa

SEQ ID NO: 85992 - DNA, 1072 bp, Homo sapiens
gcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaagatatgaggagttatttaatttcttcagatgtatcgagctctgttttcttccccccgagtcctcccaatcttttgaaacattaaggccattttccttaaggatgtttttggctctcctactccccgtgagaaagatctttccatttccagaacttctccacactaaaagtgaaatatttttgtgaaatgcttttttagggcctgccaaactcaggtgagtctgttctctgggataagctggcttctcttaaaatgaagccagtcagaaatgtcagggcatcccaagattgaccagtcagagggcagttctctccaacttttcagctttcccgctatagaatcttctgtgacactacacgtgtatacaatgtaaaccacctcccctggctcagctgccccgtgttactattttacttacttgattatgtgggttgcctcccccaatcagtggagaaagaacacagcccagacccagtggacaggacagagctatcctcagaagggtaacagtgtctgatattgaacaaaggactaaaaaagaccaggtgatagatacctgcaggtctgaggcaagtacttgtctgtttatgggcaggcctggaaagcaggggtacctcacctggagagcttgctaatacactggtccccatcctaatcccccaaggtaaaggcaaactctccaaggatgggctgttgggagaaagag

SEQ ID NO: 85993 - DNA, 1031 bp, Homo sapiens
gctgttgagagagtttcctgacccagggaaatttgcttctggtcaaagggaatgttaggtgtgtcctgaaggactccccaggttccctgggtccatgcatggggtccctggaatcgccctgggagtccctctgagactgtcctgctcaggctgcccatcagcccccagtccatatgctataggggcccccgtggggagggggcatggagacacgtggagagcccgacactcgggtgctaaaggcaatgggatagttgctaggggcccgtggtcacccctcagcaggcagtaatgtgaaccctaatcctacaagtgctgtaaggccctgggccctgttcatccaccctatggtggatgaaatggagagggcatccagccacctgcccctcctgtgtagccaccacgccagcaaatggtgtcagtagcctccaacccagagagtcatcctcagcgcctcctcatgcagctgccttgagtcctctgttccccactcacccctgcctcccccttccatcacagccactgccacccactgaccgggcgtcctcctgtcctcagccttcctctctccacacccccatcccgctcctgggacccgtccttaccaagggatgaaaaccaacatcagctcctacccactactctagcctcatctctcaccatggtgcatctcacacctaaaactggcgataccaaaccgctccccgtttcctgagaaagccatgttctctcttgcctctgagtgttatctttctcctaggatgtcctccctcccgcttccttgtcaggagctaacgtctactcacctttttaagacttacttgccgggagtggtggctcatgcctgtaatcccagcactttgggaggctgaggtgggaggattacttgagcccaggagtttgagaccagcctggacaatatagtgagactgcttctcttaaaaaaaaaatttttacttaggtaccgcctcctccaggaagcctccctgactccttctgccccagcccaaaggagaaggacctgcactgag

SEQ ID NO: 85994 - DNA, 1784 bp, Homo sapiens
tcccccactggcctgtaagctccgtgggtccagggctttgccagtgtcattcactgctgcacagtgcctggcatagagaggctgttggtgcagatttgttgcacaagcagatggatgaatctcagatgtggaatgttgactctttgtcagggagggatgggctcccacctaggagtctccgaggaccagctcaaaggctgtaaaaatcatgccctgcctcagtgctctgggggattagaaagggggtgcctggattctctgagactctgcagctgggctctctcgctttcctgtgcgtgtcaatcactgatcttaagaaaatgcagattctggttcacaggcctgggtctgcgttcctagcctgctcatcagcaatggtggtgctgctgacctcagatctctctagcagcgcttttgtaacttgcaggtcctgtgccatctttccccctacatgccatgggaccacgcggaaagagccagaggggtcccttcattgcctcctctgcccctcctccctccatccagcagcaagtgttatttgtagcagtcactgtcacctccgcatgtggtgaggcctgctaggtttctgtctccacatttctgttactgtgacagacaagacggattctctgccaggaactgtgctcagccacttgcttctggcattgctgtttcctctctgtgcacctcttattcaggcagactcctgggggatgttgcccctgctggaagtcaggcccagttcattgccctagtgtgggatggggcagctgaccccgcggggaactgggaggcattaccgagaggtttccaagctttggtttcaggagtacaggtataggcctacctgactggccctgggggcaaaatgttcatttaaacttggggagaggctgggcacggtggctcacgcctgtaattccaacactttgggaggccaaggtggatggattgcttgagcccaggagttggagaccagcctaagcaacatagagagaccccatatctacaaaaaaattaaaaagtagccaggcatggtggcgtgtgcctgtagtcccagctactcaggaggctgaggtgggaggatcacttgagcctaggaggttgaggctgcagtgagctattatattatcacacgactgcactccagcctgtaccatagagagagaccctacctcaaaaaaaaaaaaaaaaaaaaaaaaacaaacctggggagagtttgggacctttggagtccaagagttctgagtttgaatcctgatgctgtcacatactacttgggccacgccgaacaaggaacttagcctccctgagcctcactttcttcacttgctagatggaggttgtaactcgtgtcttcctcccagggtcgttgtcaaaatgaaacatgaaagtgcatggaagtaggaggtcaaggcaggtgaattacatgaggtcaggagttcgagaccagcctggccaacatggtgaaatgctgtctctgctaaaaatacaaaaattagctgggcgtggtggtgcatgcctgtagtcccaactactagggaggctgaggcaggagaatcacttgagctgagatcgcaccactgcactccagcctgggcacaagactcgtctcaaaaaaaaaaaaaaaaaaaaagaaagaaaagaaaagaaagtgcatggaaggctctccgcactgtggaaaatactggcatttctcaactcacaatgcatagattgtgagacatatcatggtccattgaatatcttttgactcaggggtggtgaccaggtgctgatagcaa

SEQ ID NO: 85995 - DNA, 1028 bp, Homo sapiens
ggggggacaggggacaagctcagagagatgggggaccacccaatgctgtgacaacccagaatcccaggaggaggaggagaggggactgacagtacaagtgagactagaaatccacaggcacgagctgccttccattgctctgcccttctcagagcctccgcgtcgaggggatttgggcattgaggcatttctggaggacaggcttctgtggccactgctgccacagacttccctgccctcagcttgagttgggtcagacgagcctgtccatgtgaacgtggaaacatttcctgccagactatgctgttgccaccacacgaatcaaaccagcaaagggcacgccggcgatgtgcatacagctgtgtctctgacagctgcctgggcctgcctgctgttcccacgggtcagctcctgtcgggtagggacaggtcctgctctcaaggctcataaagcagccagcagcctgcccgtgttttccgtactctggcctgtgtcacccaggctgtctcctcatctcttgtctgatcctcaagggttccctggcctccctcttcactccctctgcctgtggcaggcagcagcacagttctatggggtcctaaggaccccagggagtcactcccacatttgagcagcaactttgggtttagtctgtccaggttagggccccagatcatatatatgtgtgtacacacacgtgtgtttgcgtgtcatgcggcattcggatggggcatcctgttcatccacccccctgctatggggtggctgaaggttggggtgccctctgagtttttggtgggtggggcttcagcagggtgtcttggctacctctcctggccagcacatgttatcctgggaggatttgtagctttgggcctgaccacggttccaagcaccatgatctggagcccacactgggtggcaggctgcagagaaggtgcccccagaagcctggactgcacccttatctgttttcatttggagctattttctcattatctcatgccaagtgtctgactacacatggc

SEQ ID NO: 85996 - DNA, 1094 bp, Homo sapiens
atgattatctgcacgattgcatcagttattagcaaagaaggattttatagcagcaggtgtgtgctcatgtgcttgtgtggagttgttgactgcccttcactgcacacacacagtctgcggaactgtgactgaatccctgttccctactcacacttacatggtattttctgggattctaaggcacattctttttttcctttcctttttttccatttaacatcttaaattggaatgtgtcgcacatttgcggattattataatttgacagcgcctttttcttggcatacttgaaataacggtgcattgtaaaatcagaggtgtctcagatttaatgaaatagaaactaggtaacctctggggaacttatataatttgtccagttcctccaaggatgcaggtggagccaccttgtagtggtggcagattatatgaggggaccctgatgtggttcaaggggacaaccttggattgggcttagattccagctttatggctcgccagctgtgtggccttggcaaagtagagcgacctctctgagcctcgggattttcctcccaccacatatgaatcgtggctccacagttgtcatggctgtgtgcaaggcaacattccctgtttctcttgctgggtatcatctaaggtctgccccgttccatctgggttaagagggaaaatgagggctgggagtgggtcactggccttcccaagggagcagagggaaactggtgttccaagggcttcttgactcagtttataatccttggacattactcttcttccctcgtccttctccccctttgcctgagttttcattttcacatgtgtttccttttagcaattttctttcaaatctctcctctccctttctgtaaagtcttcccacatgtagcctctttgaagctccctggggtgggaaaggggaggagggctctgcctgatggcctggatggcacagacctcagaagcccagtgtgctgtggtccctgcaagcttcagctcaagtccaagttctggtaccatcagcgttgctaactgccattcctgtggctgcagggtcagcctgagtccactccagtgcacagtgttgtccatgg

SEQ ID NO: 85997 - DNA, 1050 bp, Homo sapiens
cgattctcctgcctccgcctcccgagtagctgggattacaggcacgtgccaccgtgtccagctaatttttgtattttttagtagagatggggtttcaccatgttgaccaggatggtctcaatctcctgacctcgtgatccgcccgtctcggcctcccaaagtgctgggattacaggcatgagccaccgcacctggccacatttccccatctataaggaggaaaatgataattacttgcagggagtttaccacctctgtaaagcacagagcagactggccacatggtaggcgccctagtatgtcaactttgttctctttctctgagttgtggctccactagctatttgtagacaggagatctttgtggcttcaggtaggtgatgggggactgaaagctaagaggaaaagcctcccctgacctgcagcttctctttgagctggcatgcctggaattcttggggctggctgctgggtttgttttccagatgtggaagcaatttaagttctgttttcttaatccccaacagtttgcctccgaagtccacattctcatttgaaaatcaaggccgttggctctgtttgcagggcagagggtaggctagatagcctcttcaaaccctttttgtttaggaaatgggcttactggggcactcagatctgggacccagggcattcttgggacagtcacaccccatccaggacttggttaaaaggtgagttcactttctctgtgggttttccttggagatgattcactgagctaaattcagctgcaccttggttacaaaccagctctagaccgctgtggagtggcgggggtggggctcgggtttgggccatgtcacaggccagctggcgtccctctgagcagggtgcccacgtgtcccgggggcagtagcggccctccttcccacactgaccacaacagagggaggaaaatgctccagatgtcaggtagccagaaatactgtctggcacggagaaactggtaatatcttgttcagttactgagcgctgctggtcacagaggcagcctgacccaggataaaa

SEQ ID NO: 85998 - DNA, 1790 bp, Homo sapiens
cgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacata

SEQ ID NO: 85999 - DNA, 1101 bp, Homo sapiens
tgctggctaggaagactgaggtctgctgcgccaaggggcctcaagttagaagggccatgccgttcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaac

SEQ ID NO: 86000 - DNA, 1101 bp, Homo sapiens
ccatgttgaaattcttaataattttgaacaaaaggccccataaaatacgtagctggttctgagctcaccatttgctgggagaggcctgtgctttctgagaaatagtctctctccttggccagggctatgctcctgggagggcccttaggcaggtccggaagcagccatagaaagtaagagggaaaggctgtgaacctgagggttgacttggtgaatggacctcacattgggaggtcagactgggcttctccaagtccctcttacaaagaggaaactaaccttggtgaacctggggctgtgtcaaggagatgggattatccctacatttacagagaagcatcagggctgaaagatttgcccaaaggccactggttataaatggcaggtcctagattcaagtccaggcctgattcctgctccaccgtgcagcctccagatcagtgctgcgcatgaagcagcagacctgggtttgagttcttgccctgctcccaatttgctgtgtgtcctttagtgagggacttgccctctctggcccacttaccctagcagtcctttgagagagctgatcaactacaaaagtccctttcaaacagaatcactatgtaaccaaatcatagaggagaggaagtctcttttatagatggattccagctaataaatgctgaatgattgaaatataatgtcattctgaagtccttaatgaattaattgcttgaagcttccatggctgctaacatcaggaacaaataattggacattatgtgcctcctaatagaagaatttgatgccagctaaggacatggtcttatgtgtgtgtgtgtgtgtgtgtatctatctatctatctatctatctatctatctatctatctatctataacttgaatctgatcaagcctctacttccaactgccaacttttaggaaaaacagaggatagaggaacatgttgaactacaccacaggggagcaatccacaaaacccagatggaggaaaataccacaagacaaacaactcgtttcctccagtaaataaattgcaagcaaaaacaaaacaaaaaccttgctgggtgtggcagctcacacctgtaatcccagcactttg

SEQ ID NO: 86001 - DNA, 1042 bp, Homo sapiens
tggggacacagccaaactgtatcagggtgccatccaacctactatggcctttgtggatggcaaagtaggacaaaattgggactgtgatgacaccattgagcccctatcaaccaatccagaagactgactgcttcagggcttcacgttatataactcaataaatcctccttagtgctttaagccacttcaacacaatctgccacgcccccatcaccagctgctgaatgtgccctactgatacaccgtgcccacctggagtcctgcatgcaggcagtggggtgtgatggagattggaattcttcttggttgggctctattgtggacactccgtgtgaccgtgggaaaaccacagctttgctgaccatcagtttgaatatataaatgggcccttgtccctgcaaaaggctcttcaaaatggaagccactgtggtttctgttgtatggcttctgcattccaagaaagatgtaataggactggaaaagggccagacaatggagtgatgaagggcttttaccatgagggcaagctctgcaattagagttctccagccaggaaagatggaggctgagcagggagtgtaactaaatccttttctatggtacagcatatccacaaggtgggccagactcacccaattccagaatccttatcatatatatatatatatagtagccaaatatagcagcacagccactatatatacacacacacacacacaccatatatatatatatacacgcacatatacacacaccatatatatacacacacatatatatagtgtatatatatatacacacatatacatgtatatatgtatatatatacacacatatatggtgtgcgtgtgtgtgtgtgtataatctatataaagagaggcacttctgaaagtttgagaagttgttttagggcaaacaatagaaagcgccatgttccatggtggagctgagctcaaggcactcgggcagtttggtgtagtgcacctggaatccgggagagcttggctccacttctggcttcagctgtgtgatggtgagcaaa

SEQ ID NO: 86002 - DNA, 1708 bp, Homo sapiens
agcaggtcctctttggtttgtcactaaggccatcttctctttgtcaatttagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatggtaggtgtggagtctctgggggtcctgaactaggccttctcagacacacctgtcagaccagccctgaaggcagtttggaacaggggtccacatctatgagcttaggctggtatctgttacaggtctccaatttctgtgacaccttctcttttatattgaaaaaatccaaattttgcatttgactccataatgtatcactgttttaaagtcaaaactgttactctctccaaaaatctctgctatgaattgagcagctgcagatagaagtgctgtgttatccagtttgcttcttcactgctaagaacccttgtctgagaagcatagcttctcagctgttccgaatgaacgcatttacaattcttcaggaaaggagaactgtgtgtgtttttaaacaaaataagtgcaaggatctgtcccctagacatacctttttggctgtccgtttttaccttccttccttccctccttccttcccttaatctgtcttttaaaactgcctgcagatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaaccagtatgcttcgtctgcttttttcccatttatttatttatggagacagtctcactgtgtcacgcaggctggagtgcagcagcgcgaacttggctcgttggaacctccacctcctgggtttaagcgatttttgtgcctcagcctcctgagtagctgggactataggtgctcgccaccacacccggctaattttttgtatttttagtagagatggggtttcaccacgttggccaggctgttctcaaattcctggcctcaagtaatccacccgccttggcctcccaaagtgctgggattacaggtgtgagccaccgtgcccagccttcactacttcatttaaagtccctgaatgacattttaaagattcaaacgcttggaggcttaaaactactctgtgaaagaaaaaaaattttagttttgcttctgtagatctagcactgttgaccaaggattggaatccaggagacactggtgattttgtagctgattgttttcc

SEQ ID NO: 86003 - DNA, 1060 bp, Homo sapiens
cagttatctaattgtatgttttttttttaaaagatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatag

SEQ ID NO: 86004 - DNA, 1019 bp, Homo sapiens
cgcaaacaagacatgtaaaatctgacctgttttggtccaaatggagagtgaggccttaagccatgtgatcttgccaccactcttggagcctcagagaacacagttggaaggtcagtgatcttgttcaagctgcacactttacaagtgagggaactggcccggagagagagacatgatttaccagtggtcatatggcacaggtagtctaggattgttaattttcgtcctagtgcttttcctccttgtactacctgttaagttacgtttgatataacactctttaggagaatcctgattattctgaagaaatccttaagggcgagttggcatggatcatctacaaaaattctgtaagcataattaaaggtaggtatcttttgaacattatttttggtaggaaagtgaaacattcttttcttaatgaagatctttagctagttttgaaattttccattagaatgtgtataaaactctgtaggaatagtgtcctgtttctttcagaaaatacttatttttcctaggctataattgaacatttcagtaacttatttattttttgagatggagtcttgatctgttgcccaggctggagtgcattggcgtgatctcggctcaccacaacctctgcttcctgggttcaagtgattctcctgcctcagcctcccaagtagctgggactataggtgtgtgccaccctgcccagctaatttttgtatttttagtagagacgtagtttcactatgttggctaggctggtctcgtactcctgaccttgtgacctgcccgccttggcctcccaaagtgttgggattacaggcgtgagccaccatgcctggcataagtctctttttaaaatttatattctactcccatttttttcccttaaattttaataggtttgggccgggtatggtggctcatgcctgtaatcccagcactttgggaggccaaggcaggtggatcacctgaggtcaggagtttgcgaccagcctggcccacatggtgaaaccccatttcta

SEQ ID NO: 86005 - DNA, 2088 bp, Homo sapiens
tttgtaagtacactgaagacttagagctagaaaataaatggttatgtaggggcaatacctcagaaacttgatttttttttttttcttttttttttttttttgagataaggtctcactgtgttgcccagactagagtacagtagggtgatctcggttcactgtaacctctgcctcccaggctcaaatgattctcccacctcagcctccccagtagctgggatcacaggcgcatgccaccgtgcctggctaatttttgtatttttggtagacatagggtttcgtcatgttttttaggctggtctcgaactcctgggctcaagtgatctgcccacctcagcctcccaaagtgctgggattacgggagtgtttgggattgggtatattatatgagaagtattttggattcttggtaatgacaaattttatattgctaccccagattgagattctttaagaactgcattaaaccaactggatagataacaaagtttttttggagcattgtgagtgggagttgggggaaaggttgaattatcatagttaagagatcggaggcctttgtgaggaagagccagataggatgagaggtgactggattttctgaaatctgcttctttttttttttttttttttttggtgggggatggagttttgctctgttgcccaggctagagtgcagtggtgtgatcttggctcactgcaacctctgcctcccagattgaagcaattttcctgcctcagcctccccagtacctgggacttcaggcacgcaccaccgcgcctggctaatttttgtatttttagtagacagggtttcaccatcttggccaggctggtctcaaactcctgacctcaggtgatccacctgcctcagcctccaaaagtgctgggattacaggcctgagccattgtgcctggcttttttttttttttttttttgaggtggagtcttgctctgtcacccaggttagagtgcagtggcacacaatctcggcagctcactgcaaccttcgcctcctaggttcaagtgattcttctgcctcagcctccctagtagctgggattacaggcacataccaccacacctggctaattttttttgtttgtttttttgagttggagcttccctatgttgcccaggctggagtgcagtggcccgatctcggcctcccggcttcaagcgattctcctgtctcaacttcctgagtagctgggattacaggggtctgccaccaagtccggctaatttttttgtatttttagtagagacggggtttcaccatatttgacaggctggttttgaactcctgacctcaagtgatcaatccgccttggcctcccaataatctttgtaattttaggttaggtggggtttcaccatgttggccaggctggtttcaatctcctgacctcaagtgatccgcccgcttcggcttcacaaagtggtgggattacaggtgtgagccaccgcatccaacctgaaatttgcttgtttttagcaaaattaattaatgcaaaggtgtattatatgtaaaggtcaaatttgggcagcttactacattgcttttcttgcaggacgatgttcaactttggctctcctatgtggctttttgtaagaagtgggtgagtaaagccatgcatgtcttgcttcctctgaccgtctttttgttaatctgccctttaagcttcatgccagatgttttttcctgaagtgtagggttaacatgaaaaaagaacccaagaaggcggaacatcaatataacattggatatctgaatgactatggtttccaattcaattgaaaagaatataatttttacgtgtgtttgttcaatacagttgactttttaaaaagatatttaaagtgtttagtggtttaattgaggtagaaaattttgagggtctgtgttcgtttatatatccctagcaatagcatgtcatgctccattggattttacagttggtaaagttagggtacatattacttagagagtaagatcaatgatttatctgtgcaggaagtagaaatattttccttttttacaggctactaaaactcgacttagcaaggtattctctgccatgttg

SEQ ID NO: 86006 - DNA, 1166 bp, Homo sapiens
ggattacaggcatgagccaccgcgaccggctttcaaaaatgtttaattgtacaatatcctcctcctttgcttttttttttgttgttgttcttggtgttgggaagtcaggacgtgggatgggagacaatattctgaagaaaatgcatctcgtgtccctttcaggcttgagcagcccacctctctacacctggaggcgcttttcctgatggctgtccaagtctagcggcgcgcgcacttaacccctccctcccgtctagccccgcccctcaactcctgtccgctagagtcgtcctgcccaagaccagggcgggttctcgctgcaatcccacaatcggccacagggaggggacggtggctgtagaagccgaagggccttcccctaagtaggaggtggcggaagcggaaaaggcgggacctagggagcacgttacgtccggacgcgtcggtggtagggctgggtctccgaacctgaaaccgggagcttcctgctcgtgttcgctgttgagaagctacccgcggggttgtagacctcggacctcatggcagagataattcaggaacgcatagaagatcggctcccggaattggaacagctggagcgcattggactgttcagtcatgcggagattaagtgagagagggttggggagagggaagagctgaggcggcctgaggggaggttgggagtgtgtggcaggggctagatgtggggacgctcgacctgtgtttacttttcctaacgtggtggaagcccatttctcgttttcggtgatgtccagaattaatttttcattcgttgcaaggtaatccgtccgtctacttacccatcagacgttttgacagcccttcatggagccgggtcttagggctgtaaaggtgataaacccaggattcctgctcattaggagctaattgggcagagtgtggtgggggagacagacaaattaaatattttgataacagtgtactgtaagttgattgtagtaccttgtactgctgtagggatgggaacagagtgctgtgagagcccagggggagtggataaattcctaactagacttgaaggtggggaccattgaaatcagtttcatatgctactccagagcctaactacagcgcctggcacatggtagacattcagtagcgtgttaaaattatgtttaata

SEQ ID NO: 86007 - DNA, 1022 bp, Homo sapiens
caacaagagcgaaactcggtctcaaaaaataataaaaataaagaaaatacttttcccagttggtttgtgtaatatactatgattacatttccttttttgttgttgtggagacggagactcgctttgttccccaggctggagtgcagtggctggatctcggctcaccacctcccggattcaaacgattctcctgcctcagcctcccaagtagctgggattacaggggcccagcagcatactcggctaatttttgtatttttagtagagatgggttttcaccatgttggccaggctggtctcaaactcctgacctcaagtgatctgcccgcctcggcctcccaaagtgctgggattacaggtgtgagccatcgcccccagccatatttcctttcttatcagactttttttttttttttttttccttgtggttagtgattgtctcaatggttggtttgttaaggcttctatgtacccatcattaatttccaccccccaccccacaaatgctttgccagaattgcaaggctccattcattcaaactcatcaaataatacacctattttgttttttcttggaaatatccctcccatgccaatcttaactgttgctcactagacgaactgcacagctgttctgggaattcccttcttcaccatcctgggaattttctttacttctttgtgtgagtcccctttgtcctggattccatgtttgtttttctccctcactttggtagaatatgtcctccagtagctttctgacaaagggtgtggtgaaggggaaaattttttgagatgttgcgtgtctgaaaatatctttttttttttttaagggacgaagtattgctatgtagcccaggctggaatgcagtggctattcacaggcaccagcatagccactgcagcctcaaactcctggcctcaagccgtcctcctgtctcagcctcctgggtgaaagatatctttatttgatctcacttgattaatgtgataatttgtctggttacataattctaggttgg

SEQ ID NO: 86008 - DNA, 2397 bp, Homo sapiens
gatcctaaagaagagaagagtgtatgtaagtacttctcaaccagtttacctctctgaccactcttacggtgtttgggggcaacaaactaaggatctagactcgctaaaccgctcgctgggtccttctctccccacaatgcaccggggccagcaggaaggccgctccgacccctaattttcccgcgaattcagttcaaagaggcggccgggcccgcgatcggcagcgcgcacgggccaaccaagccgcgcctccgcgagaagcgcctccgcgtgactgacgggggaatccgcgggccaacgggctgggcggcccggcggtgcgcgctcccgccggccaatcagagcgccgggcgggggaagtgggcggagcgaggccagggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagagtgagtgtgtgcgaggctttgagggcaggaagacccactctgccaacaccggggatgggacactctgctgggcccccttcctcctcgggagtccacttgtgtggtagtggagggaggaattgaggggatgtccccctttcggagattacgtctccaggggatccggagtccagggccttgggagagctggaaaagagggtccgggcgggttcttgactcccccaagattgacgcaagaggctcgggactggggccccacgttcagagcaggcggcttttagatgaggaggtagcagttgaactgagccgcagtcacatcccgagactggttcttgttttctttcatgcctttcggactctagaaatacaggggtttcggttgtagcttttgaggggcaaaatgaagcctgtgaagggatgagtgcagtggaaccgaagaaagtgtccttagtctgaaatgccttcgcgctaacttggtgctgcaggttcctatggcacctttggatgcttaaaacccttcaaatctatccacccattttgtggatatgtaaactgagccagagagtggtcaagcatcttctctggagacgaccccggaattctgctttttctacctggcttacagaacattttcttgcgtcaatttctgtttctaagttctgtctggaaggtgaaactgacttatttggaaaggagagcaaggtgtctggaaacaaacaatagaatttattaaaaacatcgtgactatgaataatcctgattgttctttaaggaatgttatatcctgattggttcccttttttgcttttgtgtgttataatttgggtgatctttaatagctaaataatcttacagaaacttgaataaacttggctctaccgcccagtgtccttatttacagtttcactgtggcatatgttaagggcatggtatcagctgtgcttagaaagacgtattacgttgtttaatacccttccttcattctctctcattagtgcttcatgaaattctaattggaacttaatagaaggaatttcagtttttatggaaacgaatattgaacctgcttcagagagattcacattattcacgtatttcttagtatactttgaaatatctagagaggctttaattggaaataggatgtagaactgaagggcagtggtgacaataatgatacttgtttgtaccccttctaaagtatctcatctccctttagttaatttaaaataaaaccaattgaagatttaggtggaaattttaaaagttctttctgaatgttaagacacatcctccaagaaagttttaactatttgcgttctgatgagtcgacctcagggaagtcaagtgtcattaagagctagatctggtcataaaacaactcgaagttgtttactggaaagtttaaatacttgaatgtaattattcacatagttatttctatttggtttattctgatactgctgtataatgacctaacgtgacactaataggtcattaatgtaactgatataatag

SEQ ID NO: 86009 - DNA, 1505 bp, Homo sapiens
ctgtattaggatgtattaggattctgttttggctgactacaattttttttttttttttgagacgaagtttcgctctttattgcccaggctggagtacaatgacgcgatctcggctcacggcagcctccgcctcccaggttcaagtgattctcctgcctcagcctcccaagtagctgggattacaggcatgcgccgcccctatgcctggctgtttttgtatatttggtggagacagggtttctccatgttggtcaggctggtctcgaactcccgaccttaggtgatctgcccaccttggcctcccaaagtgctgggaatacaggcatgagccactgcgcctggccggctgactacagattttttaagtgaccatttaaaaagtgaaattttcatcttgtttggcatcaatcaatagttcttttgttgactccagctgcctattacagctgctttttggaagaaaatcggtaataaatagtttaaattagctaagttaaatgagtacaactacttctcttgagttctgctcggtaacaataactatcttagaaaggcttaagaaaaatattgtagagaaccttcagtataaaaagcatagatgaactttgtgaatgtatgccattgattgaataccttttgatcttactgtgcatactttcttgatgtaaatatttagtgcgatataaatagtgcgtgatttccatagcagatgataagtttatattgattataacatggtctcggttgatatttttctgacaagtaagtttagatcatgtttggattttgtttcctattacctagagccaacacagatctatagatttcttcgaactcggaatctcatagcagtaagtagtcaacaaaattcatcaatattatttctctcttataactgcatctgtattcaattttaacatttttaaaactctttttgtagccaatatttttgcacagaactcttacttacatgtctcatcgaaactccagaacaaacatcaaaaggtacattttatgaatcttatttcaagctgatcaaaccatgttagttttattttaaagtactatttctcaaaattaaaaaaaaaaacgaacaaaaataagtactatttctaactaaagatttaagatgaaaactgaagtgagagagtgactggttgaattggttgcacagtggttttctatagtataatctttgtaagtctcaggttgttattagctttttttttttatcctctaatagaaatgaggctgggtgtggtggctcatacctataatcccagcactttgggaggccaagttgggcggatcacttgaggtcaggagttcgagaccagtttggccaacatgggaaaaccctgtatctactaaaacaaaaattagctgggcgtggtggtgtgtgcctgtaatcccagttacttgcgaggctgaggcaggagaattgcttgagcccgggaggtggaggttgcagtgagccgagattgcgccgttgcactccagcctgg

SEQ ID NO: 86010 - DNA, 1750 bp, Homo sapiens
attgtactccagcctgggcaacaagagtgacactcccatctcaaaaacaaaacaaacaaaaacaaacaaacacaaaactctctttgaggaatgagattattcgtaatttttggtgtctgcattcaagcattataaagtaataaattgatgtggagtacatttggcttttcaagtcctaaagaggaagggactatatgagtataaagagaaacattttttctaattaaattatatatgggtatagatttttagactcttatctctagaacatgtcatagaccaccttaagaactaagatgaggcttgtttttacaatccattcattctttaattgctttgagaagttatacttaagtttctattttttgggaaatagcttttttctcttaaacttgtcaagttaaaaggtagtagttttattacgatttgatggatcattccctaacttcaaaattttttcatgatgtcaacaactgtctctttaatatgacatatcattgagctttaggctttgctgataatctttgaggataccttgtgaacttcaaatatattttatagaatatttctttttttatgtgatggtgctagtacatatttgttgtgttgcttagtagacgtgttaagtgtttcagaatacacataatttatatttgtttggcttaattcaacagatacttgaatacctaccaagtataaggcactatgccagcactgcatagctttccttgaagaagagcaattactgcccttcaggaatatataatctagtaggagaaataaaatatttacatgagttttacgtgtaggaaactgaatgaaaagtaagtgtcaaaataaatataaaccaagtaccatgggtaaggagaaatcactggtttgggaataattgggtaaaaggtttaatgaaaacaagttagcgttttagatggggcttgaaggctcgtgtgctgtattatacaccgtctccatagtattcattgttatggctaatcatccataatttatcttactaaaaataatcaaaatctggtttccatcttgcctattagagtgacaataaagtataatttgtttctttttcccagttgagaagtgattattttgtttatctgtttcttccaggaaaacatttaaagttgatgatatgttatcaaaagtagagaaaatgaaaggagagcaagaatctcataggtaagataatctatcagtttacattaagtgatatactttaggaaagaggaaaaattacagtgatcattttcctagtgatcaccttgatataaggagttagaaggaatcttagaggtcagtttggtccaaactcacacacaagtcagaaattaatttctgtagcattcctggcagagaatacttaagctgtggcttgaatacctccagtgtagttgtatttattattgtttatctttattaccagtttcttccattttgagtgaaacctctgacttctgccgttggtcttaactctaccacctcatttaaagagggatactcacatttatagtatatgtgctaggtactgtggcagggacttcacaatatcacgtatcttgtaagttattctcaaatatgagaggggttctcttttttttccatctttttcttctcatttaaatctatcaggcaacatattcataacttttatttcatatttgaaatatgtttctcacatagtttcagaaacttgaacatttggacagaatctacttgttgtacattatcaaatata

SEQ ID NO: 86011 - DNA, 1008 bp, Homo sapiens
tatttttagtagagacagggtttcaccatgttggccaggctggtgtcaaactcctgacctcaagtgatccttccaccttggcctctcaaagtgttgcaattacaggctgagccactgcgcccagccttctttttctaagagacagggtcttgctctgttgcccaggctggagcacaagtggctgctcactgcagcctctaactcctggcctcaaaccatcctcccatcttagcctcctgaatagctaggactacaggtgcatgccaccatgcctggctaatttttaaatttttgtagaggcaggatcttgctatgttgcccaggctggtctcaaactcctggcctcaagtgatcctttcagattggcttcccaaagttccgggattacaggtgtgagccaccacgcctggcctttattttctttacagaaggtctgatataatgccttacatcctttccagctcttgtttctggtactccagttttgaatttttcatggattttgaccaggcactatggctgattagaataaatctcttgcctttgtgtagtggtatatgctagcaggattctagggattcttatgctgtcctaccaattttggaattatcttttttttgttgctgtttttttgagatggaatgtggctttgtcgctcaggctggagtgcagtagcgcgatctcggcttactgcaacctcctcttcctgggttcaggcagttctcatgcctcagcctcctgagtagctgggattacaggcatctgccaccacgcccagctactttttgcatttttagtagagacagggttttaccatgttggtcaggctggtcttgaactcctgacctcaagtgatccgccttccgtggccttccaaagtgctgggattacaggcgtgtggcaccgtgcctgtccccaatgttggaattctctggtaacaactcttgagtgctgagtgcatctccatggactaaaatgcatcatgaaaagatttttaaatctgagttg

SEQ ID NO: 86012 - DNA, 1077 bp, Homo sapiens
gacggggtttcaccatattggtcaggctggtttcgaactcctgacctcgtgttctgcccacctcggcctcccaaagcgctgggattgcaggcgtgagcctctgcgcccagccaactttgtttttgatgcaacctaagcttttgaattagtaaccttccttttctaaacctccccctttttaagcatttatttttacaataagaaggcctgcatctatattcttgggggcgcgtttcatttatgtagtgtgcaatgtcctaggcactatactaagccctcgggtatataagggtgaacaaaatggatgaaggccctgcctttatggagcttagtgttaggggagaaagacataatcatttaataaatatgaaataagtgctgggaaagaaaagcataagaaaactgtgagtgtataaaacaggagaaccagctttcatttgaggtgttagatttgggaataatgacgatcagggaaggcatctctgaagaaataagctgagatttgaaagaagtgtacagaagtaaaatggggtgggaggatgaacaaataggtggttctagttaaagggaatattacatataaagcatttgatgccagagtagctgtgtagaaagagcaagtctccttgagagtggtatgagaagaagctggagcagatggccagggccagacagtgcattgtcttcaaggtaatttaaggatgttggtcttaagaaagtcgtttgttcgttctttttgttgttgttgttctctaagaggtggggtcttgttctgtcacccacacgggagtgcagtgataggttcatagcttactgcatcctcgaacttccaggctctgttgtcttactttattttttattttactttttagagatgaggatttgccctgtcgctgaggtggcagtacagtggtgtgatcatggctcaactacagccatgaactcctgggctcaagtaaccctcctgccttagcctcctgagtagctgggactacaggcacatgctaccatgtcccacttattttattttattaaaaaaaggtttttttaggagacagggtctcacttcatcagcca

SEQ ID NO: 86013 - DNA, 1011 bp, Homo sapiens
ctggattacaggtgtgagccactgcacctggccctggctcaccttttgtcctttttttttttttttttttttttttgagacagagtcttgctctgtcgcccaggctggagttcagtggcgcaatctccgctcactgcaagttctgcctcccgggttcatgccattctcctgcctcagcctcccgagtagctgggactacaggcgcctgccatcacgcccggctaatttttttgtatttttagtagagatggggtttcaccgtgttagccaggatgtctcaatctcctgacctcatgatccgcccacctcagcctcccaaagtgccgggattgcaggcgtgagccaccgcgcccagccccttttgtactttttgtagagatgaggtttcaccgttttgcccagtgtgacctcgaactactgagttcaagtgatctgcccactttgtcctcctaaagtgttaggattacaggcgtgagccactgcatccgacctattaaattatttttaagagaactattgtattaatgatttttccctacttttctattttgtacatttagctgcagtttaaaatctttaggctggcccaggcatggtgactcacgcctgtatcccagcactttgggaggtcaaggcaggtggttcacttgaggtgaagagttcaagagcagcttgaccaacatggtaaaaaccccatctctactaaaaatccaaaaaattaggccaggtgcggtggctcacgcctgtaatcccagcactttgggaggtcaaggcaggcggatcatgaggtcaagagattgagactatcctggccaacatggtgaaaccccatctctagtaaaaatacaaaaattagctgggcgtggtggcatgtgcctgtatttctagctactcgggaggctgaggcaggagaattgcttaaacctgggaggcagaggttgcagtgagccgagattacaccgctgcactccatcctggctacagagtgaaactctgtctcaaaaataaata

SEQ ID NO: 86014 - DNA, 1063 bp, Homo sapiens
tcagaatattggacttgatgtagacacgagtttctcagctttacatatcataggatgaaatgtatataacaaaagttgaatagctaacatctaactatagaaaccaagtagattatcagacttgtcctgttttgaggtaatactgccatgcccttaaaatgaagccttattcctgctgctagcagattcatgtatataaattagaggcactaatcttggtctcctcttgtcataaaaattacttcctctgtgggatctggctgttcttaaaatgggaggctcttccttgaattagatttcaaagtgttagtctcttatgaattagcttagcatcattttctgtagactgtatcagaactgtcagatgtttgtgcttggaatgctgaaatttgcatctcaaaatttcaaattctttacctgatttcttgttatcatgtgtcttacttcctgagaagatgcagggagcacatgacatagatgaactaagtttcttatatcttattctggtcatgtaaactagatttttttgtggcctaaaaccaaatagtcctgaccaaccttacgtgtttcttttcctcccgttcatctggtccagcctaaccaattaagatgtggacaaagtagctgcaagagagggcagagggaagggagagaaaactttgcccttttccttggaacaaaccacctatggaagggatcattggtacactttattctagtacatatcagagtgtttactttttttttttgagacggggtctcgctctgttgcccaggttggagtgcagtgatgcaatctcggctcactgcaacctccgcctcccaggtttaagcgattctcctgcctcagcctcctgagtagctgggattacaggtgcctgccaccacggccagctaatttatgtgtttttagtagagatgaggtttcaccacgttggtcaggctggtctcgaactcctgaccttgtgatctgcccgcctcggcctcccaaagtgctgggattacaggcgtgagccactgcgcccagccagagtgtttacttttaggtgaggaaggggaaatc

SEQ ID NO: 86015 - DNA, 1719 bp, Homo sapiens
aaagaggagtcctggtcaaatttacagggcaacctcttcataatatgtccttatttccagtcattacttgttccttagtactctcttgccacaatgtctttctgtaactgttcccatctgactataaaaatgcctagattgtcaccatcatttaaaaaaaaaatatatatatatgccctttactagtccttagtgcccagcaactatttcattagtaaatgccttatgtaagggatcagtactgctttcctttccccaccatctgttctgtatagccctccataatctggtgtctgtacatgtcacactatggaaactatgctcaggagagttatgaatgtctcctgatcaacaactgtattgtgttttgcagtttaaaggtacttcaaaagcttattgatgcttctgtttattttatcccatgcttattgtttttttctattgttaatagatgtttgtgaaaatagaaggagcactagttctagttcatgcttgcttttgcttttccatagcttctaaaactaacagtgaaaatgatatattgaaacagtaaattatagatctataccagatttgtaattgtgtatttcattgctatttgaagtataaagtaatggttctgtatcatttattgggaaggttgaatttccatagcttcaaaatattcaaatttttttgcatggatttagctacgcttttcaaaatttccttttgatgaagtcattgactaaagcgtcattaaaacaaaacaaaaaaagaattccaaaaaccctccaaaattcctttttaaagataggaaggcatacctgctgtcattttataggtagaacactaaaacacagtaaattacctggcctccaacttggtagtctgatttttttctgccttggtctggtgtttttgtggttttgttcttactttttgtgagttgtgaggggttttttgttgtttattttttgttaggtgtatagacacacttttggatgtcatatttaacagggaaagcatagagtcatgggcctgaataacagttgagtacaaatatttataaattggttgaagtaactttgatttcaatgttatattttaaagtctaggttattttactacagagcattacaatgataaaatatttccttttttttttttttagcttgtcagctcatttgcagcttacgtttactggtttcttccacaaaaatggtatgtatttaaaagtaaataaagtggcattttaatagcaagatacctttgtgaatgtaaaaaaagtggggcttctgagtgtaaatttataaaattaagtttaatggaaaatatgttggttctgatgtttttgaactttaaggtatgaaggctaatgatgaaatttgtttttggtggatgggggtgcagagtgaaggctggagtgcaatgttatgatcttggctgactgcagcctccacctcccgggttcaagcgattctcctgcctcagcctcctgagtagctgggattacaggcacgtgccccatgcctggctaattttttgtatttttagtagagacagggtctcaccatgctggccaggctggtcttgaactcctgacctcgtgatccacccgccttggcctcccaagggggcgtgagccaccacgcctggctaatgatgaagattttaacaaattgtcttagaacttcaataggtaaagaatctcctcagtagaaccttttatgcataaac

SEQ ID NO: 86016 - DNA, 1306 bp, Homo sapiens
ttgtgagtggtttatttacactatatataaaggcttttaaagagtttgctgtaagtttggaactgatttgaggaaaaaagaatgagtgaacttttgagaagtcttactgtgggaaatctctgtttgaagttccctgacttgttagcaaaatgaataccttgttcatatattttttaaatatattttaaaatactgattttctatttagataagccatcaccaaactcagaaaatgaacaaaattctgttaccctggaagtcctgcttgtgaaagtttgccacaaaaaaagaaaggtaatgtcaacaaaatgatattggtagattaaatggaataatttgcttaattggacatctttatgcatatatattgtattttaaagcttagttttaaattttgaaagcttaagaaatgtgttgatggcctaattataaaactgataacctcttttgccaactcgcatatctgtgtagtttttctagtcttttaataagtgtctgtacaaaactttctcataggagtctggaaatggagaagctatgttttagcatctggcataaattcagttgctgttctaccatttcaatctgttagcgtatttcttagctgtttgtacccattgacattttaggtaagggctaagagagagttttttccacaagattatcctttgtaacactgctctcaggcaaagaaattttgttgtcagcgttattagccattcacttattagtacattgcttcaaatttttataaggtgaagttatttcaccatagaaacaagtgttaagatgtttcctggtcaaccgatcaaagccaacatatgtacctttagttgcctcaagtcctcgagtgtttcaagaggagtaggagctggtctgggtccagggtcccagtgctgatattcttccaagaccataggccataagggcctcaatcactgggagggagtagactaaggcaccatggaggcagcagtggaactttatttttgaaagtttatgtaaaggccggttgccgtagctcacacctataatcccagcactttgggaggcagaagtgggcagattgcttgaacccaggagttaagcatcctgggcaacatggtgaaaccctgtctctaccaaaaatacaaaaatgagctaggcatgatggcctgtgcctgtagtcccagctactcgggaggattgcttgagcccagtaagtcgaggctgcagtgagccatgattgcaccactgagctccagcctgtgcgacagagtgaaactgtctcaagaaaaaaaaaaaatgtatgtaaagttaggaaata

SEQ ID NO: 86017 - DNA, 2456 bp, Homo sapiens
aaatgtatcggggtaatcattttcctggaagaatatacacagccaactgctagtattagtcatctccggagcgtaagacctgggggggtgggtgagaattcatagttttcactttatagtcttataaaatagaaatttttttagactgtatgtattctatttatttaaaagaagtagctgctgtaagatactgtcataaaagtcttctgatccttccagtttttctagtatgcattttcagtgtaactaatcatacaataacagaatattactcagaatatgatcattggtagataaaaccagttttgtttttgtttttttaaggatgatgattctttctgttaaacaacatattttaactatatggatttactgtttcataatgtagttgttgaccatgggattattagtcatttttttttatttctaatggtcctattagtcactgtcatgttaaaatagaacatttaagagatttgataaaagtacatgagtttaacattttagcatggtttttttgttgttgctaaaaagccttaccagagagatttagcatgcttttagttctaaatttctaatatacaactgtttcagatcactgttagctaaatattaggtatactgtatcataatttcattatgttggagaaaacctcaattgctttaatatttggaatataggtatttcaaatgtttatttttgcttcacagtttgcagaactatggttagaattttaacattccatttggtgatcatggcctatctcccgtgtttcctatagctgtgattagaagttttattataattcttattgcttatatacaaataaatataaattaataatgtttacctttgcaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattggtaatttttttttttactagattttatcactggagactaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacctatctacttacctcttagattcaacaatgaacattttattatacttgttgtgtatttatccccctgcccatccctcttttcttccaacaattgtgaattcatctttgaggtattcattcaacaaacacataggtgctggggatgatttaatttaatcgaagatgattaaaacattcagtcctatcctccaaagtctcacaacctagtgtagggaaatagacatgaaatatatcattgcagcaaaatgatgagtgccataatacaggtatatgtgaagttcagcagagaaacacgttggaaaaaataatctttgactcgaagtattgtttgaagtttttgggagttaccacgagtgagaaggagtttgcctagcaaagataattctaaacagaaacattagcatttgcaaagatgtggggttaatgttgtgattgttaaaaagaacatatagtaaaaatgcaaaattggaaacatgtggtctgtatattattgcaactttagtgtaattcgtacctcatttgggataaatgtagcatgttttatgttaagggaccatatatcataacacatttttgttctaatatttgatttatgagaaatgtttgttaaatttagatgtcaatgaagagcttccagccagaagaaaacgaaatcgtgaggatggggaaaagacatttgttgcacaaatgacagtatttgataaaaacaggtaatgttgatgaacaagtgaggctcccacaatgttctggaaatgttttcattctgaagcagaatataattatttatattgattatttcattgcctttgtttctttttattcttacggatgaaaaaacaaatttgcaaacactgaatttttgtctgttttatagaaaacaataattaaggaactattcggatagatagctcagttaaacttacttatttggcgaatattttctgagtgtctactctttgccagacactgttctagacattaagaaggcaacaaaatccctgccttcaccatggagcttaacttttagtggaggaaacagaccaccacccaaaaaatcaactaatgtcacttagtgatgagtgttgtgaagaaaaatagagaataaatggttactgttttagagagatatcctctgggaggaggtagtatttgagaagagacttaaatggactgg

SEQ ID NO: 86018 - DNA, 1065 bp, Homo sapiens
ttgtattttcagtagagacgggtttcaccgtgttagccagaatggtgtcggtctcctcatctcgtgatccgcctgccttggcctcccaaagtgctgggattacaggcgtgagccaccatgcctaggcgagaccccatcttttttaaaaaaagaaagaaggccgggcgcagtggctcacgcctgtaatcccagctctttgggaggctgcagtgggtggatcacgaggtcaggagttcgagaccagcctggccaagatggcgaaaccctgtctctactaaaaatacaaaaattagccaggcacggtggcgtgtgcctgtaatcccagctactcaggaggccgaggcaggggaatcgcttgaacctgggaggcagaggttgcagtgagccgagatcacaccactgcactccatcctgggtgacagagcaagactcttgtcttaaaaagaaaagaaaagaaaatcatgtataatgattgtgtacctctgtgcatttggtacaggatggcaagaaacacagacttattaaatatttctgcaatttctgtttggaaacgaaatattttagtgaaaatatcaccagtgaaagaatgtctgggaagcaaatccagcattttttctttttgggattggagaaagaaacctatgccgtcatttcttgtaccaggctgcgtgctggtagttaacagtttattgtcaggtataggacaaagaaccagggaaagtaactaggccattcctcctattgtttattttttatttatttatttgtttatttttgagacggactctcgctgtgtcacccaggctggagttcagtggcatgatctcagctcactgcaacctctgcctcctgggttcaagcgattcacctgcctcagcctcctgaatagctgggattacaggcacctgctaccatgcccagctaatttttgtatttttagtagagatgaggtttcaccatgttggccaggctggtctggagctcctgacctcacatcatccacctgcctcagcctcccaaagtgctgggattacaggtgagccaccgtgcccggccagtgtcttt

SEQ ID NO: 86019 - DNA, 1059 bp, Homo sapiens
caaaaaaaaaaaaagacatttgaactggttagcaacaacctaaatgggaaattttcccatgataactttgatttctgacctatttggaaaaatctgaaaatctgtctgtgttggacgagtgttttcacatggcaacaattcacctgttgctgatcagtggtcgcctcttttagacagcctgtgctctccagttcaagttctacagtgtctggtccatacttttactttgtttgcctagccgtctcagtcagcatttggattttcaagacaaatctattaaggcaaatccacattgacttataatgaattttttttaatttctacaatttatttgaattcattatctgagtctccagtctttgcatgttttttattttttagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattggtaagaaaacattgcaatcaaaataataaaataatggtttgcagagttaggtcttgtgctttagattaattcatttgtgttttgctttatgtgattcttctttttttttttttgagatggagtcttgctctgttgcccaggcaggagtgcagtagcgtgatttcggctcactgcaacctctgccttgtgggttcagatgattctcctgactcagcctcccgagtagctgtgactacaggcgcatgccaccacacctggctaattttttgtagttttagtagagacagggttggccgagcgcagtggctcaacacctgtaatctcagcatttgggagaccgaggcgggcggatcacaaggtcaggagatggagatcatcctggctaacacggtgaaacaccgtccctactaaaaatacaaaaaaatttagccaggtgtggtggcgggcacctgtagtcccagctacttgggaggctgaggcatgagaatggcgtgaaccca

SEQ ID NO: 86020 - DNA, 3521 bp, Homo sapiens
ttgtcatccaggcggaagtgcagtggtgtggtcttggctcactgcaacctccgcctcccgggttcaagcaattctgcttccgcctcctgagtagctgggattgcaggtgcccgccaccacgccctgctaattttttatatttttaattagagatggggttttgccacgttgggcaggctggtctctaactcctgacatcgtaatcctcctgccttggcctcccaatgtgctgggattacaggcgtgagccaccgcgcccggccagaggtgctttttaaggaaaaaaataagtcctgccaatagaccttaacatcagattagggatgctgaattatgggtatttttcctgcgatcatcagttgagggagataacagaaatatatttaaataccacaagtagaattctgtgaaacctttaatatttaatagtttttgtgaggtatgttattttgcttttcaaaagcaatgtttttattgaatataaaagtgtatgttttcagctgttaaagaatcattgactacagatctacaaacaagaaaagaaaaggatactccaaatgaaaaccgacaaaaattaagaatattttatcaggtaaacatagctgacccttcttaaagtaattatgaaatgtatttgttttttgtatgtcaaacatgaaaattttttgttcatttttattttatttatttatttatttgagacaggatctcacttttttgcccaggctggagtgcagtggtgcagtcttggctcactgcaacctctgcctcctgggttcaacctgattctcacgcctcagcctcacgagtaactaattacaagcacatgccaccactcctggctaatttttgtagtttttgtggagacgaggttttaccatgttgcccaggcttgtcttgagctccaagcgatacatttgacagtgtctgccttggcctcccaaaatgctgggattaacaggcgtgagtgacctcgcgtcactgggcatatttaattaaagagaatatctctaatttgattttccgcttaaattttttaaactatttttagaagtgatatttaaacaaaatatcttgttatgcgtaaattggagatttgctttttttttttaattgtttttagtttctctataacaacaatacaaggcaacaaactgaagcaagagatgacctgcattgcccttggtgtactctgaactgccgcaaactttatagtttactcaagcatcttaaactctgccatagcagatttatcttcaactatgttgtgagtaatttttcatattttctcaatttgtgttaagaaatctcttgtaccccataaatatatacatctatgtacccacaaaaattttttaaattaaaaaagggaaaaaatatgcattaagtacaagatagcatgactttcaaaaattgtactttgtataaaaaacaaatttctgtatttgatagattgccgtatatatggattacagtgaatgattcagagttgacatatatttggaattataattaatgtttgtgtagtgtctctaattgactcacaaaatcctcaaccaactctttgaattaaatgataattttcttattcttgctcaaccaagaaataatttgtacaaagtcaccaagcaataaatgacatagttaagattttaacacattttgttgaccccaggtcttctgactgcctgtttaccatgctggtgtgcctggcctattttagttttctaaatattaagagcccacaaattctttaattaaattggagggatatttaggataggatacttaatatatttttttttttacatttttgttgcagtatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggtaggtaaaaagggcatataagaaaagtttaagctctgatttttactgatgttggaggaacaaaggagccagatgaagctactagttcgttaggtggaaattattatttttcagtattaggtgtctatggggttgttaactactttataacacttgatagctcctatttctacagagaagttttctcacttttcctttgaactttatacttaagttttaatgatgttaatgtcactactgctgcagtggtttgggattaaagaattctgtcagaagtttctggataattggttgaacctgggaggtcgaggttgcagtgagccgaggttgtgccattgcactccggcctgggcaacaagagcaaaacttcgtctcaaataataataatagtaataaaaaaattacaaagagggaatttttaatcttagtaaaactgaaaaaatttttaaggcaggtgtatgcatatgtaaccagtgttaacggcttttctgctttgtgaatatacatgagttagaatacacagttttgacatgtaggattttatatgcatattcctatctgaatgtgccctaactagcacttcatttctttttcctcctttttaactgtaacttttcacacccagaaagacagtttgtgtttgaattaatatgtaataggtttgatttacattatgtaccaaaagaaaataactagtgggggtgtgcctctaatactattgttttatggttagttttataaaagggtgatgttgcagattatcacagatctcaactcctagtcgtgaggttagatggtatacatgtagaggccataaatcaacatttatttcttttcattaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacagtaattattattatctttattggcaattatcttggaatattattttgttttgaaaattgcttactatgaactagacttttattgtaaaggaactttttttaaaaaaaaaaaaaggaatccggaaatgtacaggttttaaaattatgtcactttaaaagttaaccaagttaggctggtggcggtcgctcacacctgtaatcctagcactttgcgaggcaggcgcattgcctgagttcaggagttcaagaccagtctggacagcatggtgaaacccggtctctactaaaaatacaaaaaattagccaggcatggtggcatgcacttgtagtcccagctattcagttggctgaggcaggagagtcgcttaaccccaggagatggaggttgcagtgagccaagattgcaccactgcactccagcctgggtgacagagggagaccctgtatcaaaacaaacaaaaaagttaccaagttaaagggaatatggattttcttcaagta

SEQ ID NO: 86021 - DNA, 1076 bp, Homo sapiens
ggtaatcgtaatttaggctttccctttttaaatgacggcaggtgtgctggctcacacctgtaatcccaacactttggtagggcgagttgggctgatcacctgaggtcaggagtttgagaccagcctggccaacatggcaaaaccccatctctactaaaagaaaatacaagagttagctgggcatggtagagcgtgcttgtgatcccagctactcgggaggctgagacaggagaattgcttgaacccgggaggtcaaggtttcagtgaactgagatcgtgccactgtacttcagcctgggcgatagagcaagactctgtctctaactaaataaataaattaaattaaatgactacttaaatagaagttaattttaagaaatgttgccactttgctgtataaatatgttgtatttttagttccaaaacattctgtttttgacattctcacaagtttttcttaaaatatgtgtttaataggtgtttttctttctttttcccagcaaattgaagagttttctgatgttaatgaaggagagaaagaagtgatgaaactctggaatctccatgtcatgaagcatgggtagggtatttctaaattaatttaaatattttattattctttatggtcttttgctgtttcacattctagaaatcttacgtgtgttagaatcttatttaaaattccattaatgtatatttgtcccaaattttattctattccaatgttttttggtttggcaggttttttttaggtacaaagacgttccttttggtattatttataacaatgaattaatattatattcattagtattaataaaatcaaggcaaaaaccgggccttgcctttagaacttgttgcacagatgtgagtcatcgcagcattatttatcagggttgttgattctgtcagctttcaagaggaaacaggctgctgcaaccctggtgtccgtaggaaagggtgtcatcatcatagaacctcctcagaaatcactggtgcccatcctaactctcgtagtagtgtttctcccatgcttgcaaactctatcagggttgactcgttcacactcaaaacat

SEQ ID NO: 86022 - DNA, 3144 bp, Homo sapiens
caagctccacctcccaggttcacaccattctcctgcctcagcctccggagccgctgggaccacaggcacccgccaccacacccagctgattttttgcatttttagtagagacggggtttcacagtgttagccaggatggtcttgatctcctgatcttgcgatccacccacctcggcctcccaaagtgctagaattacaggcgtaattacctggcccaaatattttatgcttttaagactgcttatgtaattgaagaacagaaattatatctgctgttctaatggtacctgtttaagcttaagttagattaaatctcttgaaatttttaaaatggtaagctcattcagatgattgaatttcagtttctctatagttttactgcttctttaatcatcttttattttactggaattggatatagtcttattataatggttatcactgttgcatttgacaaaaatgctttgtattgctattcatattctgtttttattaaataggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgttttggggtttttttgttattatgcattgttaacatgtacattaaaattttgatttagatagcatagtaagatttcagcctcaaatgagtcagagctaataagaaattaggaaaatcttaatgtgaaatcctgctttcagcagttacaactaatatgtcatttatggtattacataaatatttaaaaatttatagttcagagtaatgaaggagagagattcatttttcacagcatacctttttatactatttaaac

SEQ ID NO: 86023 - DNA, 1088 bp, Homo sapiens
agaaaaaaagtcacttagtttggttataaagaaaggagtcttgttcacacagcgtaaaaacgaatcttataatcgtattttataagcatcagaggcaaaagcaactagggtgacgggctttggggagtggaaagcgccggatcctgggagccagtcgccctactcgatcaagcattttctgacggccctatccaataacgtggggacgcagctgaaaaccatgcaagctgatcgctgccctcccggagtttatggtctggtgagaagatccctgctctgagtcactgccaagctctagctatgtgactttgaacagggaatttctgtccctatctataaaataaacggggttaaaccagggaatccgccattcaaattcctggcccaagtgtctccggggtcgcggtgcccaaaggagggtgggcgaggctccctgggcctgcgctgcggcggcctgacagcgggagcgctgttccggcgcagagcgcgttcgcgttccgaaagcgcgtgtccctcgccgcgtgccgtcgtccccgccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacgtgagtccgcaccctctggccggcccctgagtccctgccctccctgcccctgcagcccctgtcgcccctgtcgcccctgcagccccaacctttgcagccccggcccttctcgcgcctcacagctccgctcgcctttctccgcgttcctaggccttccagccccttcactcttctcttttggctggccgccggcggccctcaccctgtcacctcacctgggccctccagagatctcctttccctgttccccagccgtcctcccaagccatgtccctat

SEQ ID NO: 86024 - DNA, 1056 bp, Homo sapiens
catataggaaattccaagggattctgatgctctgtgccagaagctggggacaaagaccagatgtattctatgttatatcattccctcctttatattatttgaaattttaacattttattttttaccaaaaacaaattgaacacagtaattttagcatatgtttatattttaactgcctcagtagcgacctgttattcccagttctccggttgctgttaagaaaatctttgaatgctagttccagaatctccaggaggtgggaccagtttcgttagtggtgatgtcgaaaataacagcagtaccactgtgcttgggccaggtgaaatcaaatcagatgattcagtctggttgatgtgctagaggcccttttcccattcatgtaaaattggaaaattttgttcactatccaagtgtttccaaatatttggttattgtgtcaatgtagattcatacatattaagtatgtatcttgggtataaatttaagttataatttaatataaattgtgtggcacaaaagtagttcaaaggaggaagtggaggaaataagagctataggtagaatttgaaccatccttgaaagataattattaataacatttgggaaagtagaggggaaagcaggaatgatgtttagatgagggaaactgtgaggtgggcaggatttatcatggcttgtttgcacttaaacaatgcagaatggccttatttgagcaaattgagtgggggatagtgggaaatgagattaggtaggtgagctagggatagattatttatgatattcaaaggccagtagaatgatttcattttggtgtggtagataattgagagtcaaagaaagcgtttgatcaggtgagtcagaaaatgaaaagagcatgtaagaaaaatggaccagcatttatattgttggtagattaatgaggagagagactggagaaagggataggaaatttgggactgggagatttttcaataaaagtaccataattagggaaataggggaacagtgagggaaggaatgaatgttaaaaatttcaaaggaaaatttgacagatct

SEQ ID NO: 86025 - DNA, 1883 bp, Homo sapiens
tgtcacccaggctgtagtgcaatggcgccatctcggctcactgcaacctccgctgcccgggttcaagcgattctcctgcctcagcctcccaagtagctaggactacaggcatgcgccacaacacccagctaatttttgtatttttagtagagacggggtttcaccatgttggccagggtggactcgatctcctcgtgatccgcctgcctcagcctcccaaagtgctgggattacaggcgtgagccactgcacccagcccatgttttacttaaataatacatttaaaaaagtggtgactattcctaatgtagaatatgtttctttggttgcaattcatggatttaatattgctttgtagattatcattttatattatttgtggttttaacgctggtttgtttttaaatatatttttatgttttttgctagaggatttgtttcaacactccattagctcctcaagctctggaggatgtcaagaatgtagtcagaaaacatataagtgatggtgtggctgacagtgggttgaccctgaaaggtgggtaaatggtatttttcccccttttgaaacttaatattttcaaaatttggcagaaggtgaaggtctttattgcattatttatactttaaggaaatgttaatatttactagtatgcctaaagtctgatttggatatttatgagttgggagggacaggccattgttggggattatcatctttactaccaatataaattagaggtagggaaattggttggatctcaaggatacagaggtccacctgatggaaggagatatctggaacaaaaaaaaagtatcttaaaattcttcctactcataaacagcctttaaatagtcattatttttagggaattttgtctatgagtcaaatttaccagtatagaatgttccctggagaatatattatagaggcacagtgaagttaatgagattgaaaaccagaattttccatgacaaaaataagctcaaagatctgtagaacactactctcatataactttgtgcatgtcagtatattccttgagatgcaatgttggccatttcctctagtgctctctcttgctgagctgggtgtatatgtgaaacaattctgaaatcagctctgtttcattgagatacttgtgaattttgttttgttttgagctttacaatgcaaagctagcatccgtatgttcatgaatctggttcttgccattatgttacatgcttttctcctatgtgactctgtacactttatttactaatttactttatttcaggttttctctttttacacacactttttatccagagagggagacacgaaactacttggactgtgcttcgacgatttggttatgatgatgacctggatttgacacctgaatatttgttccccctgtatgtacctttgttttttttgttgttgttgttgtttaattttttattgagacaggatctcactatgtttcccaggctggtcttgaactcctgagtcaagtgatcctcccaccttggcctcccaaattgctgtgattaaaggcattgagccatgcccagtcacctttggttttgtaatgattttacttgttaaatatttttaaggttgatttagcacacatggggaggtgggcttcaagctaattgggaatattttagaattatagcagagctttatagcaggatttctcaacctcagcactattggcattttggaccagaaaattttttgttgtggatgtcctgtgcagtataggatctttaccacatccgtagatgtcagtgacacttccagttgtgacaaccaaaactgttgagaaattgccgaatgtaccctctgaagtgaaattatccccagttgagaaccactgattccctcatgg

SEQ ID NO: 86026 - DNA, 2563 bp, Homo sapiens
taaaaacaataaatgtaaaattaaaaatagttttgaattctgaagaatatggaggacacagtattacatttttaagtggttatgtccagcatgactgcgactatacagacacacataaaaatgcatgtgctcaaggactagaggtgatattaaaaaatgaaagtagtttttataaaagaatttaggtggatttctttatatttcaaaatatgtgtgtttaatgtgtgtttttaattacatgttttttttaattgtaataaatctaaggaatcagtataggtctgttttgtcatcagcattggaaaagtgatctggatcttatttattatatgagatttacctagaccactgccaatctttgccttttggttcactttttcgctttgaaactactgttgctttgcccatctggaggaaatgcttggttcacatttaattaaatagtaatttttgaacttgttatcagattttgatttcattttttattccatagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgtaagtacttgctgtcttcattttcatgttgcatggttcataacattgcatgccattattagccatgaagggaatatctttgtcacataggaattgttcagcaacagaaagatactttgtaatgagaaggtacaaatttgagtaaatgcaagtttggtttgaatgccataataaaatgatataaacagtgcttctgacaatatctgtatatttttgagcaggctgtaactatcttaatagaatagtacaataaaacacaaccccccacccagcattaaaaaatagttttactggaataaaatgggtttggcatcatgttgttttatgcttataaagcattttcatatgaacagaaagtttatatttttctgtttttgaccttaggtatatgaagttttctaaaatattttattaatttatgttgaaattgtgggtatgcttcagttaggatatgtcttttttaagtgctgtaaagagtagttgtaattggaatttctactgtataaatgttttacattaagtgttacgagccacaaatttcatgtacatttattatatatctatacatgcatatgcacaagcacataactgtggtcatctctgtagtttactaactgccttaaaattgcatggttcttaatggcattcgcctcaagtagtgtgtttgtataaattctgttttgtaacaaaatagtttttcaggcagtgcgtttctcaggactttatagcttattctacttattcttatgttagtctctaaattatttttcttcttatgaaaactacagtgtaacacagagtaataatcaaacattgctataaaccaagaatgacatttttcaaaaaggtgttgatttgtacagatttttaaagtcagttaactttactgctattttattacctaatactttttttagatgcaacaaacccttgaatttctatttgtattcgaagacaagtcattcctattattatagaataaccaaaaccttatttatgttttacctttgctttaaaactctcatgtatgttatctacagagaggatcattacagagacagactctcccgagacatgggccacactgatagaatagagaatttgagaaaaatctgggtctttctaaaaactgctttgtaagttactttttctttatgacttctgtgggattttgttgatattttcttagagaatgaccaaatctcctttcttgccataattaacatttagtaattatgtagaaacgcactgcttggtcaggcttcctgcctagctatatattacgttgtcttccttactacataaatgtacttctttaatcttgtgattacagtaactgcaagtgtgtttttacatctgcatttttaaaacattttactgtaattctgttgtgtgtgtgtgtgttatatgataaatgtacatacatggaccacttgtttatatggttaatcccaaactacttctcatgaagcatctccctgttgctaagcatactttgcatctctcctttttggtgggtggagccttgtgtatgttaaagaatcagatttgatttataaaataacagatggattccagtatgacagctggcagagacttagtagcagtgatttgttcatcatcacaagtcaaaaaaaatgaaaaaaaaatgaaaaaggaatgtcttgggcctatacaagtttttttttttaattcttgtttttcttcatattgggaattaggcattattggaatgctgctaatcgttacaaccatgccaccatgtgctgtggtctcatcagatctcataagctaagccaagtcagattgggccagtcttttgactgagaagcctataaaaaaatgttcaggtgttacaggaagtgat

SEQ ID NO: 86027 - DNA, 1030 bp, Homo sapiens
tacacttgtcttttgactcatttgtatatttatcattcttctccttcctggttttcaggcatgtgtgtatgctgagggaggaggaggaggagggaatcgttatttaaacgctagcaaactttgtccttttggtgggtgcttatggcttactcaggttttctttttattaatttagacgagggtgccatctattgctgtgcatatttattccacaaaaattcatgtaataataattccatcccccctccaaaaaaagcaaaagtatcagctaattttccctagattttctacagggagggaggaggaagctattactatttattatgtttttggtaaatgtggaattctgcacaactttagcatgccccatactgtccttttcctttctacaaagagtgttgcttatgcctaagtcttttttttttaagttggcacaccctgacttgtgccatatttgtaagtaagaactcaactcctgtccttctgtgtgttttcgcagccatgcccggttacgctgtatgtgcacctgcaacaggtgtacattttgcatctgtcagaacttcctcaactcagacttgctgcaatctgtaaagaacaaaatcttcactgcagttcttaacaggttcttaactttatttactgggtaccaggcattctgttaaaatacaaaagaaaaaagcggataactatttattatacagatactcactacaaagacaagctgactgatgcccaactaacttccactaaaattctcactgtgatgacaatgtttagttttggaagcatccttaataatgtttttaaattaataggtatatttagaggactataaaataagattttggatgtttttttcataaggaagataaattatctttcctattaaaagataatatgtatagggaaattaaaattttttggctgtgagttaatagattaggacttttgtagtaaagaaaagacacattaatcctaaatgaaagatattatactgtactcagcttacaatgaaataatatatctcatt

SEQ ID NO: 86028 - DNA, 1047 bp, Homo sapiens
tgaactcaccttggctccccgtaattgctgatcacaaaccacctattttattacctattctagaaactcttgattgtccataattacagattgattcattgtctgtgtccctggtgacaattttattcctagattggtttagttagctttcaaataaaattgatttagttagctttcaaatgaaataggacagatgtgcattaaatgaatactattgtgcatagtaaattatacaatggccctcaaagagaaatcagtacgtttcggtcatatctatttataaactggtagtaatttaatggtgatgtcagcacacatcctgacatctggtaatcaagaatggaaagaatgaaaacgacaagtagaggaaccagtatacttttcaaacactccttccttatccccgttagtatttcaatcatttatttaagagaagtacagtggaattttaggggctgcgtattggagtttcttctagtttatgaaaggtaagtaagataggtaggtgggggccaaaaactcagtgcccacaggtcccggatggatactgtaaaagaatgaaggtggccaagtataagaaacaaggagaggtggggactgtgacaggcactgtctaaaagaggcagccaccactcagctctggccgtttgttgttgtacaggtctggtgttgccaggttttctggttttacaagagactggaaatcaaggctttggtgtgaaatttccagattgttagagattagcaattaattaacaaatttttaagtactaatcagaacaaagcatgtttatagtccaccagcttgcaacctcagtcttaaggtatggcctagtcatgaaaatagaggccaaggaaaaggacacatagaatgaaaatgtctctggtcccatcaccaccaccaccactttactcctttcccatgaaaaatttgaaaaagttattgggtggtgggatgagaatggaaccacctttccctgttacttctcaggttttggcagctgttactggttggtcactattggtttcctgtgttagacatatcct

SEQ ID NO: 86029 - DNA, 1078 bp, Homo sapiens
tagaatacatttattttaaatatagaaaacatgagatccatcatatagggtggcaactcaatttatgtgtgggatgcataattgagagatgttattttgagtccctttttttgtgagctctgctgtgaactgcaaactgtgtgcatgtgtataaaaggttaagagcccggatagctgagtggggtgccatgctgttagcagacgatgagggcagtattactcaccaggtgcatgctgtcagctctgtagaagattccatcttcatggagtcatctcatggtccactttttcttgaagccaggtaacatttccaatgggttggcctcgttggagtttttccagcttgaaaaacctaagcattttcttctctgactttttttttaataaaatgctgcctgttggaaaaactaacttgcaagctggaatgaacctgtgatatcactttgctttgtaagaaataattatgtgaggagtgattttttttttttaaatagaaactggtgagggtgagaattggagtgttgtgtcttgctttgttgtgttaagcatggagcactctggcttgtgttgtagacttttgtttctagggatgtacagactattttgtgataactaatctgttctctttgactattactgaggcaaagtagttttgtgcagtttgaattcttggctcttaactcttttgcatatgtcagtgccttggtcttttaatgatatctgacttttgcttcaaatctgtttaacttagttataaaataacctaaactagacagtctctctaagctcttaattttgtaagttttcttttctttctttttttttttttttgcgatagagtctcactctgtcacccaggctggagtgcagtggcaccgtgtcggctcactgcaaactccgtcttctaggttcaagcaattctcctgcctcagcctcccaagtagctgggattacaggcacccaccaccatgcccggccactttttatatttttagtagagacggggtttcaccatgttggccaggccagtctcgaactcctgacctcaggtgatccacccgcctcagcctccgaagtg

SEQ ID NO: 86030 - DNA, 1722 bp, Homo sapiens
agcttgacaagtgtgctaatacttccctaaaagtagactgctaaataactggtatagggttttcatactaatcatgttttaaataataattatattttctgactgcaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtgatcttgagttcttttgtcatctaaagtaaatatttctgtacagatgtgagtgaagtcctctggtttctatctctcatattgaaaattattctgtataaaaggaatactcagccgggagtggtggctcaatcgtgtaatcccagcactttgggaggccgaggtgggtggatcacctgaggtcaggagtttgagaccagcctgaccaacatggtgaaaccctgtctctactaaataaaaaaaattagctgggcatggtggcgcatgcctgtaatcccagctacttgggaggctgaggcaggagaatcgtttgaacctgggaggaggtggagattgcagtgagccaagatcacgccattgcactccagcctgggcaacaagagtgaaagtatacctcaaaaaaaaaaaaaaaaaaaacttattaggaaaaaagtcaagtatgatttatatatgtaagaggaaatttatttaaaagttgtagagaaatctattctggtaaaaggcca

SEQ ID NO: 86031 - DNA, 1100 bp, Homo sapiens
ggggttggggggtagtttacgatcttctctctttggcgtctgcggttaaatctatcacttccttctggccctaaacccctggcagaatctgatgtagtcaccacttagactcagccttggaagagaatgggtgggcttcaccgcattcggcattcaccacccccccttccccgcaaaaaaacaaaaaacgaacaaacaaacaaaaaactgcaggcaaaatgttagtgtttatgcagaggtgagttctcctggggggggaggggggggctctagctcccagcaggtgagactcattgcgccggggtctgatggaattgcacctggccatgctctcccaggcctgggagtagctgtggacataagctttaggcagcagaaattattagaggcgcttggacatatttggacgcctttatttagtaattgttgagaatcacttgttctgccagttccagaaccagcaacacccaccttgccgcccccgcccccaccccatcccttactgtgagtttcctccctctgctcagtgtggactcattggggagctcctcccagacttcccctgctctcctgtggccagtccctgagcctggtcatgactcctgggcagccgctgggaggctatgtcagaaacatccgaggactacagagaccttggtgataagtgtgtctttctttctctcctcttcttcctctcctgcatggcctccctctctgccagcactggaaagtcctgtttgatcaggtatgtgagcagttaaccccccatttccttccagccctccctgaaatcggtctcagtctccctgcttgcgtgggcttccctagctccgcgctcctgagatggtgacgtggggtgggggtgtggctttgtgcatctctagggctgaacgacactgctctccaggtatcaggaggaagagatgggctcccctgagaggatctccctcctgcctcctccctactctgctgcaccagagccgggtttacaccatgtagaaattggacgttatatattgaatgcctgggaaatcctccatatgccaggggattgcagtagggggctggagaggtgggggaagggcttgggctgacaatcc

SEQ ID NO: 86032 - DNA, 1021 bp, Homo sapiens
cattacacagctctatatgatagtcttattttatctttttttttttttaatgaaatggggtctcactatgttgctcagactggtcttaaactcttggactcaagcaatcctcccaccttggcctcccaaactgagccactgcacccggcctctggtagtcttattttaaaaaaagtaagtctgggctgggtgtggtggctcatgcctgtaatcccagcactttgggaggcctaggcgggcagatcatgaggtcaggagatcgagaccatcctggctaacacggtgaaaccccgtctctactaaaagtacaaaaaattagccgggcgtggtggcaggcgtctgtagttccagctactcgggaggctgaggcaggagaatggcgtgaacccgggaggcggagcttgcagtgagtcgagatcacaccactgcactcaagcctgggcgacagagcgagactccgtctcaaaaaaaaaaaaaaagtctgacaaactctgtatcactactgtagacaaggaaaatggtgtcatggaactgaatatcttggtcatgagaagaaaccacagagttcatgactagaaacatgtactgtattcaaattttaataagctactatcttggcttttaaagttgtttttttttttgtttttgttttattttttaagacagaatctcgctctgtcacccaggctggagtgtggtggtgcaatcttggctcactgcaacctctgcctcccaggttcaagtgattctccttcctcagcctccccagtagctgggactacaggcatgtgccaccatgcatggctaattttttgtatttttagtagagacggggtttcaccgtgttagccaggatggtctcgatcttctcaccttgtgatccacccgccttggcctcccaaagtgccgggattacaggcgtgagccactgtgcccagccagcttttaaagttttaaaaaggatttgttcagacatggaatatatttgtgtatattacttgtgtgctgtacacacagagga

SEQ ID NO: 86033 - DNA, 2354 bp, Homo sapiens
attattatttcacttaacacatttttaactgggtaatcattttctaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaaaaaaaaaatgtaattctagtcttagaacagattaataccactacaccagttcagagatagatctgtgcatcctgtgggtgcttgatacatttttttgtctagttgataacggcatggatgataaagtcagattttaagtcaatatgcaaatcctgagtatgtagaaaattaaatgagctttacaaatcgatgcactagcttcaagataaaatattatctttgagctgggcgcagtggctcaagcctgtaatcccagcactttgggaggctgaggcgggcagatcatgaggtcaggagatcgagaccatcctggctaacacagtgaaagcccgtctctactaaaatacaaaaaattagccgggcatggtggcgggcgcctgtagtcccagctactctggaggctgaggcaggagagtggcgtgaacccaggaggtggagcttgcagtgagccgagatcgcgccactgcactccagcctgggcgacagagcgagactctgtctcaaaaaaaaaaataattatctctgagagaaagctactgcagaaatcgccttcagtcaccatttcatttatttgttcacaggtatttatgaagagcctgtgttttcttttaggtgaaaatgctggagttttaaaacagtgttgagaaaagaaacaaagtacatacagtttacaagcaaactgtaacataaggaatgcaaacagtttcttcctattagagttactcattgattttagttttttgtacatttgttacaagcctcagattgttttactctgaatcaattgaaagtgccctcagctagccatttacaattcccatggaagcctatgtagctacatacatacaattgcaatttgctcgggatagctctttaataaattcatttgataatgatttttgcttagaagaacagaagtcttgtgttctcacttccctgaggatgctcagaggagcacaaacccataaaactgaggaatcctctcttaaatggatctaaattcacattaagtgctgagttttaactttcaaaatgactgacaatggccttctgctttctcctctacataagcctcgggacatgactcacatttcttttcttttaatgagaaatacaattcagaatcttcataaatgctttcatacggttttaaactttaataacttggaatgtaggcagtatagaaaaaaatctaagtagcatttttcatagtattaaagtgagagtggctgggcacgatggctcatgcctgtaatcccagcactttgagaggccgaggcaggtggatcacctgaggtcaggagttccagaccagcctgaccaatatggtgaaaccctgtctctactaaaattacaaaaattagctgggaactgtggcatgtgcctgtagtcccagctacttgggaggctgaggcaggagaatcgcttgaacccgggaggcagagattgcggtgagccgagatcgcgccactgcattccaacctgagtgacagagcgagactctgtctcaaaaaaataaagtcagggtgactaaggaaaaccagcaattttatgacactgtccttgaatctgactgtcttttcccaatgtagttggttccccacttggaaatcattttttaaagtaagctacattagcacatcaacgttttaagtctgaaaaaatacttcattttcaaattcatgtcattcaagagtc

SEQ ID NO: 86034 - DNA, 1021 bp, Homo sapiens
tttctgtcattatctccccacttctcccatttctgtcacacacacccccatccccaccctctggttttcctctgttcttgattcctctttttcctccttctgactttcctggaaccttcttggccttgtcaagtttggtttttaaaggagtttccttgaaccttctgggtatttagcctttcctccacccgttaagtggcctggagagagaaggggctcttgtcagcactgctgtatgggttttccttgtcatgaggataggcagtgcacttccaccttgcagcatttttagttgactccttgccttaccctgcttgccaggcccccatactcctcttggtttagagcccataattgatagcactattggttttgtggcttgtagattggcacagcaacgaggggacagtgaggacggaagcccaagtggcacaaatgcagaaactccctctggtgatgatttcaggtaaaaagagcttcagcataattcatgcatgtgctttcatcttccctgcatctctggcctgtacatgtcagtggatactctatttccactgagctttccctgagtcaaaccgtcaattcctcctatcccctaggaacctcatcctgatttcctcattggctggttcattcaaggctggggcaaacaaatccacatactgatagtgtgcttggtgattagccaaaaagaaatcctttttttttctttttccttttaaattgagacagggtcttgctctgctgcccaggctggagtgcagtggcatgactttggctcgctgcagcgtcaacctccccggcctcaggtgatcctctcacctcagcctccccagtagctgggactactgaccaccacgcctggctaatttttgtatttctggtagagatggggtttcaccatgttgcccaggctggtcttgaactcctggactcaagtgatccgcccacttctgcctcgcaaagtgttgggattacaggcatgagccaccttgcccagccctgaaaaattttttttttt

SEQ ID NO: 86035 - DNA, 2534 bp, Homo sapiens
cagagactaacttatttggtttagcatttaataggcacataatcaacatttactgttcaattgaaacaaaattaaaattgggcgctgtctctatctttatttgtgatcggccctaactgcactggcaatcttttccgtttttttgttttctgttttccattcgcatgccccttagcgtacctggggctccggctcctttacaaatgaaacccaaagtgctccgcaagcacagccagcgaaagcgaaaaactctgaaacggacaagatggctgccacctcttcgcgcctcttagtcccacccactcagggcggaggtctgcgtcatgtgaccctccccttcttggctccgcctcctaccgcagtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtatcctttgtcggtttgaagtcgaggtcgcgttggggtgccggttgttggggcctgggactaggaggcctggatttggcttacggcgtggagcgtttgtatttaggcgtctgcgtgggtggcctggtggctgggattggacttgggaaggcttctaggaaaatggggttccgaggtcgacaggcttttgcagttgtgggtcgtgtgactctgtgactcaggaggatcttgttcggtgcgaattttggactccgggaggcggcctggacccctccgccagggacagtgtcccctagggactattcagccaccttccgttgttttggtgacgattcaacaagggacttttcttcgagtgcgataggcttattactttcatggagggttggggacagcttcacagtctgtcacccactttttctgtttttatttactttatgtgtgttttgtgtttattttttcgaattggcggtttagtaaagaaccaagttagtcaaccctggtttcgaacctttttttttttttttttcttttcggggcgggaggagaactagcttccgtgtctcacccagaggcgccttaatcttcaggaagcgttctcacagggcggagtttctgttacccaactttgtaggactaaaaagtgcctatcttattaggaaaactcttactacagtgtggtattaatgctttttctggaagcgttaatattctttacattaaaattgattttatttactgttttgtacgtaaaggcggcttgttacagtactgcgtttatgtaacagttttaaaaatagcttaaatacggttacgaattttgtaatgtgattttaggaaaatctgagtagtgaggtaagaattctgttttattgatgtaagaattctgctttattgattttattgatctgtgaatttaaatacattgcttggcaacataaattcatacggaattggaaacaactttatggattgttcattcgaaattatgtgattattgttcaccatatagttactcttagattctaaatattgctaaattcctaatccagttattgctatcgtcttcatatctagtgaagtaattgtcttgacagaaccttagggatttcttaactgaactctttcctgtcctcagtgtgcatttgtaaatgttgaaatatttataacaaaagtttcaccgacatctctgttaaacacaggaatttgacaaagtatattgctgattattgagatgtgttttttggggtggtgaagagagctggccttctaggaaattgaaaatactgaaataacatggcaagtgtagtccctaattgtgtaataaatataaaaagcagagtttctatacagtaccattttggttttagctgttcccatattgtaatgttatccatatgtttttattataggcagtgtcatcattaggctgtctttgtgccttaacagtattgatcaggtattgtaatagagattttgatgatgagaagatccttattcagcaccaaaaagcaaagcattttaaatgccatatatgtcacaagaaattgtatacaggacctggcttagctattcattgcatgcaggtaaggatttttcttctgtatttattgtccgcttgtgatttggaaacaacttgaaagaataatcttttttatttttttgagtttcggtcttgtcgcccaagctggagtgcagtggtgcaatctcggcccactgcaacctctgcctctcgggttcaagctattcttctgcctcagcctccggagtagttgggactacaggcagccgccaccatgcccggctaattttttgtatttttagtagagactggggtttcaccatgttggccaggctggtctcgaactcctgacctcaggtgatccacccacctgggcctcccagagtgctgggattacaggcgtgagccaccgcgcctggccgaaagaataatcatttatttctctga

SEQ ID NO: 86036 - DNA, 2056 bp, Homo sapiens
ggactcctataatttcagtgctttaggtagctgaggccgtaggatcacttgaggccaaaagttcaagacctcacctttaccccccccccaaaaaaaaaaaaaaaaagcccagtgtggtggcatgtgtctgcagtcccagctacttgggagactgtggcgggaggatcgcttcagcccaggagtttgagagtgcagtgagctgcagtcgtgccactgctgtacagcctgcatcgcagagcaagactttactaaaaatttaaaagaaaaaatactgatttaggataatcattttacctttcataggacagggaaagaacgttaatcttgtttaatatagggcgaaaacacatttgaagaacatagagcagtattaattgaatttttggggaagaaaaatctcatgaagtaattttacccatatatgtatttttaaatattgaatgttgtaaataaactttcttagtttttactctatggaaataattttttttttttaacagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggtagcacataggattgcttaaaatctaacatttttaggacattattgatattgtatcgaagtattactttcttccctctaactctttaatatttgttattattttgattgaaattcttgcttgtaggcatacctccattaatgccaggtgttcctcctctgatgccaggaatgccaccagttatgccaggcatgccacctgggtaagaaaattcttttaattgccctgtaggcttgtgcctagtaatgatctttttcaatttggatgttatatgaatgaaatgttactttccattttttgcttctagaaggtatgggctctatatatcttgtctaataaagggatcaaccagtaaatttaaggaatataaatttgcctctgagtaatagatttttgggttttagggtatatgtaagcaaccatctacttcaattgcatttactgtgattaaagtagttggttatttatagatttgcgtttctgagattcagaattatctgtgacactttgtagttgtgacaagaagcagagaaactctgtaaatgatttatttgtcaaagcatcaaaactaaaatgaatatgaggtgcttgtgcccatcacttttacttaaatattgttggatgtgagaggtatacaatacactttcccactgtattttgaaaatcacagttagattttgattttgtcatacattttcacagattgcatcatcagagaaaatacacccagtcattttgcggtgaaaacatgtaagcatctcattcataatgtaattcaggaggtataatcatactgtcatttttttatgtgtgtgtttaatggtatctattcagttgacttcagaaattttctaaccttcctcactaaaacttgcaagctaattaacacaggtctcttaaagaaggaaaataaaacatcttttaggaaacggtaatagacccatataaacatacttcaaatgtgcagtgattttctccaaactattgaaagtaatgggacctgttaataagggttagtatttaagaaagactatattctatgaaattacatgctttattattataggatgtaatggaattttctaatctattaatagaagttaatcttctgataaaaattttaaatcaagaactgaatttacccacaaaaatttaaaaaatttgaaagaaaattgaccaatttatcattttttaagtgaattggacactgatatttgaaggtgagctcttttaggggaaaaaataagtgggttgtgtttttaagtcatggtttagtggtaggtagttattgtaaataggccatctggttttacttttgagtgtctttaattttggtggtagtatttcctttctctaaaaaaaaaaagtgtgtgtgtgtgtgtgtgtgt

SEQ ID NO: 86037 - DNA, 1170 bp, Homo sapiens
cctttcttttatgctacagatggggacacctgtcacaagctcaagtacagcttcatccaattcagaaagtctgtctgcatcttctaaagctctgtttcctagcacagcacaagtacgcaggaagttgcagtttaaaattgttaaaatggctttataacttaaccctttggaccctacttaaaaaatgaatatttttccaaaaatatactgtgtttacttttttaaagcaaaattaatgctatataagtcaaatggtatttaaaaatttgaattcatactaaacaaaactaccccgaactcctgtggttctaaagggttaaaagcatgtaagcagtaaatgcattatagtggccaatggttagcctgatgcatgattaagctattttgatttaatgctgtttaatgcatcacatttaatgtaagaaaatttaatactgctttggttctaaagttggcctagtctacatgttttagatgtgtggtattatgaaaagtaacatatttgttactgataacttgctactttaaaagatcctgctaaattaactcctttgtccatgataattatccagccattgttaatttggaggggattatatatatatatatatatatatatatatatatatatatatatataaagaatactactaaaggatgtatttttattgtgtcaccatttacactgttcatgttatagttagtaacgagtttaaactcatattctgtagttttttttttagctgtttgatagattaataactaattaatagaacattaaaaatagaacacatgctattctaagatactgtatttcagcaatctggaataaatacaaagcattgtaaatttaatttttggtgaggaggtagaagacatctaacaagttaaatatgcagtcttatttccactgctgtgttgtgggtgtgactttaacctagcatcttttgatatttttatgggttatcttgaattttgtggaatgtttatcacattaactttgtattaatttcatttaaagtttggtcctttatttaatgttgatgccttgttttaagttaaactgttgtagatatagttaatttaaggttttgaagtttcgttgatgaagtattgtattttacaggctcaggcagctgtccaaggacctgttggtacagatttcaaacc

SEQ ID NO: 86038 - DNA, 3122 bp, Homo sapiens
ttgagccaagattgcaccactgcactccagcctgggcaacagagcaagactccatctcaaaaaaaaaaaaagaaaaaaatggaatgttggccgggcgcgcagtggctcacaccggtaatcccagcactttgggaggccgaggcgggtggatcacctgagggtcgggagttcgagaccagcctgaccattgtggagaaaccccatctctcctaaaaatacagaattagccgggcgtggcggtgcatgcctgtaatcccagctactccggaggctgaggcaggagaatttcttgaacccgggaggcggaggttgtggtgagctgagaccaggccattgcactccagcctggacaatgagtgaaaccccgtctcaaaaaaaaaaagaatgttaataacaatacttcattagatagtttcttgttgaagcaatttgtaattcccggaaagttgttagccatgcttcaagtttacaaataggtgaagttttaaggtatctagagtttaagtagttggattggtttgtctggcaaaagtaaatagttgggatgtaagggtaaatttttgaaaattactcttaacgttgtaagattttagatgcatgcctttatgcttggtgagcctctgcattcgagtatttagccctgcgcttatttttattcccaggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtattcctctttttatgtttttcatatttagtggattttctaagttcacgcataaaatattaaatttatctgcagcatacgttgcacttaaaagtacaatgcgttaacaatctatttttttgtgtttgaaattcttgattttaggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttttgggatctgtttttctgatcttttgcagggtagttttatgattttttaggcatcaaataacctatgcaaagtattaatataatgaactcaagttgagtttttctcattataaagttaagacttctaagaaaatggtaacatttctttataactttcctgtgaaggtatagataaaacacatgaagtctgaagttgtatggaaaaaagggctttaactttgaaggaaaatatattgaaaagtgatttagccatcacaaaagagttcgtatttatgtgacagatgaaagtcatacctttaagcaaaacattgcaagtattataaagctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgatt

SEQ ID NO: 86039 - DNA, 8969 bp, Homo sapiens
tgaacctctgcttacctaaatggtttcaaaattaatacatgctgctttgatttggcagcacacttaatatactgctgaaggaaaacttgtgttgaaagtctttaagataaaaatggtgtgataggccgggcgcagtggctcacgcctgtaatcccagcactttgggaggcccaggcgggtggatcatgaggtcaggagatggagaccatcctggctaacacggtgaaaccccgtttctactaaaaatacaaaaaattagctgggcgtagttgcggatgcctgtagtcccaactactctggagaccgaggcaggagaatggcgtgaacccgggaggcatagcttgcagtgagcggagatcacaccactgcactctagcctggacgacagattgagactccgtctcaaaaaaaaaaaatgctgtgattaaatttagaataattaagtaaggggtgctctcccaaattctcaggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgaggcaagtgggatttattttattccttataggggctttcacagctttatggctgttggatatttatgtccccaaacttgcagcaagtttggtgaaggcccctaaatttaattaaacttaggatttttatactcttttggcagagaaggctctatattaatattcacgtttgactgtggtgttaataaacataagtatttcatatgcaattttatgtaatttgctgtgtgttacataattaacagcttcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactggatactgaaatgtgccttctcttttttgagacggagtttcactcttatcacccaggatggagtgcagtggtgcgatctcggttcactgcaacctctgcctcccggattcaagtgattctcctgcctcagcctcccgagtagctgggattataggctcccgccaccacatctggctattttttcaatatttttcagtagggatggggttttgccgtgttggccaggctggtctcaaactcctgacctcaggtgatccacccatctcagcctcccagagtgctggagtagcaggtgtgagccaccgcgcctggccaaaatctgcattctttttttttttttttttttttttttgagactgtctcgctgtgtcacccaggccagagtgcagtagcacgatctcagctcactacaacctccacctcctggattcaagcgattctcctgtctcagcctcccgagtagctgggactacaggtgcttgccaccacacccggctaattttttgtatttttagtagagacggggtttcaccgtgttagccaggatggtctcgatctcctgactttgcgatccccctgcctcggcctcccaaagtgctgggattacaggcgtgggccaccgcgcttggccaaaatctgcattcttaatcacaaacttacgcattgaatgttaaggctaaaaggtcatctggaaatgcttaattttaaaatattttcaagcctcaccacattagagcaaatgttaatgtagagccctgtaaaggtgggaaggtggtgtctatgtgtgtgcttgtgtatgtgggggtatagaccatatagttgatataacaacagaatttgggtgttacagacctttcagcatggatggattactaattttcaggtatcgaaactgaaatttgatacctgatcctgtggtaaagtatgttaaactatggttttggagtgattattttgaggttcattttcagcctcactgaacagtgttttacgcacatgtgaaaagtatccacatttgtttccaactaaaatttgcttttatttggtgagaaaagttgtgtgcgtgtgtttgttgtagggaataattagggaattggaagagaggccaaaaacaaacctgaattacttttgtttcttgtgtttgagccacgattctatccagatagcagtttactctgagcagtaacaatgaacaagcagtatagcatttagcaaacctggaattgtttgtatatggttttcattcttggaagcataaagaaaaaatatgcattaaatgaattgtaaattttgacttgttaaataacatgtttttcactataactaataggattttaatatttaaagaattttgttgcttccatgacaaaatatcccattggactattttataacctcagtaatcaacatttaagagtccttaattggagatctgttttctctattacctaccatcctgcaatatgctgaaatctttctaagttgcttatcttaattctaatggtgataattgaaaaaagtgtgctggaaatacaggctcttatctggttgagtactgggggtgggaaggatttagtaatgtcataatctgttgaaggtaatatctatagataactaagatagttcctttttttttgtagttctgtgactcagacaaataagattttgagaattatgtagtttttaggtgtctgtaacatccactagtaaaacttggcaaatgaaagaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataatggatattcattaattttgtgattagtgctgagttttctaaactactatcttaagctcttaggcaccctattatggatctaattcaaaccaatatgtaggaaatggagaaagtaggacttcagtttgcgcttcccaataactttaaatatatccaccttttccaagtgtttaagccctaaaacatctatctttatttttttacctggcatttttgttagaaaatagattacgttttaaagtaacattaaaaaaattcttcagtaagataattgcttttaataagtatatttttcttgctcttggctctatacatttttgcataatattttagtcttgaaaagcttttcattttcttaactctggaaaataatagtttggaactaaattagtttgagaaatctgaatcatctctctttaaatctgttcagttagtctcatgtattctcaggggaaaatgtctttattttactaagcggaagtagtagtcatattgaggcagaaatttgtagcccaaacaaggtaggtcttcgctgaaactaatttgaactattcctatttgaagcaaattgaacactattataaatctagactggctaattagatggaaactttgatggttaggttctttaagaggcatacaatccgttatgagaatgtttatgtttatgttttaatttttatcaaaataacctcagaggaggtacatgtgagtaaactgtcttaatggttgattacttggaacccacccattaattctaaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttcaccattggttaagtctgaggaactaacagtgaaattcattgatggccaacttggataaaaatgaagaatgatattttcccagtttactacacatggaccaatagtgattatttgggagagaacactgggtagtattgtttgacttaagaaccttaaatatattgaaaagtaatggcattcttgctcatgatttgcatttgttagtgaggtctcaccatagtattttaatgtagcttcttattaaaattttattcataaatagtttagcagtcacagaggtgaaaaaaaaaagatttgcaccatcatatccgagtctttactaataaaatgaggctgcttaagtacccaagtggagcaagggaagagttactacagttactgtaagtctgagttagaaaaaatacagagcatctagttattgagcaaagcccccttttacctgttcgcttattcaaagagaaacaatagaatttgcttctcagtacatgtttttaaaattgagaatctctgatgtgacaaaatcaatttttacaaaagttgaattaaaaacttttaaaaattgcttgtctttgggggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaactagggaaaagttttaaatgtattagtatcaggctctgaggaaatttaatgcacattgactttttaaactatggattgaactcctcagtttaatacaatttgtgtttttgttaactagcagcagaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcag

SEQ ID NO: 86040 - DNA, 1411 bp, Homo sapiens
ggtcccctcgccggctgctgactcacggggggctcagcgtagggtgggagagtgggccgagccgggcccccggggatccctccctagccatgtccccggctctggcccgcacgagctggtctgggacccggagcagtgccggccggcgtgcttgtcacggactggtcctagagtctctacttgaaaggccttggcgaaaccagctctggacaggcatttcccgccgttgtaatcagcacagcctgctccgggtgggagcgcgagcgcttgctcttctctgggagtttccttccacgggacgctgggagctgctactcctcagccccacggcagaaagctccactaagaggagggtctctttcagaatgtgggaaattcaggggtgacacacacctcagattggcatttggtttgtggaggtggccgagacgctcatctgctctgtgtagggtgtaagagtgaggtgttggagcgggaccgcctggctagaggaggtgactaatctttccagactgcctgtaggggttggaagtgagttaagggagttagttgtcagccgcggagttcagggaattctttggaacgggtcggctgcatgttgccggaaaaattaaaatttcttaacgctgtaataacgatggtcttacacctacacacaacaggaaaactgaaatgggaatcccagccagtcgcttccggcagctttctgttgggattcaagtgtgaacagaaatttattacgacagaagaagacgttaatgttcactcataaaggattcaattagggcttggactagctcttcactgcacatgtaatggcatctttgtagtgtagtttgggaagatctgaattggctcaacaagtagtatgagaatgcacctgtatgtgggacttgcaagatgttggcatttgacttagtgtgttgaattttggtattccagacctgcacggagaaaggacaatgacaagatcttgatactttatcattggggatactagagaaggagaggaagtgggcgtcaaggtgtatctttgaatgatattggtaaaaggtgtttcattttaaaagttctgatcttaggtcagttacttctacggaaccagagtcatctcaatcaccgttacatggatattttattctgagtacacactattatttagaactaatgtgaggagcatgaattttaatagtctgtgtctagtgtctaatattttttctttcataaagtagaaattacgtcaaatattacaattagagtatttcctgttggcccactattctaggggagagttccctgaaagcttcactgttagagcaagcttgagtcatggtggttgacggccttactttttctggactccatcatggtttttgtcaagtcatgatgctttgtaagagtagtagtaact

SEQ ID NO: 86041 - DNA, 1029 bp, Homo sapiens
ataaatgaagcagagacatgagcttttcctgcaacttcatagtaatccagtggctgagtagggaacagaatgcaaatttggtatatgatgttaacttatttttgctattctgctatttgctaggaatgctttaaactcctagtaagtttcacttagactgattccagtgatgtaagtaccgatttttatgacgttgggtcagtttcttaagtgggtattttgtctcaaatgttgatgtttactcctctttttgaattgcctttcctacagagcttggaggactcctgaagtatgtacgacccttcttgaattccatcagcaaggctaaagcagctcgcctggtccgatctcttcttgatctgtttcttgatatggaagcagctacagggcaggaggtaagtgatattaatgacagaaagtagacaatatggagaaaagtttgtttccaagaaagaaatgcctacctgcactttagtactaatgtggaagggaaaactgggaggacagcgcaggacttatcatgtcagtttctctttgttacagggcatttgatactttgggtctgttccatgctttgctttgtaagtggagattgtcagtggtccctggaatcctcattacatcagggtcacaaactgattcttgtctttgaggtattgtattgccacacctttgtaatgttttctgtgtctgtggtacctttcatcttgtgtcacaaagctccttctgagcactaattaagtcttgtggtattccttcttagcatgttttgtactgcatatatgcctttattgaggggtgagcatccatccatttgtgtctcattgtgcagaagtgactctggtgttcctgtatgtgtcccacaagttcagactagaccctgagctgtattaaagagtgcttctcagtaatcactgaatcttccaaccttctcaaagataactgtattttctgcaattcaggaagagacgcataccaaaattaaacatcattctgtaaaaagtggcagattgaagcagggtatattgt

SEQ ID NO: 86042 - DNA, 1093 bp, Homo sapiens
tctctctttttttttttttccccgagatggagtcttgctctgtcacccaggctggagtgcagtgttgcgatcttggctcactgcaacctctgcctcctgggttcaagcaattctcctgcctcagcctcccaagtagctgggattacaggtgcccgccactgcacctggctaatttttgtatttttagtagagacggagtttcaccatgttggccaggctggtctcgaactcctgaccttgtgatctgccggcctcagcctcccagagtactgggattataggcgtgagctactgcgcccagctgtggtctctctttacaactaccatctagtttggttcttaatttttttttacttggactactgtaaaagcctcattccatcattgtcagagataccttaccaaatagccctctgataattttattcctctccctcttctcccacaactcaaaccttcagtggctttccattgcctgcagaattagataattaatggttttctataatacaacctactgcaacctactgcagtagtctaatctcccaggactctactaagcatatcaaatatgtcagccatgttggatccctggctgtttgctgaacaagcctgtataaccctcatgctgtacctttctcttccatagtcttatctcaagttctacctcctctgaactctttccttcctgactttaatgtggttttaactctttcagtgactcacattgtattttgtacatgctctgagtattctgccttgtatgacagtggctttacacttgccttgtctcctttactgtaatacaatctcactcaggtgaagcactatgtgccttgcagtaccacagagccttcctcattcccagtacagttcaaattccttaaccatggctacctctgaccacatccactatactagtctccttttactttctttacagctgtaattactggccttattgccttatgcttcaaactgtctggggttgggacattcatatacatatggattgctgtcagcttgatcttaacaggattttttttctttacactgtttcaagtctttgctcacatcttacctcctcagagac

SEQ ID NO: 86043 - DNA, 1431 bp, Homo sapiens
ctctggactcggcctcccaaagtgctgggattacagatgtgagacaccatgcccagccaggaaatactttgttgaattaagatctgagtttattgaattgaaatgtaagcatggggtgttgttactacattcgtttaggtaactcaaggtctctgacttggggaaataggatataatttttattcttagttcttttttctttttgagatggagtcttactctgtctcccaggctggagtgcagtggtgtgatcttggctcactacaacttctgcctcccgggttcaagtgattctcctgccttagcctcctgagtagctgggattatagtagagatgggcttttgccatgttggccagggtggtcttgaacttctgacctcaggtgatccgcctgtcttggcctcccaaagtgcctggtttataggtgtgagccaccacacccggccttgttcttagttcttttaaaattttttgactgggtgttgggaaagaatagacaagcaagtcataggtgggaaagaatagacaagcaagacataccatggctatcatggtagtattgaggcctgaggcaaaatgggaagttttatttatttgaaatgggggtcttggtctgtggcccacgttggggtgcagggtgcaatcgtagttcactgtaaccttgaacatctgggctcaagcatttctcctgcctcagcctcccaagttgctgggactgcagatgtgcaccactacacctggctaattaaaacaatttttttgtagagatagggtcttgctatgttgcccaggctggtctcaaactcctggcctcaagtgatctgcttgcctcagcctcccaaagtgcctggattacggatgtgagtcactgtgcctggtttaaataagacgttttagaatactgttaagacagctagaattttgtgttaaggagtttggtactgagaatatgagggaggggatttcccttgcttttttctatttgaggactaactataagacagatatatctggtcaggcatggtggctcacgcctgtggtcccagcactttgggaggccgagtgggcggattgtgaggttaggagatcgagactatcctggctaacacggtgaaaccttgtctctactaaaaatacaaaaaattagccaggtgtggtggcgggcgcctgaagtcccagctactggggaggctgaggcaggagaatggcgtgaacccgggaggcggagcttgcagtgagcgccactgcactccagcctgggtgagacactgtctcaaaaaaaaaaaaaaagacagatatatctagagaaccatcttcagcttgctattcccaaagttggtatgattcaggttatgatctgttcatttaaatgcaaggtttggagcctagaaagtgagggcatgtgagtcggggagtgagagagtgaggat

SEQ ID NO: 86044 - DNA, 7392 bp, Homo sapiens
tttattgaaataaaacttacagaggaatatttctaagtcctaggtattcatttttgtgtcctttgaaaaaactccctgggtaaaactgtggggggcacttcttaccctttgaagtcatgtagaactaaacacttatatttcctttgctaagactattcagagaaatattttcagttccatttatattagaaatcttactttgaatttagcttttcagaatataactcaaaactctgcaattgtgataaagcttgcttttattttagtttttggttctgtcttatttttaggtaatttttatgaggtcagttgagtttagagttggagattaggtagccaccagggggctccagtgaggagttgtaaaggttttgttggttctcttcctggtgaatcctctgaatactgtgtaatgttatctattaatttatttacagagctagaatttaggatctaaaagtagaagatcctgtcaatttggattatgtccctatagtttttccttcttacagcatttcttttcttttcttttttttgagacggagtttcactcttgttgcccaggctggagtgcaatggtgcgatctcggctcaccgcaacctccacctcccaggttcaagggattattctacctcagcctcccgagtagctgggattacgatcatgagccaccatacctggctaatttcttctatttttagtaaagacaggatttctccatgttggtcaggctggtcttgaactcccgacctcaggtgatccacctgccttggcctcccagattgctgggattacaggcatgagccactgcgcctggccagcatttcttaagagaactttggatttatataaaaacctgttgtattagcaattagttctctggagagctcagtttctcatttcatttcttttgctcttatgctctagttagcaaccttaatataaaacttgcagtaaccaaagtgatagaagatcttcagtacttaatatttactttgtcaaagctagcatgtcagggatacctgatggcgtgctagactgtctagcattgagtgctgctttaagtcagttactttgcaccttacctcactacttaggtggcagatagtagtaggggttcagagtgcctttaaataaagcttaaaagcgcttttacgtgttaggctaattctaatttcttttttttttaattaaaaaaattttttttaagactagtcaaagtgcagtagtgagaagcagggaaagagtagatcaggagctcaatctgtaactgactgtgaacaatcgagattactcattaccttcagaccagcttttatcccctttaatgcaagctaggttactgtacctgtttgctttaagagtgatgatgaattgattagttgcactgcttagaatctgaaagggaaaaagccagctggaccttttgagtcttaaaagcaactgctaggaatgaggcattagtgcttaggatgagaatttctcccctttattacctgtgtattatacattaccattactatttctaaccagggagaaatctgtgctttaaaaattcctaatctgtcatagaaatctacattccaggtctatacatgttgtttggaagttcttggtctctcctcagtaggtaggagtcttgaagatagagctcttttcctaaaaaacataatctaagcacaaaaatattttatgtgtaaaaagccaagttgatgctccattatgatataactattacacattgagatactgtggatcagacactaaatagagcaacatggataatatgtaaggagggaatttaagctgttctccaaagcatggtttgtgggaagaatttgaggacataatgttgcatgtactgtctctccttattgcaggtcgagctgtgtttagagtgcatcgaatgggccaagtcagagaaaagaactttcttacgccaagctttggaggtaggttttacattagtactcatttcaggtctctaagcatgagacagagggtgaatgtaagcagtaccatccttatcaaaagtatcttcagcaactttgtaattacctagataccgaaagattattgatggtagccccacttatgataattgctctgattgaagttttgagacagatttgctacttggctcagagtagtaagcaacaacatggtaaagttaacagtcatttgctggctataataggagacaatacattggctagatcgtctcttatgctgaatttgatgctatcatcagaaattgcatatttaacagtaacagttctgtgactgtcaatctttgatttctttctgtggctttttccccccccttcaatcaatgccttttctctttcctaggcaagactggtgtctttgtactttgataccaagaggtaccaggaagcattgcatttgggtaagtaagctggtaataagtcatctcagctagctaaatgaatgtattctaaaccacctggctactcttactaattacctgttaataatttatattctactgacttctaagaaggatttaaagtagcttacagttctgcatttgtcatgggaaaatgtcatttgaaagtttaaaaaactagctagagttaatctgtcaaatttagaggacaaatgggtagttttaagtttacttgaatttggagcagtaaaatcaattccattttaataactgaaatttaaaaaaagtgtatctatattttgcatatagtactctgttaaatttcagatttaggtttttaaaggcaaatgtttggcttactgtcctatttactatatctgcttatatacttaaaatctattttaaaaatcaagaaattaattgggtacaaatatatttggaagctggagtggctaactgaagcctttttcctgtgtggcctttaaacaccttgaaatcttctctgctttttttttttaatctatctatctatctatttattattattattattattttttgagacagagtcttactctgttgcccaggctggagtgcagcagtgtgatctcagctcgctgcaacctctgcctttcaggttcaagcgattctcctgctttagcctcctgagtagctgggactgcaggcatgtgcctggctaatttttgtatttttagtagagatggggttttgctgtgttggccatgctggtctcaaactactgacctcaagtgatctgcctgccttagcctcccaaagtgctaggattacaggcatgagccaccgtgtccggccactgcttgctttttatgagtgggtagatctggactattttttccgaacaaaagaacatggctcttatgatctattaggttgaagagtttccaatattcaatttttggactgcaaaagtggcaatttcatatggttcaaataggagcatttaaaaaataactttaataagatatggttcacttaccataaaattcacttttaaagtgtataatccagtggttttcagtgtattcactaagttgtacaaccatcaccactacttaatttcagaaagttttcagctgggcgtggtggctcatgcctgtaatcccagcactttggaaggccaaggcaggcagattgcctgagctcaggagttggagaccagcctaggcaacatggtgaaaccccgtctctactaaaaatacaaaaaatttgcaggacatggtggtgcacacctgtaatcccagctacttgttaggctgaggcagaagaatcatttgaacccgggaggtggaggttgcagtgagccaagattatgccactgtactccagcctgggcaacagagcgagactctgtctccaaaaaaagaaaaaaatttcagaacttttttttttctttgagatggagtctcactctgtcgtccaggctggagtgcaggggtgtgatgttggctcactgcaacctccgtctcctgtgttcaagcgattctcctgtctcggcctcccgaatagcagagattacaggcacctgtcaccatgcctggctaatttttgtatcttttagtagagatggggtttcaccattttggtcaggctggtctcaaactcctgacctcaaatgatctgcctgccttggcctcccaaagtactgggattacaggtgtgagctaccgtgcctggcctcagaacatttttatcaccccagaaagaaacttcctattcattagcagccctgggcgattactaagctatttgtatctttgtagatttgtctgttctgggtatttcttaaaaatgaaatgatacaatatttgtttctctgtgattgtcttctttcacgtagcattatgttttcagggtttatgttgtagcatgtgtcagtacttcattcctttttattgctgaataatagtcaattgtaaggatatatcacatgtgtttatccattcatcagttgatggacacttgtgttgtttctacattttagctcttaagaatactgctatgaacaggttttatgtggacatgttcttctgggtatatacctagaagtggaattatactgtgtcatgtggtaactgattagctgtttaaggagctgctaagtaagctgttttccaaagtggctgcaccattttacattctctttaacattgtatgagggttccaatttttccatatccttaccaacacttgttattttttaattttagccatcctaaatagcatttcattatgtttttgttttgcatctccctaatgactgatgatgctgagcatattttcatgtgctttttgctccttcgtatgtcttgtttttttgtttgtttgtttgtttgttttttcttttgagacagtctttctttgttacccaggctggagtgcagtggcgtgatcttggctcactgcaacctccacctcctgggttcaagcaattctcctgcctcagcctcccaagtacctgggattatgggcacgcaccaccatgctcggctaatttttgtattcttagtagagacgggttttcaccatgttggccagcctggtctcgaactcttgacttagtgatctgcccgccttggcctcccaaagttctaggattacaggcgtgagccaccatgcccggccttttttttttttttttttttcttgagacactcttgctctgtctcccaggctggagtgcggtggcacgatctcggctcactgcaacctccacctcccgggttcaagtgattctcctgcctcagcctcccgagtagctgagattataggcgtgcaccaccatgtccagctagtttgtatatttttaatagagacggggtttcaccatgttagccaggctggtgtcgaactcctaacctcaggtgatgtgcccgccttggcctcccaaagtgctgggattacaggcttgagccactgcgcccggcctcctttatatgtatgtcttcagataaatattcagatcctttgcttattttttaattggttatttgtgtttttattttttagaaacagggtctcactctgtcacccaacctggatggagtacagtggtgcagtcatagctcactgcagcctggaaatcctgggctccagcaatcctcctgcctcagtctcctgagtagctaggactataggcgtgtgccaccacacccagctcttgtttttattttttattctgaagttcttttcttttttttaagtttgttttaatgtcgggtacatgtgcaggtttgttacataggtaaacttgcgtcatgcagtttgttgttcagattttttggtgctcaggtgttaagcctggtacctattagttatttttcttgatccttttcctcctcccaccctctgataggccttagtgtgtggtgttcccctccgcgttcaggtattctcatcatttagctcccacttacaagtgagaacatgtggtatttggttttctcttcctattttagtttgctaaggataatagcctccagctccattcatgttcctgcagaggacgtgatctcgttcttttttatggctgcatagtattctgtggtgtatatgtacattttctttattcagtctgccgttgatgggcatttaggtttattttttattctgtatacaagtcccttaccagatacatgatttgcaatttttttttctttgttctgtgggttgtttttttccttcgatgacgtcctttgaagtacattttaattttgatgaagttctgttacctgttttttgttgttgcttatgcttttggtgttacatctaagaaaccattgccaaatccaaagccacagggatttatttctgttttcttctagaagttttataggtttcactcttaaatttatgtctttgatccattttgagtcaatttatgtatatggtgtaagtctgtttgaatttgatattctagtttgagatgggggagtcagggaagaaggtatatttggagaacattggtatatctagaactctttacttccttcatcaacctagtgccccagtgtttcttatatagccttgtgattgctagacaagaagagagcgagattgtgtctttctgaactggataactagatttagcattttataggtagagattcccactgtatttaaatcttaggagtaagctcataggactgttggctctaatattgtccttaggaagcagaaaacttcaaagaggtgtgtttttctcttggaagatagcacattagtggaaaatttaattattgcatggggtctagaggtaaccttttttgagttcaggaatttttttttttttttaatcctgagtgttatgagggtgggagagtgagctattattaggtattaagctgatggctataaaggagaatgtcttttcctttttcaggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtaacagacgtagctattcctgggatgtgttttcttaaagctcatcttattttataggtggaaggaatgggggttggggctggagaataaaattggctgatttggctctagcttcttcagagaaccagttagaaagctacctttctaactagctgctcccctcctgttaactgcctaaaatgtattaagaacatacctatctgtggttgaccaggcaatctgacttttagaaccaaacttagaaaggtcgcacgtagaagactcccttagctcttagccacttactcagaatagtagcattttcctttgggattggcctaccccaagtctgttgactcttggagatctttgtaaagttggttgact

SEQ ID NO: 86045 - DNA, 1470 bp, Homo sapiens
aaggcttcagttagccactccagcttccaaatatatttgtacccaattaatttcttgatttttaaaatagattttaagtatataagcagatatagtaaataggacagtaagccaaacatttgcctttaaaaacctaaatctgaaatttaacagagtactatatgcaaaatatagatacactttttttaaatttcagttattaaaatggaattgattttactgctccaaattcaagtaaacttaaaactacccatttgtcctctaaatttgacagattaactctagctagttttttaaactttcaaatgacattttcccatgacaaatgcagaactgtaagctactttaaatccttcttagaagtcagtagaatataaattattaacaggtaattagtaagagtagccaggtggtttagaatacattcatttagctagctgagatgacttattaccagcttacttacccaaatgcaatgcttcctggtacctcttggtatcaaagtacaaagacaccagtcttgcctaggaaagagaaaaggcattgattgaaggggggggaaaaagccacagaaagaaatcaaagattgacagtcacagaactgttactgttaaatatgcaatttctgatgatagcatcaaattcagcataagagacgatctagccaatgtattgtctcctattatagccagcaaatgactgttaactttaccatgttgttgcttactactctgagccaagtagcaaatctgtctcaaaacttcaatcagagcaattatcataagtggggctaccatcaataatctttcggtatctaggtaattacaaagttgctgaagatacttttgataaggatggtactgcttacattcaccctctgtctcatgcttagagacctgaaatgagtactaatgtaaaacctacctccaaagcttggcgtaagaaagttcttttctctgacttggcccattcgatgcactctaaacacagctcgacctgcaataaggagagacagtacatgcaacattatgtcctcaaattcttcccacaaaccatgctttggagaacagcttaaattccctccttacatattatccatgttgctctatttagtgtctgatccacagtatctcaatgtgtaatagttatatcataatggagcatcaacttggctttttacacataaaatatttttgtgcttagattatgttttttaggaaaagagctctatcttcaagactcctacctactgaggagagaccaagaacttccaaacaacatgtatagacctggaatgtagatttctatgacagattaggaatttttaaagcacagatttctccctggttagaaatagtaatggtaatgtataatacacaggtaataaaggggagaaattctcatcctaagcactaatgcctcattcctagcagttgcttttaagactcaaaaggtccagctggctttttc

SEQ ID NO: 86046 - DNA, 1079 bp, Homo sapiens
ggttggcagtagtagcaggttcaatcaaagttaagctcattgggagcaactcaacttctaagcaataggggattggttaggtcaactatggtatatcagtctgaagaaatactgcttagccatgtataattaagttcatggatttggcattatgtgaaagctgtacactgagtgcatttaggcaaaagcacatccacaaatgataaatatttgaaatgaaaatataagatgttggattccctctcccatgccccatgacagttgcataaatataaaactatcaggcttagaaaagctatcttaaagtagttaatattattagaacaggtcattcaggcagtctagagatgtttaggtcaactccctgacctgtgaatgtgatgtcatggagggtaaacatggccttttcctgtggctccaaaagatagcaggactggaatggtggtgagaagcatggaagaaagatggtacagtatgtgtttttcaggtcccttttaagttgagtctctaactcctttgggaacttatattggcaatatgacattgagctgggaggtcagagacttggattctcatcttctaatctcagctgtcaaattgctgactatggtgactttgggcaggtttttttttttttagacggtctcactttttcacccatgctgcagtgcatttttgctatcacagctcccatcgctatcatcagcctcccaggctcacgtgatcctcctacctcagtctcatgagtaagtagctggggctacaggcatgtgccaccacgcctggctaattttttgtagagatggggtttcaccctgttgcctaggctggtcttgagctcctaggttcaggtgatccacctgccttggcctcccaaagtgttgagattacagatgtgagccactgtgcctggcagagcaggttctttatcctttcctgacctcatcagtaggttggtggagttgacgtagagtttttttttttttttgagacagtgtcttgctctgttgcccaggctggagtgcagtgacgtgacctcggctcactgcaacctctacctcctggattcaagtgattct

SEQ ID NO: 86047 - DNA, 3116 bp, Homo sapiens
tagaccttgttcagtgccttgttccaaacctagcagaatgaatcttgataaagcacagatataatagggtctaagggcaagaaggagtttgggtggatgtggcgataacaagccttggaggaagggagaagaaatcacagttctcttgtcatttttccttttagcttgtcatctctagagaatgctatattagggtcggtctgtttggaaaatttctgtttcctagtattattaagtcatttcaggtttcaaagggaaacaggttggcatatagtggtattcagtacttgcggctcttcttcccgggcgtctgaagaagaacgatggtggggcgggttcttccttttggcagaagttgtgtggacacagcatactgcttatgagacttgggtaaatgttagtgtgcagaataaatcgctttcatggtttgtctctttattctcagacagaagcattaaaatgcgtggctcaggctagcaagaacagatcactggcagattttgaaaaggtgagtatgatattgggttggtatggaatgtgagtggaagagagggacgtttaagtacttcaaaacacacttttaaaaataattatagtttcaaaagaagttgcaaatgattccatgtatccttcacctaggacagtattaaaaccaggaaatagttaagcactttgtacaatgaaacttactgagttgatataaaatatatattatttatacataatacctttctatttcaaaagttctttctgtccttttttcactttgatttttcacaacacacctatttattatctgcattttatggttaagggaactgggattcaggaggacactcaaagtcacacagcatagggtcagagtttgactctaggcctagtgcttgttccacatgacacagttgtaggcattccttcagctccagaaatgccaggtctgctcctctgtggacagaagggaagtcttgatgtgcgtacttggacccaaagaaacgtcctcagggtgatgatctaggctttctttaaccctggtgcattttgctcattgtttgggagttttgaaaagggagaaaagcctgtctgggcattagggtgagaattatatagtctttcctgaacctctctccttttagtctgagtataatgatcaacttaataaaaacaaaacctagatccagagagaaaaacttagtgtggatggagactagaccatgtggctttgactgtccctgagattcaccatcttcctggagggctcttgccaattcctattgcgtcttacttggcatgattcgcctgcttcccttaacaccttgtagcacagctgacatgaggctgggatgttgagaccattactgatggtccagtaaatcacacacatgaatacttggtctagatcattttatcccaatgtctgagatgtttgatgggacacttttattccaaatagttccttggaagaaggattctgtgattagatatttgggaaatactagggctaaacaaaatactagggctaataataattaaaacacctaattttgcttaatcattgcagagccatgttatgctgatggtcctcataaaactcccaagagctagttgtggaattcagcatttcctattctttaacctcaatgttctttttttcccccccatggagaccctatttattctgtagaatacatgctgagaaatgcttgtgtagctaatttggttcatgagctgagttgctcttggggcttacatggtttgagctgttcacctgaagcctgcagacagaaagatggtccctagggtgactccacctttttgttctattttgtattttttttttctcttagagactaccataaaatagcatttttaaaaatttatttttagagatggaggctctctgtgttgcccaagctggacttgaactcttgggctccagcagtcctcccacatgagcctcccgagtgactgggactccaggtgcgtgccaccaagccaaacttccctttcagttcttgacattccttttctgctttgtatcatgcatctccccagatctcccctaacttcattcaaccatgtagttttataagggccagcagactatctaggaagcaggagtagcatgactttaaagtgattctctgtgccaatctctgcaactggttcctttggcaggctctgacagattaccgggcagagctccgggatgacccaatcatcagcacacacttggccaagttgtatgataacttactagaacagaatctgatccgagtcattgagcctttttccagagtacaggtgagaaccctctggggactccatttctggccaggcattctcactgtagccacctcccttccacacctgtccagaatgggaactcacttctaggggtgtgcctggtgggcaagaggccaccaagagcttgggcctctgttgataaaatgaacaaaaatcgaggagagagatgctgtgggtagaggcatgtgggttgcccctgcatgtgttctgagcagtttcctcctcgcttttagtcactgcatgtgttgtacctgttttctgtattgggtgtgtgggataagagtctgtttattgtgtgtagcagtgaagggcaggcagatgggcagagaacaagagacttaagcacggccaaggagggtcttacattagaattttgagaaatacagcagttctccccctgttccctcccttctcttattggaggcaaaagtaaaactttcagtgttggtgtctctctgcctttccttttagattgaacacatatctagtctcatcaaactctccaaggtaaggagtcttaaggccatctgcagggaggaatgggacggggtggcgaggaggggtggcacatgcacctgattggcctcattggaaagctccccagcttctcagtggggaatgggcagtgtggactagagtaggagttgcattgttgctattttgttttcagtccatttggcctaagacccctccaacaaagctactgtgtcagggtgatctctgactagtggatactggtccctttaatcatgtgctttgattttaggccgacgtggaaaggaaattatcacagatgattcttgacaagaaat

SEQ ID NO: 86048 - DNA, 2443 bp, Homo sapiens
tttattttcaaagaagatgttctatttgtttcccccgatggttcaccctggggtcctggcccctcttccctgtgatgagaatgtgtaataagcatgtgtacatggaatagggagatgaattctatttcccttcttttctggacacagtgagtcaactagggagtgggctgcttcacaaacacttttgtgtctaacctcatcttttacctgggttgcccttgtgtttcttgcagggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataatttttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtga

SEQ ID NO: 86049 - DNA, 1063 bp, Homo sapiens
acaggcaattggtgagggtgaggcatcgtgagactctgaggctggaaggaacttagagattccagccaattcagcacagtggtcagacttaaacagaactcatccctaattgctcagttactgctctgtttgtaaagaccagcagaggaatatattccacagttcccttggtgatttatttaatgatcttaaacatcctgctcaggaaacttggtcctatttctaaccaaaactgcatctgctgtggtttcttctagttctcagagactgtgggaagcagctgtccccatctagtgacttgccctgtgataccttcacacactcatcctctgaccttttatctctcctttattcccggatcttattttctggctctttaatatattcaagttatacgtgctaaagatcagcaacagttcaaaagctctcggagcaggatgactactgtgttgcatttactttctcagtctgtaaagcaactggaaattcagatttaactagagaggagagttaccaatcattgctcatctctccaagactaatgctttgggagagaaaaggcattatggaggcagggaattcacactcctgggcgtctcccattgctcatccagtgggaggtgacggttcccagtctcagtctggggcacttcctttcacttcccctgggtgttcaccattgtgaggaacaggttagatggggaagagctgcacaagaatttcacacagtgtcttttctgtggcagatactattgcagaattggtcatgcaggtctgagaacaccacatgtaagttaaagtacaagaggcctgtgtgtccttgggcccagtgcacctgcaaacacttcctcgattagtcagcgcttagctgacttagtgtcttggcctagagcaatactatccccaattaacaatggaagtgaaatatgcccattgctgtcttcacccagagaaaatagattgctcatatattacttcttccatacactcacatggaaatcagctgaagtttctatgacaccaggacagtcagcagctctgccataaaacattttagtcataa

SEQ ID NO: 86050 - DNA, 1016 bp, Homo sapiens
ctgtagtcccagcactttgggagaccaaggcaggaggatcacttgagtccagcagtttgagatcagcctgagcaacatggtgagaccctgtctctacaaaaaaatttaaaaattacctgggtatagtggcacacacctgtagtcccagctactcaggctgaggcagggaaggattgcttcagcccaggaggctgaggctgtagtgagctgtgaccattccaccgcactctcgcctgggtgacagagcaagaccctatctcaaaaaaagaaaaagggaaaagaaaataaaaaataaaaaacattgccactgttctgaaaacagtgagtagtccagagtggcaagatcagagattgtgttgagaggagtggcaagaactaccagaaaggtatgtagatatgaccagattgtcaaggaacttgaagggaatgtaaatgagtctgaagttacgccaaagcaggaggaagtcatcaaggaaacatgtagagtgaaaaggggccaggatggacccctaggcaattcctacatgtaataaatgggaggtcaaaaggcaggaggagacttaggggaagtactctcccagaaagaagacaacaaggtcaaatgcctccgcattaaaggagacctagccctagagcagtccctttgatttggtgacctttgaaagcaccttttgtaaaagcattgagggtaaaagccaaattgcatgctaaaattaataaaaagattaaatggaagtatagtctgatctttagagtattatctctttctattacaaattctgttatttcaaactcaaaagctaatttttcatactgcacaagttcaggaaacccagttccgaggatctgttctgtaggtgagaacctgaaaatctaactgtgggtatgtcctaaactcggccagctagtgctgattcccagatgagcagggttctgaagttattattctatcaggtgaaagtagtaaccttgtaaatgtgggtgtttgatcctgagaagatggggtatagtttcct

SEQ ID NO: 86051 - DNA, 1149 bp, Homo sapiens
ttagtgtaaatctgctcagtctggttaatttctttctcatgcctcagtggcatcagttagaataaggaatagagaatttcatttttgagaaataactttacagtatgttactgttcagggatacggcagacctgggatagagaactgaacccttgtgggaagggacgggcagcaggtagtataaggttagttcattcttggggaggcaggtcctgatgacagagaggggagggtacctgacgaaaactttgctcaattaaaaattgtgtctctggtttatctttgggtctagaagagagagagaatttttttttcttcttttattttatgctcaattacagaacttccaagacacagcacccagtgtgtgtggtgaatactgtggccctaacatttgggtttaagggacattactgaggagccaggtgcaatgacccatgcctgtggtcccagctactggggaggctgaggcaggaggattgctcaagcctatgggtttgacactatggtcacgcctgtgaatagccactgcactccagcctaggcaatatagtgataccttgtctgtaaaaaaatgaaaaataaaaagagagaccctagagagccagactatgactctaatcatggttttcaacattcttattgaaatagaatggtctggttttggaaagtagatcattttttaagtgaagggttccagtaagtgacttcagttgatggagaagggaatcaagaacatctgctagttcctcttgatattttgtccaccttccaggctcctcattgtcctagcctcattcctgaagatatcccagtttgtattccaggcacagctgcccacatgggactagttacaattatcccagcatgggattgcctttattttcccacatttctgctccttgatacacaatatagaaatggatttcactttaatgagattaaagcattaactctagtaaagctattctgctttaataaaaagattgtttactcctgaacataggtttttcagaaaaagccacaggccagttcagagttctaaaagaacctcctggaatagatggataaacacaccaaggaacaaacacagctttccttttattcctcctctcctcatatctctcacagttatattgttaagtcttg

SEQ ID NO: 86052 - DNA, 1755 bp, Homo sapiens
cgaagaggtgacatctcaatgaagacctggagaaaggtggaattttctattgatttaaagaatagttcaagaaaacaacatcaggaggctgagacagaaggattgcttgagcccaggagttcaaagctgccgtgagctatgatcacaccactgtactccagcctgtgtaatagagcacgaccctgtctcttagaagaaaaagaagaaagaaaacagagagagacagagacacaaagagagagagagagacagagacagataaagaggaaggaagggaaggaaggagagaaaagaaaaaaagaaaggaaaagaaagagaagataaaagccttataaagcttaggtgattatttgtcaagtaattatagaaattgttctggaagttcagaagagagagagataccttaggttgactccaaaacaccttatagaggaagagaggagttgagctgagttccaaaggatgggtaggatttgtaaaggtggactcgtggctggagagcattccaggtggattaagcagcatgagcaggggttggcggcatgaaagctgactctgggtgacagtgaataagttaagttgtttggaagggaaggggttggtgttgtggagaggtgggaggaatcaccagctctccatatggccattggctaaggcccaggtttttaggtctacctttatacccaatctccacatcattcaaaatcctgggtgtacagatgtatatgtatttgtatgtatctcatctgtgtgtccttgatgactctgagaactggctgtggttctcattgtacagatcagtgattgttcatgacttacttatacattaaaatagttggttccctgtagccataaacacagtgccagcaaagggtagcacccttaccctcctctgaaactataaattctgacccagacagaaaacagtcctctctttcctttcactttgcagaaggtgaccagaaacccaccactgcgtaatccaggtgctgttctgtgatgttgaagtgtttttgtctcctggaatattggtggttgggcacatatttctggttgtatatagctgaaattgagcgtgtttggtccattggtatatatggatgtgtgagtgaaattcccatgtgtgcttgtacctcatgactcctgccctcccaagctgtagttcctgctcttactccccagtctggaatgtcctgtcctcccttcccacctggctcttctgcaaggcctgcttccttcctttaagtcatgtaatagtcaagcactcaaggctgcaggtgcttcatgggtctgtgttttctcaacagcagcacctagcataatgctgggtacagagtacattccttcatgacaacatttttttgtagagagggaaaaatgcttgttacttttttttttaaaagcttatgtggcattgtccttttagaattatcttcttgttttgctattaatctggccttctttttccctcttggagctaaagcttgatttttagacaactgccacaattgatgcaactttctcctaccatttttacttttaaaaattgacctaggccgggcgcggtggctcacgcctgtaatcccagcactttgggaggccgaggcaggtggatcatgaggtcaggagatccagaccatcctggctaacaaggtgaaaccctgtctctactaaaaatacaaaaaattagccgggcgcggtggcgggcgcctgtagtcccagctactcgggaggctgaggcaggagaatggcgtg

SEQ ID NO: 86053 - DNA, 1080 bp, Homo sapiens
gaggcaggcttcagttaaccatgtttaacccagccatctccaaatttatttgagcatggagccaactttaaattgcatacctaccaacatcctagggaagggtgtgcagtttggggaatactagtcaaaaagtctatctatttgggcttttgtgcaaagtccctcatttcctaggaaacctgaccctattttctttttttccctaggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaagtgtgtagtt

SEQ ID NO: 86054 - DNA, 1078 bp, Homo sapiens
caagtgatgcaagcagaaaagggaatatccaagggtatgcaaggtagaaaccaaatggtgcaaccaggaaaatatatccttgaggacaaaggagggcatgaggatggcaggggcaaagttcaaggctaaggatttgagagtcaagaagagtgagaacaaggattatccagtaaagacatgcagatggacaggcagcctgggtgagctgagagcctgagctactagcctaggtgagctcctcagtactgtcaaaagtaaacaaagctggacatgggttgacatggtgagggcagattttaatcaattatttacttttgcagtagggaagagggtgcagcatgaactgaactcaaccccaattcatagagagggcctgggtgtttcaaagagagaatgagggagtgggcagaggcaacagcaagggcttgagcagcagagtcagagaagtaaaaaaatcataaaaaacaggaaggggcttgggtgctggtccctgtgaaaagcatctgggtttgctaactggtgcttattgaagttagttaggctcctaccctcccacagagacggggagacaggggccctatattcaggtgttggctggagcaaagagtaaattctcttggcagcctcgagttttctcaggcaggcactttaagaggggatagaggtattctagggatatgaccttgggctgttagaaactatgatagtgtttgttcaagtcttcataggccaactaagggtgaggcttagaagagaagagggctcagaagagcctggctagagtctggtcaaggagagaaaatcggtcagcactcccttctgttgtatgagtaaacccacatcccttcaaagaaccaggaacaggttagactcatcaatatgtgtataaattctgtgactttctaaaagtaaattgttaattagttgtccatggcaaatctgactttgtggcttgttgaatgtacctacccctactatgatgaattacttacttgtgttgacatctctttgctatctacattgttattagcagcagaataagtgaacaacattccttggaatccagtgtgtaacttct

SEQ ID NO: 86055 - DNA, 1031 bp, Homo sapiens
tgagccctattgtgtgccagcaatgtactaagcatgagtaagcagacgtagtcactgagcccctggagtctaccttccagtggatgctgctggactcaggcgggaagcagcacagtgaaaggcaggaggaataggtggagggcattgcaaaagactgggtgtggcaggtctgaattctagcctaaagagcgtagggatctctaatgggttttcagcacaggattaatgtgatagggtttgcattccagaatgactcacagttaccttagaggatgggctggagaaggtcatctggaatcctgaagtccagctaggaaaccagagtgatgcagtcaaaaaacgcttgggtcctaaatttcagcagtaaggaagacaaaaggctaaattcaggacagatgtagagaggttattgataggctctgctgcctgattggtcctctgggtcaggagtgggcagcaactctgagggcctgacttgaaccccttggcagatggcgatgctgttccctgggacagaagtgcaagagaattgtccaatggggtggggaagctaaggaagatcagttccctctggacaagctgagtgcccagggtctgcttgaagcacatctcaaaggtatgcttataagacaatgagtgaaactagtgtgtctggaggccagaagagagcccagggctggaggtgtggactgaagggtcaggagtttacagatgacatttaatgcctggaagtgaacaggacctcccagaggtagtgctcagaggaagaagagaccagatcctactgcaacaaaccccaaagggcatccagatttgctctttgatgccaaaatttcacttggtacaagtcaggcccacagccaggatgaaaaaccactggttcctgagagcggtgatggtgatgggctgtggggactctgacctgctgtcagatttctggggtctcgccaatctctggacccccgtctgaagttacccatgtgcttctctctctctctctcttctctccttcaggtgtttacaaaatatgg

SEQ ID NO: 86056 - DNA, 1044 bp, Homo sapiens
taggaatgcagagctgaataggagacaaccttgattgtcatggagcttccaggccaatgaaaatgaaggagcaatgactcagatcggattcatccactacttgtctgatttccatagtatcttcaggagagtgagttttctggaagggtaggggtctaggtacatgtcctaaagtcatgatagatacccatatagtgggtgtcccagctccccaaccctcatgagctctgggctcagtgcacaccacaccttctcctctggttatgtcaagtttctcccccaggctgcttcttgtgggcccagaggttttccaccttggaattatgcatcggtcaccctaggcagccctacattttcttcctaaaaacacagggtattaaacccctactatttaaattaggactctctcacttacacataagagaaatctaattctaactggcttgggtaaagggaggagtttattggaagaatgctagggtatctcacagggttcaagtgctgttgagctcttggaagacttggaagcaggatggagtgctgtagggactccacttttgcttttactgctcacaagcacccaactccttcccatccccttctcttccctatcccacccgctctctctctttctcccccactcttgttctttccctctctcaccatgggccccctcttctgccctcattgcacagggacaagacagggccagccatattcctgatattactgtacattccatgttcccaaaaagaaactgagcagtctctaaacctgtttttttgtttttgtttttgtttttcgtttttttttttgtttgtttgttttttaattccagaaaagtaactgattggcccagcttggatgaggtgcccaccccggaccaatcacatggctcaggaaagtagggtcttataatatgactattgcccagggggagttggttcccagaaaatggaagcctttcctagaaagagaagggttgggcatcaagtgggaccatattataccagaccatgtttactacactgaatgatgcaccac

SEQ ID NO: 86057 - DNA, 1014 bp, Homo sapiens
gcctaccacgcagggatgttttgaagatttgatgacatgacacatatgaaaaccctgtgcaaatgaattgtgggtatagactttagatgttattatcatcattcagcaagtgactttacttgccacagccttagcttcttctatctgtcaaatgagaataagaatatttgttctgcttacttcagacagccatcaatgctttaaatgaaacaaagaatgagaaagcgctaggataaagcgccgttcaccacttccgtccgtcctcttcgcactaaatgaatcgcttaaggacggggatattgtgggattctcctttataagcccttctcctcagactgagtagggtgcctggcatatagttaatgctcagtaaatcctggttgcatttaatcaaaacccacatccattgtcattgtgaaatggtcagggcgggaattattaaacacaattgacagatgaggaaacaaagcctcagaaaaagggcaggggagtgatgctgctagaaagggacagagccagaaggaggatcctatggctccccatcccgtgagctctccactaccaccttggaatgaccattgtggggacactcaaaaatcgaacaaaaatattgatgtttcctaggggcaaaccagcctgctgatcttctggcaattctgatctccagtaactcatccaggatcagtttaaaaacagcttctccaatctagaggtgtctgggtaaccctggaacttcaccctgtagccactttatttgtatcccctcagagcctcccttccccaatcagagaccagggccatggaaggatactctgccttggtttggacacacagctgagtgcttgtctggggatagaaagcggaagacagccccatccaagcagagtcacgggacaccaccaaccacatctgagaggcctatactcataattcatcagtaagaaatcccttcttgggcatggctttgggcttggcttgaccttgggttgaccttggttcaaatcccagtgcctc

SEQ ID NO: 86058 - DNA, 1042 bp, Homo sapiens
tttcacaaagtacactaattaatttggttgataacctcaaatgtttggatgcttgttgacttttcctttaaaaataactaatctgctcttaagggacatacattagaaaaggggggccgggcatggtggctcacgcctgtaatcccagcactttgggaggctgaggtgggcagatcatttggggtcaggagtttgagaccagcctggccaacatggtgaaacccccgtccctactaaaaatacaaaattagccaggcatagttgcacacatctgtaatcccagctactcaggaggctgaggcaggagaatcacttgaaccctggaggcggaggttgcagtgagccgagatcacgccactgtactccagcctagtgacagagagagactccttctaaaaaagaaaaaagaaaaagaaaagaaagaaagaaaaaaaaagaaaagggggaaggagatggttgtctgtgttttggttcagttctgtgagaacaggttggcatctaaaatagggttaattaggccttttagtacatcaaagcgtttttctgaacatggctctctggtgagaatctgatttcctagtatgaacccggctccctgatgtgaacctgactccctagtgagaacaaggctacctggtaagaaactgggcttctggttagaattgttttcccttgtgtgatcctggattcctgatgtgaactggctatctagtatagactaggtggtcaggaaaagtttgttgtaggaatgaatgaatggctgattgatgaactgattgattgagtactgctagactgtagtttcattgaatagtattttgcacaagatgctctcttttaagaaacatataaatatattgactagattacaaatccccatgctacaaacattcctgtttatttatgtgaacagcaggccagcattaagccaggggagtggagaaagctcttgttggagcagaggcaagagacaaatatcctctcaattgctctgcttaattctctttttaaggaagctttattgagatataatttgcatgcc

SEQ ID NO: 86059 - DNA, 1021 bp, Homo sapiens
ctgtcccgcctaaagaaaaccaagagtacagaagcagcacttggtaagcgtgtgcaccggaggtttctcttgacaatctgcttcataaaataaaataagtgtgtgtatctgtgtgtgtgtctgtttatgtgtctgtgtgtgtgttttctgtagaacgagggattctttttaaagagctagcacctcaagtcatctgacattggaatttgagaccttctaatcattattgtgaaagcaacgtcagcctacacagcatgtgtggcctacatccacccagcctgatgccgttcagaaaaaaaaaaaccagttgaaaggcagatgtggagacttttgtgtacagaatacctgaatggctgcttatgccatgtgtgtgtgtgtgtgtgtgtgtgtgtgtgtgtgtgtgtgtgtgaatttccaattccgtaacctcaagtgtcatttcagtttttaaattctggaaagagttcgtgtgtatgtgaattgtgtcagatagtagaattcaactcaggagagagtgacacacacggtggtgtagtgtgtgagttttctgctgctagagggaaaacctcctagcgcatgagggcactgtcgcacagccaggcagtgtgggggttgggaaaagaggatttgggatttaggtggagcctcaacataggctttggctcaagatgtcaaatcctagtatgttagaagggagctttgggaatcatctagtgtagctgtcttcaactgatgaagttgatggcttacccagaccgctgagggtatatgaggaatttccaaggggtgcacaggcacagaaagtggtaaaagaatccattcccagactgtcagtttccacgtggtctccagggcacgtagctggagtctgccaggacaggccttctcaggtctcccttccaaagcccccttcccccacttcacaagtgaaagacaggcctcactccctctaggggacattgccctgaggggtgggcatctcttggtgcccaccaaaggggccatacaagaatgcatcgct

SEQ ID NO: 86060 - DNA, 1027 bp, Homo sapiens
tctgtgaaatctgggtttgatgtactagttacacttattctaataatcattatgaaatgcatagttattaagaaaacattgtgtccatcaatgtacaacttcatcctctaagaaactctgtcatcagctgctggtttcctgggaagagccctgcatggtatctctgcctcaaatgcaggggtgtgtgagtgtggaagatgtgtgcacacacatgtgggttttcatcagtggatcatgtccatctggccacggcaacagaaatggcatgtgcttctgatttctgccaggtgctccagtgagctgggctggtgtgcaggagtgagggtgtggcttgcaggtaaaccaagcaggcagtccagcaatcacctctcgatccagatctcttactccctgcccaccttccctgcacaacaacccccacaaaataagcaaagtgccctggaaagaaccttaaccaccattgatggaaacagaaataggtgaagtgtaaggaggactgagaaggtatgggcctcagcaagaaaaataggtgttttatggaggcgattatacactaaagtggaatttgtaaattgaaaactcccggacgtctcgggattactctcatgaatgtcaagggcttaaggctcttatgtttatcgagaggcagcgaggagtgctaggatgtacttggctgtggaaccacacagactgggtttaaatcctatttaagtcatcctgagaagttgtttaagtccttggagcctcattttctttatctgtgaaatggggataataatatcctctatccagggttgcattgaagattaactaggaaagaactggtcatagtgctgggctataaaacacaggcagttgtgattttcctaaatttctgaaagatcatggaagactttctgattcattgaagagagaataaatctttttttttttttttttgacggagtctcgctctgtccccaggctgaagtgcagtggcgagatctcggctcactgcaagctccgcctcccaggttcatgccattct

SEQ ID NO: 86061 - DNA, 1045 bp, Homo sapiens
ggtgagtggatcatttgaggtcaggggtttgagaccagcctggccaacatggtgaaaccctgctagtactaaaaatacaaaaattagccaagtgtggtggtgcatacctgtagtcccagctactcgggaggctgaggcaggagaatcgcttgaatccaagaggtggaggtttcagtgagccgagatcgtgccactgcactccagcctgggcaacaaacagagcgaggctctgtcccaaaaaaaaaaaaaaaaaaaaaaaaagatttctttctaaatagcattttgtctaattattaattagataatcatataaaatgtacataatttgtaaacataaaagaagaaaataaaaattccatagaactccccaaccagtggtaaccactattagcatgctggtgtattttctttggctctgtttgctgtgcacccatgcacgtgtctgtgtggggattagttaacaaaaatgaggatatttagcatgttttcttccatcctgctttcttgacttactattacaatgtaagcattattcctgtggatcaaatatccttttaaaatatgaagtttgaaggtaattttaaaaattttaagttaggttaggttttacatgcctacaaagtgggagagacaatcagggaagacttcatgaaggaggtgataccttctgaaggatgaatagaggtcaactagatggagaagaggggaaataggtctaccaggctatgggcaaaaactgtatgggcaaaaacctgggggtaagaggaagctgggtgcatccaaagcctgcatgaggcttgacggtgctagcctattggtttggggtagcagaggtatatagttattggaaaggcttcagccagattaaagaacttcacttttgtcccaactgaagtatttcatccaagaagggaagccaagatggtatgatcatgtccgagatatacattttaagatgatcacattggtgacagtatgaggacagggacaggggaggcacaactggaggtagagagaggattataggtttgatagaaagtcctgg

SEQ ID NO: 86062 - DNA, 1069 bp, Homo sapiens
gacttctggcttcctccctgacccacgtctgggctctactccctcttgctcatggttgcagccactaagacctcctctgtgttccacaaacattctaggcaacaaactcacctctactaccacctcagggccgctgtacttttccttccttctgccaggaatactcctcctgtgttcatctgcctcctcgctccctcacttcatttagatctctgctccagtgcacttcctgggagcagccttcccttacctcatggcaccaaattactcactcaactccctacccatcctccttctctgtcccttaccctgtgttattttgctccacagcatggatcactcctgactcttgattaactgatggattaatgtctgtgtccacccagccctcagtagaatgtaagcttcataaaggcagaaatgtaagctttctgcattcttgaccccatatccccaacgtcaagggcagcacccagtgtaactagatactcctaaagatccgttgaattaatgatgctgtgaacgagtagattaatgaattcacgtaatgaatgctgtgaatcccatgaattaatgaatgcacgtgaatgacacctacctgattacagttgggaagactaagataaagcatgcaaaatactcagcatggttcctgtcacataaaaaatcatataacttgtttatcaagcacttacaacgtgccaggcatgatttaagcaccttgcacacactaatgtagttaatgctgaaaacaatcctatcaggtagaagctaatattataatgtaatctccacctagcaagcaaggaaacataagaacagagagacaaataacttacctaaggttacccagctaggaagtactaaagccacagttctaagctacactctcagcctctagcctatcctgcctcttgggacatgagtgctgtgaaggaagatgtggttgtcattgctgttgtacctgtgttctctgaatgtcacaggaccttgataccacacacctgccttgctcaggagatggtacctgagaaggaagggctaggttgtgtgcatggagagcccagcc

SEQ ID NO: 86063 - DNA, 1410 bp, Homo sapiens
gactttgaccaagctctaacatcctggatccttagcttcctcctctgcgtagcattattgtgcagtttatccaagatgttgtctttaaagtgcttagcactgggcctggcatagagtaggtgctcaataaacagaagctgtttgtattcttcctgaaactgttcaagtgagtagagtcatcgtcagtaagacacactacagaagggctcaggttaggaagggaagatttcatttgggcaatccagcctttgtcagggttagaaatgaagttgtctttaaggttcagacaggtgatataagaaacagacaggtagaagtggataggagcagtaacaccactggccggctggaccacacacacccagcctagaggcatcctaggttaaaatgtttaaagctccatgcaggctagatgaaacccattctcaggcccagaacagctcacatgcatttgggactccatttagatgatggtagaccagagaagaattttaaacagggtgtatggattgacagtatcaaatttgcatttcagaaagaccactctggcagcaaggcagggagaggatagaagggggtgcaggtctagtccaaggcaaggagagaagccagggaactctgtgctcaggtgagaggggactgggatgaggaaatgggctgattataacataattagctctataatcagtatggaggcttatcatttcaaaatgtaaagatgattatatgattaaaggcttttttccttttaatggaaataacttgccaacctgggggtttactaggtgggtggtcggagaaaaaggtaagctattaatttttaaccaattgactttgcaatgaattagtttattgattcaaaaaaatcgctcattgtagacagtaaaagttataaatgagattagtgtctagttagagtgaatgctaagtgaaggggcccaggaggcttccctcattcaactgaagagaagtcttgcatggatggagcagagaggcatctgggctggcccacagagcctgctgggaccaagcacatggctggaggcagtgggctcagatacggaactattcctctgctctccctaaagaagtgattgaactttaagcaatgaggtgatctaagctgaccaaacacagaaactagttttactaccattcctagtgtttttaaatgcacaaactagaaaaaggaaagaaggaaggaaggaaggaaggaaagaaggaaggaaggaaggagggagggaggaagggaggaaaggcaggcaggcaggcaggcaggcaggagggagggagggaaggaaggaaggaaggaaggaaggaaggaaggaaggaaggaaggaaggaaggaaggaagggaaggagcccttaggttccagaaacaatgaaagaccttaaaaaccatggtgttca

SEQ ID NO: 86064 - DNA, 1054 bp, Homo sapiens
ctaaactcaccttaagcttttattttttcccccttagcagtcataaaatttggccatggattacaatttaaaagctatctcttctcctacattgccagaatgaaaatgtacaaactcggggcaatttcttaactaagtgttggtgaaacaggagtgagtcctggactctgtttgcatcacctgtctccaggtggaaaaggaggctggcgtggagagaggcagttcagtcaaaagaaaaagatactttgcaagggtatcgtggagctgaatgatctcaggcaagtgtctctcctcccagggctcagttttctcatttgtaaaaagttgttgaaaaatagtgacaaacctccctcactgggatgttctgagaaaccaaagagataatctataaaaaattgttttgttcaatgtaaagcatcataagcatgttggagattattgctactactgacaatgatgatgatggtgatgatggtggatgatgatagtgatgacaatgttggtgatagtgatgacaatgttggtgatggtgatgatgctcacgatgacgatgatggaggaatggtgatgatgatgatgatgacaatacagccatgtgcagggcagggctcatgggtttatgtgataagaggattttcctcagagccttgtatatctctatgtacaaaaaataggtgctcagtaaagaactgttcacctaaaatctacttcagaattcagtttacctctcagaggtttaggtcatttattcagtaagagttaattgagtgcctactgtgtgctagctcctgttagcattggactacagcaaacaaacaacacagacacagtccttgccttcatgaggcttatagtttagaagacaatgggatggaatgggatggtaaaggtagatggtaaacatataaacaaatgccataatttcagatgataatgagtgctctgaagacaacaaaataggatgataggatagacagaaatggaaatggatgtttgtaagatgctttagctcattagctcatgtagtcaggaagccctgcatgaacaggtggca

SEQ ID NO: 86065 - DNA, 1699 bp, Homo sapiens
tggatttatgagttcatggcccaaagtcacaaagctaagtcactggtgagctgcttatctctattccaaagaattttccagcttccatgtccttacttcctttcccctggatgccctgattcaccatctctgcctctgatgccctgtctattctagacaactgggtgcttagatatgcccagaatatgcctggaaggatgcctgagatctgatagcaggctgtctctgaggagaggcctggaagatggggtgcagaaagagagagggagccctgcttctcactcttcacccttatctatgacccgaatatttttagccacgtgtgtataacttacaacaaatcaacgcataagacaaaagaaaaatactgtttctaaaaatctcatctcttctatggttatctcaggccactcttccatataaatcatctgtaggcaaagggatgctttccaccctttcaaccacgcaaaactcactttgtttatgcccctctgatgaccctttcctttctcggtcttttattgcaatcccgtgcattgagtcaggttccccttcctcagctgtcatctccttgagggcaagggccatgtctggctttatcctgtagctgtcccagcacctaacgctgtgccttgtaagtgacaagttccctgtctgaatattgaattgtcgaaacaggaaaaaggatagttccaccaaaaaaaaaaatatatgtggactcattcattcgttcattcattcattcaataaagagttatggcaaacgatcataggccagggatcccgggaaatatgggatacagagggaaatggagctgaccctcccctcacagagctctcatccagatctgtgctttccaagtctccccaaagatcagaacgatgggaagggctgatttaaaaaatccctcactccaaaccagaactattgaatcagaatttataggggagaagcccatcaattttttttttttttctgatacagggtctgtctctgtcacccaggctggagtacaggggcatgatctcagctcaggtgatcctcctgcctcagcctctcaagtagctgggactacagagacgcaccaccatgcctaactgattttacgtcagtctatttttaacagacacccccaggtgattaaggattttagaaaaacattgtatgttggggggtaaaggagcagataatatgtaagttaacaaataaatgaacaagactccttccaatatgaataaatgctgtgaaggcaaaaaaaaaaaaaatgaataagggcatctgatagggaacagcaggggctgcctgaagccagggagcaggggaggatcgattctctgaggaagtgacatcttcactgagatcaggaagatgagagggggaaactatgcagggatccgaaaaaggattccaaacagggtaacagccaaccaaaggccccgagttggggaaggatctgtcttcttccttcccacactggaaaacccaattccagtcactcattcgcttgttctttgtactgtgggtacatctggctccttccaagatgtggctgcctctctcgcccacacagtatgaaagaacagcctgattctagcagctctggaaatattgacctccggaatgctaatgtaacatagctttaggtccttaggccgaactttccttcaaaaaataactccaagtgaatgggaaaaaact

SEQ ID NO: 86066 - DNA, 1073 bp, Homo sapiens
aaaatcagagagggagattgagttgctcaaggtcacaccgcaggtcactgggaagcttgaaatagactgtaaggagattcattcttaagcctacagatgacacttttgtatcacagcaatatcagtttgttcctctgtaaactctctcttcttccaaaatatgtattctggccatccccatctgattctgatggcatatctgatctgaaagttgttgatactctgatcttagaaagtgaagggtttaatcttctcttggaacccctcccagtgaaaattattttgccactttgaaatggcacgggcatccactgtgaactcacatccataaatctaagtctactgctcaggaaagcagatgaggtttgattctgcttctcagcacagtctcacagagaaaattatggaaagaatttgatttatagaaccacctcaaaggctctggagtgagacgcatgttgattcactttattaccatttattttacactatctctttacgctccctgcacatggatttgaaagatgatttggataaatgcttatgacctgtcagattgcatagccctgttgaggcacatggctgccaacatctcgggttgggggatcctcataccagttttgggggtcaggcccagcctctaacaaacagatgtggaggttctagcccagagttcttgtctgaactttcccagctctatgtttgtatggtacttggtgtggatctccagctgcaactgcaggatgtatacaggcaggcttgatttaagattcaaatatctcagaacagctggggatatttaacatcactataattacattacatttttgatggtgcatggagtgagagccttttttgttgttgttgaatattctatgagcatcaaatattttaaccagccggggaaacatgactgcatttttcacatccaagtagttttgtttttataattccggccggggatgagtgtttcgggctttcatcttttgccatgtctttggaacagcaagagcaatgtctcctacgctcttaggtgggctatgatgctggggaaagacgaaaatggggcagga

SEQ ID NO: 86067 - DNA, 2120 bp, Homo sapiens
cagctgtgatgtgccagactctggctgggcatgtttcatgtcatctcaattctgtgcaataaccctggaagactgtgtgaaaatctacattttataaatgggtgaactgcagtgctgggagcatctgtaatccacctaaagtcacagactcagcaggtgacaaagcttgggtttgaacccaagtcctcctgactgcaaaggtacatgcacgttctgcagctgcatgaggaaggagtccatcagtaggaggcagggtgtgtcctgggaagtccagcccaacctcagctttgccctggctagttgagtgactttggtttcaggattctcctgtttaatatgagggcatgagccaaatgatcaacgggatttagctgaaaagttctgtattcaagtgggcagtcaggggaatggagagctcaaatagtgcagatggcgtgagtttttcagccaaccatttcttttctttgcagagctgaaacagtaattaaggggggaaatgtacaagttattgaagtgctagagacaggatggtgattaaatagacatttatacaaggaacatgaaaagacctccaccagttatttgacttcggggaaattagtttagggaatcaaatgtaaactccactcaggtctgcagatatccaaaatgaccaacatcaggatgattctgatagtggctattttggggccactttggccagtcacgaaggcatcaatcaaatgtctgcccaatggagaagggctggagaaatagccaggacatttgcttcgcgggtcggttgccttcattctcctaagtgatttgcttggatgaactactcagaaattgagtaaatttcattgactcaattggatgtcaattggagtcaatgcacattaagcacctactgtgtgccaggcactgagtcaccaagatgaccataagtctgatctgtttctggtaaataggcttgcaacagtcaatgtgcctcatcggagtgactgagtctaaaaggagcttcctgatatacagggagtggggctggaatgaaacagcctaggatttgtattgggtacctgttacataaacagtcacattcaattttaacagcatgaatgagtgtcatggaaccctgcttacagatgagaaagccgaggctcaaggaggtacaaagccatgcatctgggaagtagtagagtcacgattcaacgaaagatcagtccagcttcaaagcccatgttctttcctatggctccattctgccaacactcagagatgctgataagaacaaatcctttcatagagggtaccactcacaatcttccaagccttgaagtttttttcactgcaagttgctgtaggctttggagagtcatcctgggttccaagacctgcaaccctgagaaggaaagacggttcgtaagaggacaagatcagtaatgaatttgcatcctcctctgccctcagacaaacagaagagaagtagatctatggaggagaatctgcctaggagttgtgaaaaaaagttttaattgtgccacaacctcaactaaatcactattttcattctttcaaggacactggtaacttgaagtcctgcatgaggaaatggtgccaaactgagttccagctcgggcctgtgctaacaaatagatgactcactcataattggaacatgaattgttggtaaaacaaatagaggctgctaacgtactcaggaagtttgttctgagcatgtcaaatatctcccctgacaccattgtttatactattaatttgccttgtaaattgtttcctccgattccacacacgtttattgagctccttctttctgccagacacttttacattcattattttatttcagctaacaacagagcagacaaaaacgtattcttttgtccctgataccaaaaagaaaactgaggcactgtgtggttccgtaccttggtcaaggtcacagaagccctgacttagggttccaaagtcaacgcactgcatcacaattgttcccacaaaaagatcttggtgcagctttggccagacaaacctgcatttgtaatcagcagaagcttaatttattatacctggataggatgtgataatgtacgttgctatctctgcagcaatggaggatg

SEQ ID NO: 86068 - DNA, 1071 bp, Homo sapiens
gtcccttcaggagccacctgacttcaacctctgcagcaggcatggccatgagttgtgtgggtcaattgttagggagttgaagacagtaaggtccttcccactggggcacacccttctcttacctccctgtactctgagtccctgcgtttgaagagtttgcaggcacacacacatccaagcaaaagtattacctccattccccaaaggtatgtgttcctggagactcaggtgacccctagtggcttcctatcatggcccagtcctgggagtatccagccccttaaagttgcatgctgtaggtttttccaaggacctcagaattaaaggcttcacccctctgtctgtagaagccagaagctatttcagggagccccaaatatacagcaggcctgtcaggaatattttcctctaaccacactgccttgtctctagcctttgtcatctttgatggagtggcaccaaagtgtagtggctgagaacatgaactctcaagctgcactgactgggctcaaattctgagtctaccacttaccatgtgcccttgggcaagtgacttaatctctctattcttgagtttcctaaatcatctaatggagataacaatactgtatacaccatattagttgtgtgtgtgtgtgtgtgtgtgtgtgtgtgtgtgtgtgtgtgtgtcagagagagctctgaaaactctgctgagctcctatagaaatgcttcctttcaatcacatcagcctcctaactggtcttttggcctcaagctctgtcccagccaacaccctgcatcccattgtctgctttacagccagagtagtctctaaagcactgctcaaagcacatggtttcccttcttcaaacctttcagtggttcagctgtcctcagattaagacctgagctcctcagaccctccacctggtcctgctttatttcttgccacaccctccctcataccatatactcaaggtctacagaacagctcccaacagctgaatccctgctcctcaagcccctctgcttggtttggtttccgctgctgctgtaactcccctttcatgctgctttgtctgcctggg

SEQ ID NO: 86069 - DNA, 1036 bp, Homo sapiens
gatgtcgggccgcggcggcgccgccctgctctgcctctcagcgctactcgcccacggtaagtgtcgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcgggcatacgggtggggggcagcgggtttttgaacagcccccaagaatgggaaatcagaccagagggaaggaggctgcagcgggccttccgcaagctggagacgctccaggaggcgaggggagcagaccgaggtgggagggagagagctccgaaaggagagtggagaagcggggccctctgctccctcctaacgtgaaaccagccgacctgggat

SEQ ID NO: 86070 - DNA, 1081 bp, Homo sapiens
ttattagacaattaaaaacccaaaacaatacaatacagtaacaatacagtcttctgcattagatatcttctctctgagaaattagtattaatgttctccataatcaagctatggtgacatatatgtaatttcagactctctcttgcttgtggtggaatggccgtgaattcttttgaagatctcactgtagattgcttgggacatgctggtcttgtgtatgagtatacattagtgagtatttctatgaacagtggttataaagtgaatactaagcccccttttttaaagaaaaatactacttgaccttttatttcatgttttgtgttttgagatctaattcacagaacagattttacagtttatttacctaaatgtttgttaagagttcagatataacttaactcccttagttatgcttgataagaaaaattcaaatgaagattgtattctagtataaattgttgattttataatgacatcaaatattaaagttatatatttttgtgccaccctttagggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggtaagctctttcttgtgattgatatgaacctcatgtatatgtgtgtatatatgtatatatatatacacacacacctatgtatgtatatatgtatatttttagacagagtcttcctctgttgcccaggctttagtgcagtggtgcgatctcagcccactgcaacctctgcctcccaggttcaagtgattcttctgcctcagcctcccaagtagctgggattacaggcacacaccaccacacttggctaattttttgtatttttagtagagatggggtttcgccatgttggccaggctggtctcgaactcctgggctcaagcgatctgcccttgttggcctcccaaagagctgaaattacacgtgtgagccaccatgcctggcctttaagtctttttaaattttatttttattattaa

SEQ ID NO: 86071 - DNA, 1050 bp, Homo sapiens
agattcaagagatatttaggtagtagaattgatagaacttggtgatctaataaatgcagggatgagggaaactaagttgagtgactgaatgaatgaaaacattcaccaaaattaaaacctgcaggaaatttgcgaatttgtgctttgtagacttccaagtattctttgaccaaaccacagttcgtaactcatcaagtgcttttatctttaaacctgtaaatagtccatttggaatgaaatctccataatctgtccatctggggagaaatgattctgtgagctgcaaatggtggtaattaccatggcatattcccatggtacagtggaagttttccgagcccagttccctctattaaggataatggagtggcaagcactgggaatgtcttcctaccacatgaagttaatatcattcttctctgaacaggcttgtttctggtgcaggtgacatcaaactcaccaaagatggcaatgtgctgctcgatgagatggtgagctgatgctgctgactttaataaaccttaataagccttaattagaagcatagtagaacttgtgtatctttaagccaaggctgtgagctaaatactgcagtcttgagatatgctgaagactgttgaattagacctcaataaaaaaatttttttggccgggtgtggtagctcactcctgtaatcccaacactttgggaggctgaggtggccaaattgcttgagcccaggagttcaagaccaggctgggcaacatggtgaaaaccgtctctacaaaaaaaaaaaaaaaaaaaaattttgctcagtgtggtgacatacgcctatagtcccagctactctggaggctgaggtgagaggatcacttgagcccaggaggccaaggctgcagtgaatgagattgtgccattgcactccagcctgagtggcagagtgaaaccctgtctcaaaaaaaaaaaaaaaaaaagtttttttttttggctgtttccaagtctttgtatacttatacatactttgtatacttaggcatacttataaatcaataatatcttttaagggcact

SEQ ID NO: 86072 - DNA, 1059 bp, Homo sapiens
gttcgtccgccagttcagcgcctcattccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagt

SEQ ID NO: 86073 - DNA, 1082 bp, Homo sapiens
atgaaggaaaaaatattatcttttatttatttcatccagccttaaattttgttatttggtggtaaattagggttccttgtttgcaggtcctatctattgtagaaagaatatttaagttgtctttccagcagtaacaattggctcttgctggtcattgatagtttaaatcactccttcctttagagattgaggtactcaaataggaaaagggaattagcagtgttctggagttgaaatgcatacagcatattcaaataaaagtgagcaataataataatagctaagacctatatatttcttagtatgggccaggcatggttctaagtgctttacatatattaactcaatctagtttccctaaagtctttttttatggagaggagtaccaagagacaaggtttgaaaagccttgaatgctaagtgaaaatttttgatgaagttcatatgaaaatggaggttttgagcaaagaattacatctgcaaagaagtatcatgggacattattaacagtatatagaatggaatgaacacggagggtagaaggaagctaggagctatttgaaaactatattttcaaaagcaaggtgacaagactgattagctgaggattgggagaaaaggaatagaagtgaaagcatgtcataggaatagctaaattcttttgttgtttgttttttttgtttgtttgttttgagacggagtctcggtctgtcgcccagtctggagtgcagtggcggaaactcggctcactgcaagctccacctcccaggttcacgccgttctcctgcttcagcctcgcgagtagccgggactacaggcacccgccaccacgccaagctaattttttgtattttttagtagagacggggtttcaccgtgttagccaggatggtctcaatctcccgacctcgtgatctgcccacctcggcctcccaaagtgctgggattacaggcgtgagccaccacgcccggccagaatagctaaattttagtgactagaagtggaagaagaaaaacaggagggataagtatgggattcaagattttgtttgtatttagtgtcactgcctaaaaggagttat

SEQ ID NO: 86074 - DNA, 1052 bp, Homo sapiens
aattgagacgaggcactaaacagcagatagatataaaatgtaaaggagtgatggaggagaaactccttgattgtatatcattcaaagtgtattatctcaaatctgaagccagctctttgagagttgggatggcgatttttacaaatgtagcagcctgagggtaagtgacctcttcagagtctaggaagagcaaacaactgggccttgttaggtaagcaaagaacaggttcccgagagaattctgtgctgtgtgatgaagagtgtcgtctttactctgtagaggacggagagccatgaagagtcttagggaatactgctgaagctgggtggggagagactgaggcaagggaacaaatcagaaggctctcatagtgacccatgtgggagatgattcagctagttagggtggagagtaaagtgcgtttttgaagatcatttagaatttaaatgatcttctagataaagtgctcgtttatggataaaataataataatttgagtgagcagaaacataatggtaccatcaactgaaatagaaaatagagaggaagaggaggtgttagggttagaaagatgagttttgtattggatacattaagtttgtttgactaagtttaactgcgattctactgtttggaggggagtaaagcctgcttttaatgcgcagcagaatgaaccagggctttggttcaaccaggcaattggaaggtcgctggagactcacgtcctagctatgataattgagtgatcttgagcacgtctctacaactacatttgctacatttttttaagtttcctcaaccgtatctgtctttttccaatgctgtaatcactagccacacgtgactattgagcacttgaatgttgcatggaattgagatgtgctataagtgaagaaaatacacaccaaaaaattcatactaaaaaaagtaaaatatctcattaataatatgtaccacataatgacatttaggccaacaatggaccaaatatatgagggtggtcccataagattataatggagctgaaaaatccctatcatatagtgacagc

SEQ ID NO: 86075 - DNA, 1096 bp, Homo sapiens
tcaggatcttgtaatacttaaaggtcatcatccattatgagtatcatatgttgctgatggcctaaaaagagcttttatgttatttggattttcttcattgtgatgtactagatgtacatgtgtgcattagataattgaacatcctgctgcgagctggcttttcctgtatcagaactctttcatgctgtagagtagactatgaatgtaatactttggaaagtgtttgattagtcatcatggactatataagacgctggcctttggaaaattggaagcctatctccttgtttatatcttttttttttttttttggcctcctactctttcgtacagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcaggtaaggtagagaacactgctttctcatcttactggtgctgagagaaaaagggataaggagttcaactgctttctttctcttttttttaactttgctcttttagagatggggtctcactctgttgcctaggccagtgtttaatgttgcattcgtagctcactgcagctttgcactgctggactcaggtcatcctgactcagcctcccaagtag

SEQ ID NO: 86076 - DNA, 1897 bp, Homo sapiens
gcaagtttccatccccttctaggaattgtggatgggctagtgtctctaagaagtgggctagatatgttgagttgggataggagctatgattgaaatttcttgattcatcttcagtcctgggtcttgggggatacacttggccaccctagggttgcagcagtggcattttggtttttggagacagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgggggagctgcctccgtcaaaccatgcccatagagagatgaactctcttgggaagggaaggttcccttggggttccagagctcttcaagaccaagttaaatgtgcttcatccccctaggtgtacagccaatgaccttaaatgcatcatcaggttgatcaaacatgatctgaagatgaactcaggtgcaaaacatgtgtaagtagcagctccgctgacagcctgagctgtcatttgttagctttgtttgttcccaactggtgtcaggacttttgagtcccagtcaggatttgaatcccccttccaccttcttactttctgtgagaccctgatctgtcacttgacctgtctctgcctccattttttcccatataaaatggagataacagtacctttctcacagagttcttacagttgaagtgtggcatacgttcagtgagtatagtatgagtctcttgcctactccagccccctcctcgctaaggcggcatccacataggcacagtatctcaaaagagctgaattttccaagagctttctctcctcttgtgaaagtctttagacaatagaacacaaccccttccctacagatgaggatttcttctgtgaggacagattgctgtccaaagccatggagtcaaacaaaggcagtggttttgtttccttgttcctgtaccccttggcaggttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggtgaggagtgctcccctgcctctgctttccagcctctccaagctccacatcctttgggctgagatcagatagggtatgagtgttgagagcacttgcaaattgactggagaagtttagggaaggaagagggaggtgcaagggggtatttctctgtaggaggcgaaggcaaaggagaagacagaggatctagtggaaagacctgagttgtaggcccagctacgccaccaagatgctgtagaatcttagatgagtgacttgcctctcttgtccttcagtctcctgtgtggatgacgtctgagactgcctgaggcatccccctagaatgatttatctgttatcttacctgaagacggatgtattaagtaacccctgagattctgtgacctactgcaaagtagatctgagagttggtagcagagccaggcttcctgtgacagggtgacttgggaagagggaggacacataaggaatgaaggctgactctgacagacatcatcttaggcctctgctcatttcgtaagaaatggggtttcctttccagtgttggttttcctgtgtgacagggcccaccacatatggtgccatgcctactgtgagattctttggatttttgagtgatgtacagtgctttttttgaaactgtcttgtttgtcatactaaaaccttggtttagggttttatgtttgagata

SEQ ID NO: 86077 - DNA, 4548 bp, Homo sapiens
gggctttgccctccatggcatggtttgaggtccctgctgccatgtcatccctcaccaaagctccccttctgctttcaggtggcccactttaaggactacattccccaggcttttcctgggggccacagcatgatcttggattctgaagtgcttctgattgacaacaagacaggcaaaccactgccctttgggactctgggagtacacaaggtactagctcagggccatatgtgcaagaatgaatgagtgtgagtgagtatgtacatgtgggtgcacgctgcggtctgaaaagggaggaaatatcccttagtgtggcccttattcttcgcttctgacctgtttctggtttggatttttgtcttttgtttttctcctaaaaaggggctggtattgggaaccagtttataactgggttggtttccatttagcactatctgctcagtgcccttatggcccaggggcttcagagcagaaatagtactttttcatccggtgcctcagggggcctccagaagtggactggtactccttattttttcacactgacttttgtcctatgtgtacctactacctcattttcccttacagaaagcagccttccaggatgctaatgtctgcctgtttgtttttgattgtatctactttaatgatgtcagcttgatggacaggtgagttggctagcatctttaaacccagaaactgccaggaatctgttttcatttcctgggtgaggaagatgggggcttcaggttggaaaggagggtacagggaaccagctggcacatacgtttgtgctcaggagcttgccaaaggcaatggcaagagggagctgagaggaagcacaattgctacatgatcagttccccattcagtgtaagaaagagcccatgtgttgactccatctcttctctgagagcttaagtcacagaagaaacccaaacccccaaagaagtttctctactaaagcaaaatggactattgcagagaaatagactgtgagcatatggggtttcagtttatttctccaatggcacccctaggggctccagtggcacccctgggggcataaggcagatggttttcagctcagaggttttgatttcagaagagactgacaacaggaagctccggattataggggaggccatgggtgggaccatcttggagagaattagcagtcttgacttagctgcatccatatgcttgtgcctgagaaaccagtatcagccctttcctcacttagaaatgtatctctacccctgttcctcctgcaacagccacatccttgattggggaaggagaaggaagtagagagggaaggaattggtgggggtaggatttggggtttgggtcccaaggcctgtctcagcctgcctaccccggggttggccttgggatcggggcaaagcagggtgcaggggataaaaaatgagagttggagtcgtatttcaagtgggaccagaatttatacaatctgggctacaggccagttctcccttggctcgcttgatgaagtagaactaggaactacaactatgaactggctctatgccacagctcacaattttccatcttcggtcacgatggagcccttgtagcccttgacagcagaactgttacacatgaggtctttgatccatggcaaaccctttcttgaagtagcagttttatcattgtggcccttccttcctcagaattcctaataagggagggaggatcccggcctaacctcagctctcctgttctcctcagacctctgtgtgagcggcggaagtttcttcatgacaacatggttgaaattccaaaccggatcatgttctcagaaatgaagcgagtcacagtaagtgaagaccctatgctaggcagtgtcctagaagtttgaaagcagggcagagaactccttgggtcaactgcgactggaagaataaatcttaatgtcttatggagcctcctgataatgttggcctttgactattgcatatgttgcctgctagtcttcacccagaagggtagggcatggaaatccttcctaggtaagcctcctgtgtttcaaagccacagcagccctctgtttgggatgagaagcaacctgctttctaaccctttgtcccttatatttcaagtaagggtgtttccagtggacacttaactagtgtgtgaaaaggaacaacccccactcactcaccaccttctccactctcacaccaacttcagcatctctcttgtccctcagaaagctttggacttggctgacatgataacccgggtgatccaggagggattggaggggctggtgctgaaggatgtgaaggtaaagtggcctcgcttggcttctcctgtcgactcactcgcagccctctcccctgagcctttccagccctgaccaggagatggcggtggcagcctgcagtggttggggtggctgctggggaagtgtgggcagatgtgtcctggatctggaggactgctttgtgtgtctcctatagtgcctggagcctgagggctcttaccctgagggaggggcactgggctagatctggtgtgtagcagtgaaggggtgaacccatcctcatggagttgcctttctattctgtggtctctcttttgcttcccttcagggtacatatgagcctgggaagcggcactggctgaaagtgaagaaagactatttgaacgagggggccatggccgacacagctgacctggtggtccttggagccttctatgggcaagggagcaaaggtcagggtggcctctgccccctggggtggtactgttttagaaggtaccgcttgaggtacaggctggccttgttactggcttgatctgccagcatggccagttatgacttccgaagtcctaggatctagggccccaagctggcctgagtcacctcaggcagagctgcttactcggttagggagaagtcagaatagagtaccctatgctagcctagcagaaggacgcttaccaccaattatttcgtcagggcctgacagctttctcctcaggcaaaatctctttcctgactggaaaggaagctggagtctgaggaactaatacttttaagcaatctatcatgtgtccaacacagttcaatgccccagagcccaacaggttgggtgtgattatccctcatttacagaagaggaaattggggcttataaaggttaaaattacacagttagtaagaggtagctccaagaggtaaactctggcactctgacggccaggacccaaggtcctctccctggccctgggctcttgggactggcagagatggctcctccaacccacactcatctcacactcccctcccaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggtgaggaagggacctggttggccatggcctctggactggccgccatcactgagacagaggctgtgctttggggactacaggtatttctgtctccccagaaagaagggttgcagcttgctcaggggagcaggattaggccttataatctctgaatgccttcttgtggaaaatggcttgcatgcctctaggtcatacccactctgggctgggaggatcacatggctcaaacatcagctgtttaagtggcttcttataatctcattaccaagagaagggatttaagccttgttccaggttgggaacagcccaaagtagcatcttttctcctctaggaccccagcaaaatacccagctggttgaaggtcaacaagatctactatcctgacttcatcgtcccagacccaaaggtatcaacccagtggcttgggggcctccagctcatagaattagcttgcaggttctctagtgccatagagaatccatctcacctcgctgaaagtccacccagggataggggtctggatttccagctgagtgataggcacagggacaaccagacaactctgaggaattttgaatagaattctttctgcaatacaattgctttaaaaaaagagagagaagaagagagtacctatcccctcagcacaaagggtgtgttctagaagtaatctggcccaatcccttcttgtaccgaccaagaaagagatctagagaacaaacaggacttccctaaggttattcagcaacagcagcagcagaactaggacccaagtttcccagctgttagccaaagcttttttggtttttgttttgttttgtttttgagacggagtttcactcttgttgcccaggctggagtgcaatagcgggatctcagctcaccacaacctccgcctcccgggttcaagtgattctcctgcttcagcctcccaggtagctgggattacaggcatgtgccaccgtggccagctaattttgtatttttagtagagatgtggtttctccatgttggtcaggctggtcttgaactcttgacctcaggtgacctgcccgcctcagtctcccagggtgctgggattac

SEQ ID NO: 86078 - DNA, 1050 bp, Homo sapiens
aggctggtctcaaactcctgacctcaggtgatccacctgccttggcctcccaaagtgctgggattacagatgcaagccaccgcgcctggccaatacttgcttctccctttttttgagacagtctcgttctggagagcagtggcatgatctcagctcactgcaacctctgcctcctgggttcaagcgattctcatacctcagccttctgagtagctgggactacaggcgtgcaccaccgtgcctggctaatttttgttattttttgtagagacggggttgcgtcatgttggccaggctggtctcaaactcctgacctcaagtaatctgcccacctcagccttcctaagtgctgggattacaggcttgagccaccacgcccggccactgatactatcttcttaaccagtgatgacctgctggcttactcctgacagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggtagcagctcttaggctgtatatgtattctccaccccactgtccaggccttggagccttgggcatctagaccattcacatgtcctctgtcttctcctttcccccattctcctgaggcagagcaaggagggcaattagagagggagacaaactgctgctgggccaggggcacagcactagacctccttctccctccatctctgagtagagaaccttgcatttgcaaggccccactgagcagcctttagtctggggaataagagtttgctcctgttgccccagcaaagcctgctttgctgtacagagaacaatgatttgtaccctgattactcaggctatagggccatactttggaatggtgccaagggagccaactccttttccttgctctttatctttctcacatctttgttcccatatgcgcctaaaatacaccacacacaccacctctgaggccagactgggaaggc

SEQ ID NO: 86079 - DNA, 2568 bp, Homo sapiens
cataaatctgcagtatccaaccaaactagccacagacagctgctgagcaattgaaatgaagctggcacaactaaggaactgaagttcttattttaattcaacttcaaatggtcacatgtcactagtgactaccacactggacagtgcaggtgtagacggagttcagatcagactcctgaaacttaatggctctaaccttaggcaagttacgttaacatctaagcctcaatccctccaagtagaatgggtgcacctaaatcatagggttgtcctgttgtcctgagcaacattatgtaaagcacttagcccagagcctagcacatagttatctagagttgggaacgtcactcctggtgtgcatgtccagaccctacccgggagaagggcctaacctatgactttagaaccctcagttgcaggtgtgcatgttccagccaacactccactctgagtgcaggctcatcaggacaccatatggttgtaaactggctgccatgtcccaatccttccagctcttgagggtcagttctcaccttatgaacaaattaacaggctctggacctataagatcaaggaccactgcgccccctggccaccccaccgcccccccccaactttgatctgattgactttggcttccacctactgtttaaaatgtgtatgttgggggagtagggacagcacgggggaggggtttactttcctgactctagcccaggacatttggtgtttttgaataggcaccattcagccttgcttcagtattaggaataagatactttttattccatcctctatggagacaaaaagctgctcctcctttgagtactgacctacatagatttccatttctctcttcagcctcaggccaaacaaacaaccggacagggcagcagaacaaggctgtctcctcaggatcctgccaaaggcactgtcctctccaacctggacccagccccacttgcccttattggttgcttacacccagagtgcacactcacaggaaagggcctctgctggctgcaggtgatcatcttgtcccttctctgccttagtgtgtgttattgccatttcaatgtcagtggttttttatgtattttcttccagtctttgctgctgagatctgactgtatatactattttgtatcctttcatgtatttctttcatgtatttcaatgcagccctcaacatcatcatcataaatctctccagcagaatgctggaggcctccctcttctgaacctctacatgctgctggctggcatcaagcagaggtcatcactgggtgctgaacaggtcagctccctagggcaatgtgagcaaagtgttgtggctcatcctcgatcctttatgcccttttggcaagattcctttctcttctcagtcacagcagatggacacataatcttgttctcccaggggctgcattctcagtagtcttttccctgctccttgggcgcctggtcagggaggtttgtacaagcctgcgcacacacagcagtctgtcacgaggctgggccaaccttttttttttttttaaacagactcttgctctgtcattcaggctggagtgcagtggtgcaatctcagctcactgcaacctctgcttcccgggttcacaagcaattctcatgcctcagcctcccaagtggctaagacttaacaaacaggcacacaccatcactcgcagctaagtttttgtatttttagtagagaccacgtttcgccatgttgtccagactggtctcaaactcctggcctcgagtcatccacgcacctcagcctcccaaagtgctgggattacaggcgtgagccatggcgcccagcctgggccaaccttttctgagccatagtccagctgtactacagctgtatccaaaaggtaccatgtatctcccagggtaacctgaagacctaactgggcatactaactgtcctcagatttcagttctttaaggcccatctcttctagatcagtgtaaatatctgaactcacttggtgcttcaacccaattggtcttgggattcatcctttacctacccagctctcattctcttctaggttgttccatggcctcttccatatattacatttgtggtcttgagcaagttagttagttacaacaacactgagcatcttgaccaaggtcacttggcccaaccacaggctaatcccaggccatgtgcacatcccaggattagcttgtggtttatcagttgtcaatttttttttttttttaatacagggtctcactctgtcaccctggctggagtgcggtggcgatcagagctcactgcagcttcaatctcctggctcaagtgatcctcccacctcagccttccaagtagttgggactacccacatgcaccaccatgcacggctaattttttggtttttttgggttttttgtttgtgtttttttttgttttgttttttgagacagagtctcgctctttcgcccaggccggactgcagtggcgcaatcttggctcactgcaagctccgcctcccgggttcacaccattctcctgcctcagcctcccgagtagctgggactacaggcacc

SEQ ID NO: 86080 - DNA, 1990 bp, Homo sapiens
atcattaaaaccaaggatccatgaggggcagaagggaggattcaaagatttaaaaaaaatcaaattttagaccttggttaaatattaactggaatgggatcttggaactcccaactttaatttggtgtaataaaaatgatgcaaaaaaaaaaaaaatcagggttgtttgacaccttttttcctaaagggaaaccttcaccaaaaggggataaaagatttaaaggcaaaatgagtaaacaacctcagttttaattcttactgaggttactaaccagctatcagtatattattttcgatttgtgtctaggagggaaactgaagaggaggtaaggcttcagcagagaaagcaggttgtaagtagagagccagcttctgcccttaagttactgctagatcttagctgaattgcacatacatagacctgttttacagaggaactgagtagctgaatgaatgatcctttgctaattggtaggcattgtaaactatagtatttactgcccatgacaaaagtggaaagggatgtcttcatgagcaaatctgattcccccaactcctgcaaaggctgtggttcagaatcaaatcatccaggactttgtataacattgaggtaagtggcccagtgttcagttgactagtttatgcagttatttcattcctccaaaggggtttagtggttggtgatggaagaaagcataaatatgtctgtaccaatgtaataagtccctttagaggtttccctctgccatccagagtcatgattggttctagtctcagatttttcagctgcatgggaggggtaaggggtgggaggtgtctgccaaggcgtttagggtttgcatagttcatccattggtaatgggaaaacactctgctttcctgatcatgtgttttgtgcttggccacgcttctgcagcaaactcttaagtcctccagctcctctaggggtgtaaagactgtgagggctcaaatacatcacctactcattgcatggtccttcctaaagagcctagaaaatggtttctcctgctgggtgtggtggctcacgcctgtaatcccagcactttgggaagctgaggcgggcggatcataaggtcaagagttcaagaccagcctggtgaacatggtaaaaccccgtctctactaaaaatacaaaaattagcctggtgtggtggtgggcgcctataatcccagctactctggaggctaaggcaggagaatagcttgaacctgggaggtggaggttgcagtaagccaagactgtaccactgcactccagcctgggcaacagagtgagactcaaaaaaaaaaaaaaaatgctttctccctgacctgcccccaaaaatcagtgggctaggaaagggaatgaaagtagggtctcctcactccccaccaacctgggaaataaagacttgaactgtcggcttacaacagaatccagtctcattcagtacctcctgaaagctcttaagtgctctgtcttaacatttgctctccaggaacttcaacagcagtctggccagagaagagcacaggctctttgcctaaatctatttcttcaatgaaaccaaatttaaaactaccatggataagggagggatttcattttcagcgaaaagtggcttaagacttctagttgggaaaaggatcagaagccaagccaaaattaaggagaaggccactgcctccacccattgcttcccctttccgcataaactaaggatggtgcaaatcaggtcccaagagaagcagcagcagggattatgcacgcactatcccttgcagacagaaacaaatttcccagcagtttgggagcctgatgttttgttggctcccagagtcaggtcaggagaccaacagcttccaatcccagcatttaatgaagtggcttttaacaactttgaaatttttctatagcatttgtatttcatttctcaccaaagataagtttactggtctaaaatctgtcctaaggaccactatcggtctg

SEQ ID NO: 86081 - DNA, 1065 bp, Homo sapiens
ttcattttatagatgaggccaactggggcaaaaaagttaagtggcttgcccaagggcacaaagctgctaagtcgaggagccaggattcaaacccaggcaggctggccccacagctcctgctctagaatggccttctgcctaactgccctaagagtagaaactatccagacagtatcaactgctgagtgcacagggttctcaataaatgctaactggcttgtgtcactagcagaatatagtgggcatgaccagtatcctagtagagctgacccaaacagaaaaaataatgttcaaaagcccagccatctccaatatgtcttaaattgtagcctgaagtaggtacccataaaaaggaactgatctcacagaagtcacctctaccatctgggggttggccaacccatagaggaattctcccttattgcatctatactttctcttttctggactattaaaaagtcaagaaatacttccccctaggaggtaggctgggtgtgaaagggagtgaaacccatttgcctcttttgaggtgctgttggtcctaacagaggtttggagactatacaaatacctaagatgaatgggaataatttataattttcagttactcattctctcagaagtaacaacaaacacattaactcagttgtcagcattctcccagggaatcagaaaaagaaaggaagcaccaagtagatcagcctgatcttggtaccggtgatgctggggggttggagggtggaggtgggtctagaactccaaatggttttggggaattgagaaaagctcaactgttttttatgtctgattagaagtaatcagacataaaattgcccattctgagcaaaaggccattttactaaataaatttgggaaatcttctgaaataagttttaaaatgctgcaggctagtccaacactactcttagaacgttctctcttggaagggagttcacaaccatatacccttgaggcttttgaaaacacatagcatattttagaatgtccccacagatggtcaggagttctgcagtgtgttctgggagtacctgagggcccagtggt

SEQ ID NO: 86082 - DNA, 2565 bp, Homo sapiens
ctgcattctgatcttgcatccagcaagccacacacatttgaagaaagaatagagagttgtttggatctggctgattgagcaacgcaggctttataattgtgtcaagctaggtcttgtcagactgcatcgacttaagtaatattccatgtcaggcccacaggtttatggcattgaagcctctttgtttcagtctcagtcatcctaaacagacttcatttcccaatagaaaagctttagatgtgaatgaaccccaaatacctgaaaacatccattttctgcctgcatggctactggtcccagaaccgttacaatgctagtgcagccatgcatccttttaagtccatctctgaacagtattgtttggttataactgtatggagaattagggagcttgatatatgtccctttgcaatgccttctaagtcttaatagccaaaactgggtggtaaatattatttccttttccctttactatgtgaatgatacttagacaaaacttatataactatcttaactatgcagacatttacttcagcccagagtgtctgtgatcttgactatgagaatcttgtctcttgagctttcttttttagcttgaatatctttctatatttcgaaaagatggaccagaaatatttaagttactacttaagtcaacacaggatgaaaagtttttaacttctttaaaggattaatgagggtgccctccaggccaatcccagtgtgctcaggaattacctctcttgttggggatgtgacatgctcttggccagaacagagctcagccggatgtcactgtgctcactcagcctgtggggtgagaggccgaggattgcttcctgtgggctgagtaagccttcctgtgttgtcagcgactgccagactagctgctgccaggcagtaccagcttgcccatcaggcgctcttgttgcctaactgagacactctgtgctttcaggaacgagagtaccctgatgtccagacagcctcccgttgctgtctaaatatttgtcttggatatgcttgtaagcaccactgggttcccagcactctgagtgggccttcctggagtggggagcctgtgtcgatggagcagtgggtggggaatttggagatggaagccaggcccttgactcagaactgctctgtacttgaatggaactgagctatgcagtatggcctggtggaaagaatgtgatcatgggcattagcctccaacagaccttgagtgtgaatacccgctctcctgtttattgcctgaccttgaatacaacagttgatctccctaagcctcggttgctttgtctgtgaatcagggaagaacactaatacctactttgcaatgtcgctttgagaattaaatgacaagctagcatatagaagcacctcaataaattaatattaattgtaacaaccaccaccaccataaccttcatgcagaaataattacagtttaggatttgaatcctggctgtcaccgttaggtaatatttcctagctataataaaacagcttacacttgttgaggactcattttgtgttagatatgctaaatgggttctctcttaatcttcacaacaaccccatgaggtagatactgttatcacccccattttacagatgtggaaactgagcaccagagaggctaaattacacacccaaggtgatactgcaagaaataagggagggaggcttaataaaaatgcagagctttttgattcttatgctggtagtcttaattaatacctcaggtgcttcaggagtaaataaagtaagcctcaaattaaataataaatgtgaagtgtcctgtacatggatatacacaatacatagtggaggtcttccacccgagtggcttttaatctaaaatctgaaagtggcttgcacccttagatatatgagagagcttagtaaaagtaagagtgactggaggagatcctgctgggcttggcagctctgaagctcccatcgcactctctgtcttgttctctcaatctgacatggtttcctgtgtcttttgctctaagcagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggtaagggcccatttgtagtctctgccagtctgtgccagtttgagggctcattttcattttcctctcctgcctttgttgtgagaatggggtataaggctaagtgtcttgattatgtgaagccttt

SEQ ID NO: 86083 - DNA, 1033 bp, Homo sapiens
agttgttatttagggttagggctttccagtttggcaggagagtacttctaactgaccacattaggacatgtttcttttttggtatttaaatatctgtcagagtggccgggcatggtgctcatgcctgtaattccagcactttgggaggctgaggcaggtgtatcacctgaggtcaggagttcaagaccagtctggccaacatggtgaaaccccgtctctactaaaaatacaaaattagccaggtgtagtgatgcacacctgtagtcccagctacgcaggaggctgaggcaggagaatcgcttgaaccctggagatggaggttgcagtgagctgagatcttgccgttgcactctagcctgggtgacaagagtgaatctccatctcaaaaaagaaaaaatttatatatatatacatatatatatggagtaaaatatatatatagatataaatatctatagatatagatacagatataggtatataaagagtaaaagcctagtcggctgactttggcaaacctgttctgttagactgagcaggtctaaggtatgttaacactggagaatcttgccactacctgatctttcctgtaataacccccttccccacatatgtatattcctagcataagacttcattctccacctaaacttggagactgtggggtggcagaatggcaattttttttttttttttgagatggagtctcgctctgttgcccaggctggagtgcagtggtgcaatttcagctcactgcaacctccacctcttgggttcaagtgattctcctgcctcagcctcctgagtagctgggactacaggcatgtgccaccatgcccggctaatttttgtatttttagtagagacggggtttcaccatgttagccaggattggtctcactctcctgaccttgtgatccacccacctcagcctcacaaagtgctgggattacaggcctgagccaccgcgcccagccagccttctttttaaaagtagccagatgacttgaataggctgatagctcttctttca

SEQ ID NO: 86084 - DNA, 1030 bp, Homo sapiens
gtaatcttagcagacaaagaaattctcttcagtctttcgttcaaggtattgctgtggttatgtgtgtttaaaatccttaatttactgatcatcccggaatcataattgtgcagtttctgtcctttttttttttttttttgagacagagtctcactctgtcagccagggtggagtgcagtgtgcaatcttggctcaccgcaacctccgcctcccaggttcaagcgatactcctgcctcagcctcccgagtagctgggactatgggcatatacaccaccacgcccagctaatttttttatttgtagtacagatggggttttgccatgttggccaggctggtctcaaactcctgacctcaggtgatccgccggcttcagcctcccaaagtgctgcgattacaggcgtgagccactgtgcctcgccaattgtgcaattttaagcatgaatttctgtcctttttttttaaaaagcgctctattgctgttatcattagttaataattcaacaaatatgtgttgattacctggcattaaggctgagaataaagctgtgaaatagacctactcttgtttcctgtttcactttccacaccctaaatatggaagaaaaatactttaaaaagaattatataggccgggcatggtggctcatgcctgtaatcctagaactttgggaggctgaggcgggcaaatcacttgaggtcaggagttcaagaccagcctggccaacatagtaaaaccccatctctactaaaaatacaaaaaattagccaggcatggtggcacgtgcctgtaatcccagctactcaggaggctgaagcatgagaattgcttgaacctgggaggtggaggttgcagtgatctgagatcatgctactgcactctagcctggacgacagagtgagactctgtctcaaaaaaagaaaaaaaaaagaattatacaaactgttagccagttgattagatacagtactgctagaatgctctttcccccagaatgtaatcattatgagattcaaggaccttgcctgt

SEQ ID NO: 86085 - DNA, 1045 bp, Homo sapiens
taccacactgaccttagagatttttcatgaaagaataatcaatatatgtttattaaatgggtagtttgggcatatgatttacaaatttggctgcatatagagtcatctgggagctttttacaagcataagctcctaggtaccagaccagtgactcagtgtctcctgggggtgttgtgttggcacataagagacactctatgtcctttctttcaggtaactatcagtaaaatgagtatggtggggggggatagatagatataatatgtaaggcaagatgatatgtacattgagatagatctcatctctcctgcttctaggacttgattgaatcctatctagcatgctcttctttccagtctgcctagtgtaaattatatttcattaaatcagcccatcatcagaacagtgtttcttgatgcctctcatttttttctcatgttttctggcatttttccttcattactttttttttagttcataattcaatatttatatgattgtttgatgtataatagacaaaaatacatctgctttgctttcgagtatctaacatagtgtctgcctcataaaaggcactcagtaagtacttgttgaatgaataagtggttgattgaatgcatgattgaatgaagtgatatttgaatttagctttaaaggtgattggaattttggacaggtagagcaaatgaatgggaaatttattgttctgaagtggaaactggatcatattgctcatgtaatttcagaaaactggagaaactggtttgggaaaatggaagagttggttttatatctagtatgctaagtttgaggtatggaaatttagcaggcatttagaaatgaagcactgatctgaagggtgagattgattccagatattcacttttgggagttacctgactggagaatgtgaaatctgttcctttcacaaatacctggtaagctcctactgtgtgccagacagctatgttatagggaaggtgaactgcagtctgagaaggagccagtcttgtgaaaagagctagggagaatgtttcagccaga

SEQ ID NO: 86086 - DNA, 1001 bp, Homo sapiens
attttcatagtcttctgtattccctatgcatccagtaggtgtgatggtaaatgatttggctttagcatagagaatgtggcagctgattaaaaaaaaaaaattccagtgcatctatcttaatgagagaacttgagttgtctgaagaaatagagaggtcagaggaggcctagtgggaaaaaagaacaatgagcctggttagaactgacaaaaattcaccctaatgatttgactggctaatgatgactgggcaagttccctgagtccactgacccagatgttctaatttgtaaatgcaaagtgacttatttatcagcctcctggggaaatcttcagagctgtgaacctgctatgttcagtaatcttgctggccccagccccagcctgttctcagatgaaattttagaaactggccactggaactttttgggtaagggctctggaggtggccaagttaccagtagtgggggaatgaggtttacctgcccccagtaatcagcacttgatttaaaacaatcagtgagctgcctcttctttcctaggttgcagttgactgcggttggttcaggctgagttgtttgggaagtacaaattttgcccagcgtgagtcagcactgccctgggtaaactccctgctgtgttgcaatcttgcttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcaggtaacctcaaactgttttcttaagtttcattagctagatgaagctgcattagaaactgggaaaatcctgtcttcagaagtgagtcaggttttttttttttttttttttttttttttttttgagacggagtttcactcttgttgcccaagctggagtgcaatggtgtgatctcggctcactgcaacct

SEQ ID NO: 86087 - DNA, 1109 bp, Homo sapiens
gggtggtcaaggctgcagtgagctgtgatcacaccaccgcactccagcctcggtgacagagtgagaactgtctcagaaaaacaaaacaaaacccagctaaaatagcataaagtagaagttagacccccatccctactaggaataactgctattaaatggttttagtatatgtgtgcgtgctcgctcgctcttttgcacgtgcgcgtgctctccctctctcggtgtgtatgtatatatatgtatgtgtgtatctatcatatataattaaatatatattcccccctgctgttcacagtgctttttttcaaatgggtaatgtattatggagcattttttaatgtgaattttttaaagcatttaggacctgggatggagctttgggttcctttctccaacccttgtctgttctgttataaaagggatgagagaggtacctttgaaagacctaaagaaaatacgttttcttccttgttacatgggtttcagttgaaataaggttttagctttatttgtgagtaaatcagtagaatactggatgttaggatgcatctctccactttattataaataatgcaaggctgattttatgatgtgatctcttgcagaactttgggggaagtgagaactgtgagcacaataatcttcagagaatgcacagtcctttgggtatttgtctactcatcagctgcttagtcagatggagtgttttcctaagtactactgaagtacacagttcagtctttattttgaaatctctccttctgccttctctccctcttccattactttgattaccttgatgggacattcaagctgtgcagtcgtatccttttatttctatagcctgcagaaaccaggttgaagattaactgtaggtgaacaggtaatcttatctacttggctagaaatcacccttcaagatgaaacacgtgttgacaaaggccccctagacttggggacatgaacaaaggtaagttaatcttggggcattattagtggaaaccagggtagacgtttaggaagtttgacttattggaggcagggcatgtgtgtcagggagacagagcatgtgagtgtgtgtattaggagaagagacgaattcagaggta

SEQ ID NO: 86088 - DNA, 1027 bp, Homo sapiens
tgtattttgagtagagacggagtttctccatgttggtcaggctggtctcgaactctccacctcaggtgatccacctgcctcggcctcccaaagtgctgggattacaggcgtgagccaccacgcccgaccacttttttttttttatactttatttttaggtaattatagattcacaggaagttgcaaaaacactacacagttcccatgtacccgtcacccgtttttctcccattggttatgtctcatttaaccatagtacaatatcaacaccaggaaactgacatggtgctctgtgtgtgtgtgcatgtgtgtgtgtgtgtgtgtagttttctgctgttttatcacatgtatggatttgtgtaactgttctaccaccacaaagatcccccttgtgctactcctttattatcatgcatatccgttttccctactgtcctaatctctggaaaccagtaatctgttcggtgtctctataattttgtcatttcagaaatattatggaaatggaatcataacagtatgtgacccaatatgtgaccttttaagactgggttttttgttttttacttttatatgcatagaacaattggaactttttttttttttttttgagacagtgtctggctctgttgcccaggctggagtgcagtggcgcaatctcagcttactgcaacctctgcctctctagctcaagccatcctcccacttcagcctcctgagtaactgagactacaggtgtgcaccaccacacccagctaatttttgtattttttttatagacagggtttcaccatgttgcccaggctggtcttgaactcctgagctcaagcgatttgtccgcctcagcctcccaaaatgctggtattacaggtgtgagccactacacccagcctcgaatgtattttttgtagagataggtctcactgtgtttcccaggctggtcttgaacccggcatttttcacttagtgtcacaccatccatccaagttattgtgtggcagcaatagtttgttccttttatctctga

SEQ ID NO: 86089 - DNA, 1048 bp, Homo sapiens
ctgtagtcccagctattcgagaggctgaggcaggagaatcccttgaacatgggaggtggagattgcagtgagccaagatcatgccactgccctccagcctgggagacagagcaagactccgtctcaaaaaaaaaaaaaaaaaaaaaaaaagaataaattgatagaatttgcattgggtgcttgtattgggaggcatattcccctctttttgactaaatactggaaaggagtttctaacttcttggcctgtaacttaactcacagttaagatgcttaaagatgggagacagaaaataaaatttaggggtgtgcaatttcttcgagacgcttttgtgtttgctttttagaagccttttgtgaatagtctacgaggatgcattattagtttttgtggttataatgtcaaaattagtgttgatttggagcaggcagggaaatctctccatgcatgcttttcatcctggtttaattgcttagttggatgaaatgtcaaacttgatagattattggagctgttattttggtagttaaacaataatgaaactgtttgaatgtttttggagaacactgcttcctgtgtctggactttgcactggagaaagtttcaattgttcacaagcaatactggttagaaaatgcagcttctgtggctcctaacacagctgtctaaattactagctatatgggggcctttggacaagcactgcttaacacttttggaaacaatttgtttctgattccaaaaatgtcgatggtcattccctgaatacttgagaaaactagaaatgggaaaaaggtattgcatgtgtctaggttatgccagtcaagtgttttttctttaagcatctctagaacaaatttacctttttagctaaggataagaggtttatggaaatgttgtagcagccccctgggcctttctttcctccttgatgactgttcagcagggtagcatgttgtcagcttgtgtgccagcttacagagggcttgcgttattataaccttgattaggaaagagggatggggaacaggagtgagaggacagatg

SEQ ID NO: 86090 - DNA, 1042 bp, Homo sapiens
acactgaatagttttccaggcatgatataggcactcaatctcatattatgaataagcttatgatgcatgggggatactgatgacagctttcttctgtccaggcaggcccagctacatggtggtatgaccagtgcagtcacacagccccatgcttagcagggctctgcacttagtttaatgctctgctgttgccatcttgaagttcttaatttttaaacaagcatcccatattttgcactgtttcttgcaaacagtgtagccagttctgtctccaggaatggatccagcactagtactggcccttctctttgggaaacatccttccattgatttcttagggagtaaatcccttgaagagtaacctcccatagaaaaattagggttagcaccctgtgtatgtttatctctaactgttccattctcagtaacctacacatcctctctcattaaaaaaacaaaacaaaacaaaaaacactttatattttacagaagctattagatccagagaggttggtaggggtgctggtgaaatggaatggtgatttgggattttggaatcaggaaaaagatctaagttcaaaaccctgctagtccctttctggccgagttacttggacaaggtaatgtctctgtcctactggtaaagtgtatgttgcaggggaattacattctttgttggtaaaatatatgcctcaggggaattaaacagataatttatgtaaagtgcctttcacagagagtctggcacatagtaggtggtcggtcactattaattcttccagctcttgccagaaataactaaaatcagggcactaggacttccaagccgtgctgctactaataaaagaaataatatgatttattttttcacaactgtttggggaaaggcctgtgcttcataaatatgcgttggaaagtacttagcaaatgagtagaaataataaaaatatgtccaagtaaacagctcctataaatatgtcacttggtagacaaattagtgttttatcactactaaatactattgctcgctgaaaaggatttc

SEQ ID NO: 86091 - DNA, 1823 bp, Homo sapiens
tgggcattccctccttaccagaagaaaacaccaggagaagcctcctggccagtgatgttcaaagacagaaccagtgcttgaaagaaatgtcttacttttcttcttggtaccttttcccctgtcttcctcctaacctcttgtgttgattttcttctcttctgccatcagtcttgataaactgcttgatgctggtctctatactggagaagtgactgaaattgtaggaggcccaggtagcggcaaaactcaggtacatgtgaggccagcagtcaggaggatttaggggtgagggtggtagatgcatagcccagggtccctgggggagcttcagcgtactaatgggttcagagcccaacagagagaagatgggtaataaggaatggggtcgggactcagcccatttgtgttgctggaatctgggcaaggtttggtggggagctcccatctggaccctctctgaagtgtcaagttcatccaatgcccccacccccaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggtaagggcaggatgctgggttccattgagattctgacacaggaaaaccccattatcccttaacattgtaagaatttgggttgaatagtcattccttgccttcaaacttgctgttctattaatacatctcgtattccttaagccacccctgttgatgccatcatcccatttgggatgctactcacactgattcttccaggaaaccctcccaactctttgcatgccctaaaccagggctggcaaacaccaagctttgtgtttccagtccatttctcacctgtgagagacatcactaatcagtcatatccctctttcctgctgagttctgagtactttacagctcagcacccaggcagccaccactgtgacaactgaccattagacaaagctcatttgccaccctggacctgagtccttgcatccaggtgcctcttccttctcagccttaccttgacccccctactccctcttatccaaagtccttgcttttcttttccaccgcttcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgagtgaggaatacttttagctgcaagtaatagaggttgtctgacagagacttgaagcttgaggacatttaattatgtcacatgagttgggaggttggcaggtccatgctatcagggcaatagatttgtgtgtctgattttcttgttcttcccctcatggttgcaaagaggctgccaaagctccaagcatcttgtcttcacacatccacatccatattcaaggcagtaaaagatagatggttcttttctgtacctcctcccttttatcagggatgaagaatctttctccagagcccactaatagacgtccctcttccccttacatctagttggc

SEQ ID NO: 86092 - DNA, 1054 bp, Homo sapiens
ggcaggcagatcacctgagttcaggagttcgagactagcctggccaacatggcaaaaccctgtctctactaaaaatacaaaaattagccaggcatagtggcacgtgcctataatcccagttaccccggaggctgaggcaggagaatcatttgaacttgggaggcaaaggttgcagtgagtcgagttcacaccactgtactccagcctgggcaacagagtgatactgtgtctcaaaaaaaaaaaaatgctagtttatgtcttaggagagaagtgatcttagagctagctgctgaagaggtagggctgtagccctggagaaggtgaagtggtggtaggtaggcttgtggtacaattgttacttggccctcctcaaagtgtgggccacagaccagcggcatcagcatcacctgggagcttgatagaaatgcagagtcctggccccaactcagaccttgtggatctgattcttcattttaacaaagttaccaggtgactctgctacccactcaagtatgggaacccttggtgtgatgaggcacagtgctcttggggttaatcggattagaggagaggcaaaggcacaggcaagggggagaaaaagagccagggaaaccttgttagggctgaaggggggacctctgcgttagtgacgtcactgtgttttcacacagcaaccctttaagataggtaattgggttcctttttaaaataaggaaaatgagtctcagagaggcctgatggtttgtccaaagagaaacagctagactgtgttgacgtgaaagttcagtgggcccactgttactccatgccacctgtcagcaggcacttgctgtttggggggatgacaggcagatgggctaagcagatggccacgttggagtctaaggcatgcaaagttgtgcaggtatggagggcaagcaagaggcatgctagaagctactcatttggagaagttttacaaattgtaatgactggtaatgattaaaaatggtctgggatggggaccaggcagtgtgattttgtaaaggttcccaggtatttctaacagacagcc

SEQ ID NO: 86093 - DNA, 1008 bp, Homo sapiens
gggggagaattgctcagaacttggaaagcgactggtctctcaggatagagaccgcgacgcaaagaagtgacggaaaagatgcgtccgccatcccttttgctccacccctgacgttggcctcggccttcgattggctgctcctcccaccagccccgcctcaggggcgcccacgtgacccgatggccgccgtgggattggttgttcggcgagagccgcgctaggctgtaagacctgagccgggcggagaagcaaaggagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggtaagtcggatttataacttgtgttgatgcttttataatctaggagcttagggtttagtaggaagagtcgctcattcaatgaattaaacgctcattcctatgtactaggcaccattccgagtgcagtggctacaaagactagtagaacatagtcctggttctttaggaactctgtgattgggcaagtgggagagagggcggaaaacgtgaactggtgagtagttggcgtgtgatgcgtgccgtagtggaagaaagtgctgtgagagttagaagagggggatgattgaaggaattaaggacatttaacagaaagtgatatttgagtaaagtttatttttgttttgttttttttttttttttgagacgggagtctcgctctgcctccca

SEQ ID NO: 86094 - DNA, 1083 bp, Homo sapiens
ttgtctcaaaataaaaatatatatatatattaattgaaaacaggccaggcatggtggctcacgcctgtaatccgcgcactttgggaggctggagaaggtggattgcttgagtccaggagtttgagaacagcctggacaacatggtaaaaccctgtctctacaaaaagtacaaaaattagccagatatggtggcctgtgactgtagtcccagctacttgggaggctgaggtgggatgatcgtctgagcctggggaggttgagactgcagtgagccatgatcaggccattgcactccagcctgggtgacagagtaagaccctgtcttaaaaaaaaaaagaaagaaagaaatattaattagaaacccatggttgaaacttacctgaatagaaggctttattttttttcataggtaagcctatgttttcttggatgtgaaactagggcactgggttgctcttaggtaatacaaggagatgaaatgcagcgatgcgatgatgagtgaagtagagcctgacctggtattgccattgcttcactgttggctttgaccagggtatgatctcttaatcttctctctgagctgattctgattgtggtttttccacacaggtgtgttgtatcctgtttggacactggttttattatgtttaagatgtttcttttattttcttttgaattactgatattctcatgttttcctccttaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaaatacaaaaattagccaggcgtggtggcacgcacctgtaatcacagctacttaggaggctgaggtggcagaattgtttgaacccaggaggtggaggttgcagtgagccgagatcacaccactgcactcaagccttggcatcag

SEQ ID NO: 86095 - DNA, 1180 bp, Homo sapiens
tacacaggaatcttcagactactctctgtaacactcaacccctattccttttttaaccagtttctcaagaaggatatggagagctcataaaggaatatcctcaaatatcctaaatatccaacttttaaaataccttttttatccttaaaagctgataaacaatagatgtcacttaacaaatgtctcacagtatatggaaggagcttttttcccccccagagtgtttctaagcatttctatcaagagcaagtctgcatttcttatcgtttgcaaactgatgaaatttccaccttacagacaggcaggtaaatgctttcttttctaaaaagaagtcttgctaccacctcactgttcactttattttttatgcggtctaacctgggtttttcgtaagagctcctttatttcttatattttaaggaaagggataggcaaaaacttgtgtactcattattctgtttaatctctacactggccctcatatcccctgccagtcctgatccttctactttaagcagcttggtcaactgtaagtagggttctagagagcaggctaaaaggttaggatcaaatgggcatatccttttaaagaaatccatataatcatttaaagttcatatagttatgaattgaggctgagaagtgtcaactcaataccatgctgaaaccagctctgtgacattacagcgcaatacttttgttgtgaggataagacatgattccctttcagttctcaggggagtagagtttaatcagatgttgtacttctgttggataacctgtgatgggacaagcttggtgactcctcacataatgaaacacacagcggtaacaaaacacatagccagaggtggcaagaacagtatcattcacccgggttttacgacacagtgggcacacagtcttcattttgggtaagaggggagaatcagagttatagtctaggtgtacaggtggtggtggagtaggcagggcagtcaatgacttgatggtttcttgattttcagatgagtaccaccagtcaaggaactgcaagaagaatacacccacagaaaggccagtagacagggataaggcaacacccccaacagctttcttcagagctgagtttatcttctcactaacactgttgggagaaaagaacaaggaggcaaagagagaaactttatttaggtatcat

SEQ ID NO: 86096 - DNA, 1050 bp, Homo sapiens
atattagtgtgtggccagggctgagaacctttgcattcaagagtcaggagacacagtgctaagcccaactttgtcactgactctgtgaactttgagcctcatttcttaatctgtaaagccgagcgtgggtaaatgaggtaatacgcgcctgctccctacctacgtttatgttctcctccagactttaacattctgatggaagatcatccttcatatactgttctctccccattgtagctagatataatgagatttggtttttcccactcttgtggttcttgaagatctggattgcaccttcctctctggccataatttaaaagatttttaaaacttactgatggcttccttgtcagtgagtcaggtaatattctagggctttgaattttatatattctataattttaaaatcttattttagttgctgccctgctatcctggtattggttattacatagtgtagtattctgctctaagtctgtggtactggaaccttaccagtttgctctcatctcttgcaggagaaatatttgaactaaaagctgaactcaacaatgaaaagaaagaaaagagaaaggaggctgtgaagaaagtgattgctgctatgaccgtggggaaggatgttaggtaagagtaatcacccttgccattgatcacttcagaggtccataccccatcttatggcctttactgcttttcctttaaaagtatcataatcatagaacctctaagaatgggtttgtcccactaaaaacatcattaggaagtgcagttgcctttgtattaatgctctactttttgtttgtttgtttgttatggggtgtgtgtgtgtttgtgttagaacagtgaaacgagtttgatttcattgcattcagatctagcataacacctcctgagagctggcacagttacaaatctttttgctgaggtcgttttagaagatgataaaaatacactgagaagcataagttcacatgatctttaactggctcaagccactgccctcaactttacaactgtacattcaattgctggattcaagatgaaaat

SEQ ID NO: 86097 - DNA, 1050 bp, Homo sapiens
tttccttttttttttagacacaggagtctcgctcttgttgcccaggctggagtgcaatggtgtgatctcagctcaccgcaaactctgcctcccaggttcaaacgattctcctgtctcagcctcctgagtagctgggattacagacatgcaccaccatgcctggctaattttttgtatttttagtagagacggggtttctccatgttggtcaggctagtctcaaactcccgacctcaggtgatccgcctgccttggcctcccagagtgctgggattataggcgtgagccaccgtgcccagccagtttctttagtaattcatttctgtgacagttaccactgtggggacatttgttcttgcatcaaatcactgttagttaaggctattcatgttctgtccaacagcttggcaccaacacctgcttactttccttttctcttttaccctctcttctcagttctctctttccagacgtagtgaactgtatgcagactgacaatctggaactaaagaagcttgtgtatctctacttgatgaactacgccaagagtcagccagacatggccatcatggctgtaaacagctttgtgaaggtaacttttcccaaggcctcaataacagagtttgaattgcaaataagtaacctctgttcacaaggaaggagtgtagggaagtgttggcaatgactaggaatgttcatgttttaagcattctgtataccagtgtgtgtcatccagggaaattcaaaccatgtgctgagctttctgttagtggggcttggtgcatccttgccagatgggtagaagaaaacctggtgaaaccccactgttttaccttctgaggctgacaaaggtgggcatatcattgtactatcagtaattgggggctttacctattttatctttgtagaaattatacttatgagtcagcagtagtggagactgccggagtttctactttcatttcatttaatacgtcttacatcatttgattaatttttttttttttttgatacagagtctcactctgtcaccgaggctggagtgcagtg

SEQ ID NO: 86098 - DNA, 1047 bp, Homo sapiens
aagcttgggcttaagaggtagccaacacacatagatacatacctactttttattttgaatttatacttttcatctcaactgtattccctacttattaccttagagtattacaactgtcattagaacacttaaatttaagtgccttctatgccatgcacagtggtagatgcttttacttacaatgtttcacttagttctcacatttctccttaaagcagaggttattccatgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcgcacacacacacacacacacacacacacagaactgcttcattttctcaaagtgtttacgtttgaatacataaagactgagttatctgaacactgcttcattatagaaatctcaaaaaagaaaaaaaaaatgaaagatacaaaaaaaaaagaaatatcaatcctcttattccagtgatggatatgagtccttattttactgctcttgaggagtgattttgttccactttttcagaggctactccacatggtggcagcactgcaccagcacatattagattctcttagaaaagaaaagaatgaatgcttccaggggttgtgccttagtagttttcttgtagctcacttcagaagggcatcctagatttgaaagcactagaatatctgcagaaatgactttgaaatcttctaatatgagagataaatgttggtcgagggctgaaaattcttggtgttatattgacctcaagtctggttcctagtgacactgtgccttgctgcaggtaacaaagctttaccatagttttgtttcctgtgttttgcagagaatcacatacatcttactttcctgcagttg

SEQ ID NO: 86099 - DNA, 1033 bp, Homo sapiens
caagactgggcatgtgttggcaacaataaatcaaaacaggcatttggccttctgatatgatattttgattctttagactataataaggtcaactaagtatgttgtgcaagggaaataaaatatcttgcatgtgaagcacatggaagggattattatttctctctttatggcttttctcatgcttgatgatagagttagcaaacaaaaattaagtcagaaaagagcctcatacatgttaccatccagtaggtgggctagataagttttcctgatttgtcttaacaagtataaaatagtatatctgtaaccatatttaccaagtgagtctctgatttttcatcttagcatctttgttctgatcaccaaagtatagcttgagatgattgcatttgtggcatcattatcctttacataataatggacatttttgtaagtatattatttgttaaataaatcacattctctagacatttatcttctagataaaatcatatgctgggataatctgaagattacacagatgatgtgaatactaaaatcaatagctagattgtagtcattatgtttcttcccttgctaacaaaatgataatcatacaaatcttaatttctctagtttttattaagggacttcagtaagaactaacaatggttttacatttttgagaatatttccaatatatataattgctgaagcttgtctcctatcacatctcatttatacttggagaatatttatttatttatttttgagacggagtctcactctgtcgcccaagctggagtgcagtggcgtgatcttggctcactgcaaccttcacctcccgggttcaagcagttctcctgcctcagcctcctgagtagctgggattacaggcacacaccaccatgcccggctaattttttatatttttagtagagacagggtttcaccatgttggccaggctggtctcgaactcctgacctaagtgatccgcccatctcagcctcccaaagtgttgggtttacaggcgtgagccaccacgcccagcca

SEQ ID NO: 86100 - DNA, 1041 bp, Homo sapiens
gggtttcgctatgttggccaggctggtctcaaactcctgatctcaagcgatccgtccaccttggcctcccaaagtgctgggattacaggcatgagccactgcgcctggctggccctgatgattttttatattttttgtagaggcaaggttttgccacgttgcccaggctgatctcaaactcttgggtccaagtgatccgcctgtttcagcctcccaaggtgttgggattacaggcatgagctatgagctaccacatccagcctgaagtatcttcttaatacccagtctgcataaatcactacaacattggttgatgataaatccagcagtttgggtttctgtatggagaacagtttcatctccacctccttgcctttgccttttctttaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggaggtaagaaggtgtgaactgtctctgagtgagaaatgactcttgtttagacagcgttgctcttctttatgcttttatagtctggaaaagaactgctgtacatttttgcttctttatgcttttatagtctggaaaagaactgctgtacatttttggacacctactactatacaaccccagggagctccatctgaataccagtgaccacacataaaatcggtgaaagactcctctgtgttccaatctaggagtacattatggctttagaaaattgtggtgaagaccttctaaattgataaagtctgaaagttgcttaagtctgcagtaagaagagactagaaataaccccatagttgaaaacttggaaaaaagcctgtgtatacatttagccatc

SEQ ID NO: 86101 - DNA, 1071 bp, Homo sapiens
agttgactggaagttgaatttgaccaatttagatatggtcgctcagtcccagggtcctttttatccttgcttacttgccataattggagaccgaaaattgagggcattttatattttggattgtctaaccattttctattcttctatcttaaaacttgatattcatgagaagatatttttattcttcctttttcatagcctggtgatcttcccttagatcttgttctgtttcatcttcttttactgtcacactcataaaattcggccagcgttaagatgtagtgagttgtgaccttttcttattaggttggagcaaaagtaattgcgatttttgccattaacagtatttacttttgctccaacctagtagaactgtcacagtcaggaaatacttatcaatttattatttatttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcgcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctgagtagtgtgatttttctcaccgtgcagatccttctggtttggtgtagtgtgggaggtga

SEQ ID NO: 86102 - DNA, 1086 bp, Homo sapiens
aagcttctaaagaatgtgtgttctcatcaatgacgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccaatttaggtttgtgtcactggggctcttcttgtcttgtcttaaccttacttgatgtcactcacattgaagttcaagaggggaaactcccggttaatgaagctcatttaagcccttgggaaaagcaccatccaggctaggccaggcttcatacagtcttacctttctgaggaccaatttggctgaattctctgctttctaatctgactccttatgggggatccctgctatagagatgtagaccagttgtccattccaggagttgtaactgtgataactgag

SEQ ID NO: 86103 - DNA, 1050 bp, Homo sapiens
actctgtcgcccaggctggagtgcagtggcgtgatcttggctcactgcaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgagcaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttttttatttgttaaaaaatgcatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgac

SEQ ID NO: 86104 - DNA, 1013 bp, Homo sapiens
tacttactgtgattgctacttccagtttgacatattcttcatgtcccatcaggactataaacatattatttaatctcatctgagaaattcaatatattatgtattagatattccttttttgctagattgtccttagtgagaacactcctttatctttttttatcaagataatcgagagtctactaagcagtatcttttgtctttctgtaaccagcactcaactactggtttctgggatcttttagcagtatatctattaataataactgtcttctttgaatggccacacataagcaatcggcaagagttccatattctgataagcaaaggtgtctgatggatcagaaatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagttttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgtgaccatgtacacataaggaatgtaaaatctcatagttggaagggatggtctttaattttgtctgtt

SEQ ID NO: 86105 - DNA, 1009 bp, Homo sapiens
gagtctcactctgttgttgcccaggctggagtacaatggtgtgatctcagctcactacaacctctgcctctcaggttcaagtgatcctcctccctcagcctcctaagtagctgggattgcaggtgcctgccaccacgctcagctaattttttggatttttagtagagatgaggttttttcaccatgttggccaggatggtctcaaactcttgacctcaagtaatccgcccacctcgacctcccagagtgctggaattacaggcgttagccaccacacctagttgtttatatgaaataaaatgtcttcctttaggttctatctgtagatcctagttctacattttgagatttttataaattaagtttctgaatcaaggcacccagggcctgaaagtcaatcaggtgggcctgtaatgaaaacatactccgtctgaatttattttcttttttttttctacttaaggaaagcctaagtttatggaaaggcatttatataatgtcagttttattgttctaattttagaagaaaatccatttagaaggagggaccctggtaaatgtagttggaatcagttatagtttggagactgaaggaaaatattatctaatcacttttgaaaagtgtgtgaatgaaagatgatccttgacttggtagcagtcttcctttccaggaacccctgaaggagttgaagggcaagtactcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgtaaggttgtactgtccaccaggcagaacataggcataacagtgaactcatttgatttttatcttgcagctaactaatctgaggatgtatgcttaatatctagaacctagatttgattctagatcagttt

SEQ ID NO: 86106 - DNA, 1373 bp, Homo sapiens
gaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaactagttcacgtctatgtctatggtattatgtaaatattggcatctccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtttctctttctctgatacagcaacatctcataaagagagaaataacctttaattctggaacgttatgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacagataccaacatgacagtcactatggcatacccacacacttatttctgtctttgtcctcttcagagtcttctttacctgtctagcacctaatttgagattgccagctccttaggcccaccaatatcataatctccaaaggtaactcgcactaaaccataggtgtaccttattctgttttcagtcctggaatgtgataggcagacaagtcatgaacctgttcttcactttttgctattgtgtgggagaatggcttctgaagtgtacacatgtccatgtgacagtacttgtcagggaactgaacacacatggctcataaggatgtgagaagagagtgtacatttgtttgagattttaactgaaggtgttggattttgaatctgtatttct

SEQ ID NO: 86107 - DNA, 2127 bp, Homo sapiens
gaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgc

SEQ ID NO: 86108 - DNA, 1033 bp, Homo sapiens
aaccatcatgagagttagataccagttttctgctggaaatacagaacatttcctgaaaccgtgtggttgaggtgaaacaggcattttgcagtcttatattttgagtaaggccaaacctgcctagtgttataaaactagacaaaaaacccaggtacccggtcttgcaggatagaaatgtgtgactaaaatgaagcatcgatctgagaagactacaaattagcgggaacctttggacaggagcatgctatacattacttagattaatgttgatatttaaggagccaggatattgatttgtttttgaggggtgcccatctacttcatataagaggctataaactgcacttctttcagtttctgcttaatccttgctcaaacaagaaataatttcttattccaaagtagacattggtacatctttttctaggtacgtaatttgggatgaagtctgataaagctccttagaagttcttatagtacaccctcacaagagtgtatcatctacccgtggtttaaacagaaattaaaattctaccctcgtggagaaatttaccaagttttaatggtttcagtcctcattaaaaacttttagcctgtcttgatctttaacataattattgatataaaacaatggcttctgtggaaagtcgaagttttagtggtttgctatttgtaaaatacaggctttttcatgtatcatataagcatataagctggcttaatcattagtattgatcttcaagttactaagacaccagatatttgttattttgtagttcgagtattttttaaaatacgaaattggcttttcggtgtgtgaaaagggctacttactagacgcttgtttttaaattaacattcaattaattaaagctagactctttatattcttaggcttggtatactatttatatgttttgtaataagtgtataaaaataatacctttgactttgtgtaaaaataatgcttttgacttgttctttgatgaatgtttattaaaatcccccaaaacaactaatgccattaataatt

SEQ ID NO: 86109 - DNA, 1032 bp, Homo sapiens
gtttaggctccaggaaactttaagacaaattaacgtaaaaatggtttctgggctggtaatacccttggtgtttctgttaaaaacatgaagaacggctgggcgtggtggctcacgtctgtaatcccagcactttgggaggccgaggcgggtggatcacctaaggtcgagagttcgagaccagcttgaccaacctggagaaaccccatctctacttaaaaaattaaggcatcctacatgcctgtaatcccagctactcagaaggctgaggcaggagaatcgcttgaacctgggaggcggaggttgtggtgagccgagattgcgccattgcactccagcctggggaacaagagaaactctatctcaaaaaaaaaaaaaaaaaaaaaaacctgaaaaacattttctggaggaaatttcatggtttagatcacaaggaatttcagataaagcaagccttgcaaaagatatgttcatagtaaattgcagagctttaggaaacatttcactgaaatgagagtcaatgacaaataggattagagcctctaacagattatctgagagaatatttttatgtttaaaattgttaaaataaacctaaaggaaggaatcaaccctaagatcaaggttggccgggtgcggtggctcatgcctgtaatcccagccctttgggatcctgaagcaggtggatcacctgaggtcagaagttcgagaccagcctggccaccatggcgaaaccccatctctactaaaagtataaaaattgccaggtgaggtggcgggaacctgtaatcccagatccttgtgaggctgaggcaccagaattggttgaagctaggaggcagaggttgcagtttgagacactgcactccagcttgggtgacagagcaagactctgtctcaaaaaaaaaaaaaaaaaaaaaagatcaaggtgttaataaaacaagccacatagatttgaaaaagaatcaagtaaaacgtttagaattaattaggaaaagtgaataagttggaatagcagacctagcagaagaaaga

SEQ ID NO: 86110 - DNA, 1029 bp, Homo sapiens
aggagtttgaaaacagcctgggcaacgtgatgaaactcccatctctacaaaatacaaaaaagatcagctgaatgtggcggtatgcatgtgtaatcccagctactcgggaggttgaagtgggaggattgcttgagcccaggaaatcgaggctacagtgagctgtgattgtcctacagcacttcagccttggcaacagagcgagaccctgtccccccccccccgcaaaaaaagattaagaaacatgggaaatagattaaaaactcctgtcatacatctaataagagattgagaaggagaaaatggaggaagaatcaatagttgatttccaaagtaaatgaacattttgaattgaacactagatttaaacatgaaacattcatacctagatacattgatgtaaaaatgcaggttatgaagtaccagtaacctactagagaaaataggaagcagtggtatgattaataacagactaattaaatatttgaagaagctggaaaataatgaaattatccattagagtttagagagaaagtaaccattgactttgaattttcttttttctgttttttttgttgttgttgttgttgtttttgttttttttaagagtagcggggactgacaacaggtgcacactgccttacctggctaatttttaaaattttttgtagagataggatctttctgtgttgcccaggctggtcttgaactcctcagctcaagcaatttgcaaacaccaaccaaaaggtgattttttttttttgagatggagtctcgctctgtcgcccaggctggagtgcagtggcgcaatctcggctcactgcaagctccgcctcctgggttcacgccattctcctgcctcagcctcccgagtaactgggactacaggtgcccaccaccaccacgtccggctaattttctgtatttttagtagagacgggatttcaccatgttagccaggatggtctcgatctcctgaccttgtgatctgcccacctcagcctcccaaagtgctgggattacaggcgtgag

SEQ ID NO: 86111 - DNA, 1132 bp, Homo sapiens
atgttatagactgatagaattcacttgaaatttagaaaatacataattattttcaggcacacagggaacatgtgccaagggggaaaagcaaaacaggaaatctgagcaaataccaagaataataaaataacttttctggctgcagtggaatattaggaaaaaacacaaagagaatcaaaactatacacttggaaattcaaaagcactttaaatttaaattcgtaggtccagacacaaagcacaattgtcaaataatcacaatgaacagttgtttaggatgccttaatctataaactgattttctctgatgaatgtaaaacacctgcactttatcactcaaggatttataccaagggacagatttactagtcagtacgcttatttctatatcatctgggagtttttaagctagccagctaaagaagttagatttataatttcagagggctgaaatgactgggttaagattaagggccttactgttagatttgagatagggttacaggacctatgtgctgtaccctactaaaattttgcctgaacctaaagaaaatatgctgcgattatgtattttgtcactgggagaacctacatccatgcttcaggatatagtttaacctaaagcttcatgcatccacaaataccttgttttactcattgttttccccctcataacccttttcatcctttgatttgggataatctgatttcctgtcatttcatagaggcatctaatctcttaatggtctaattagattgtgtattcttttccgatttttcttaattggttgttagctacaactctagctatcttctcatgggcctggcagtgatgtgtaattttttctttttcatttcagctagttttatgccctccatattcatagaagtagtagtttgtgtcaagatttcatttaatactttttttctcttttgagacagggtctcattctgtcgctaaagctggagtgcagtggtgcaatcatgacccactgcagcctcgacctcctgggctcaagcagtactcctgtcctggccacccaaaatgctgggattacagggatgagccactacacctggccttcatttactattcttaagcattaaacaaaatcttgttcggtctaattgg

SEQ ID NO: 86112 - DNA, 1521 bp, Homo sapiens
tttcataaaatctgctcttatgcgtcacatacttggtcattcatttgactctgagtaaagcctgaaggatagataaatagaacctcttcagtaatttttgatatgattgacattttgaagtattgagaaaagctcatagttcaaattctttattttttatgttaccacccccaccccacccccacttttttttttttttttttttttttttttgagaagtgtcattcagtcgtgcaggctggagtgcagtggcacaatcacagctcactgcagccttgaccgcccctggatcaggtgatccacctcagcctctcgagtagctgggactacaggcacatgccaccatgcccagctagtttttgtgttttttgtagagatggggtttcgccatgttggctgggctgatttcaagccatctgcctgcctcagcttcccatagtgctgggattgtgtgagccaccatgcccggtcccttggtcatttttttgattgctaaattgaagctacaagcaggtattgctgacttgctgtgccaattggctgaatccctgaaagcttggtaaaatcagaatagagcaactaacttagctgctttttttttttttttagcaagtctttggaaatatttttgttggtgctgacagccaaagcagtccaatacagaggaatggtgtatatcttggggtggtaaggatgttcaagtagatgtaatcctggggatgtcatagtgcatgtctttcccctttttggacctgattagttttaacagatgtctttttgtatataataatattgcttaaggtcttgagtctgtttaaagaatggattttcactgtttacatttgttcactgggttcttgtgaccctagcacacatgtagaatagtagtttgcaaatacgtagttattgtaaaaagtaaatactatttgtacaaatttcttgtttcatagtatttaacttgagttagtttttctttctgcagttctttacattttcttaccacatttcttctgtatgagctaaagtcagcctttgaaggaaccataattttaaataagatttaaaattctttttatgtgttctagattctggaagttacggtcagtctgggggtgagcagcaaaggtaaagtatacatacattttaataatatgaaagggtagaactgaggtgaattttgtcaagcttcttctcttgagacttgatgctggatgtcataagttaaatattagcttgtcacagagtgaagagagtcagtgtaaataggtgctgtaagacatttattccctttctgtttttctttatgttttgagacagagtcttgctgttttgctcaggctggagtgcagtggcaaatcatagtgtactacagccttaaattcctgggcttaagcgatcctcctgcctcagtctcccaagtaactgtaatctccactacagacatgtgccactctactgggcttcttccttttcttttttttttgagactgagtctcgctctttcgcccaggctggagtgca

SEQ ID NO: 86113 - DNA, 2234 bp, Homo sapiens
ggacttctagtgcctccctgtgcatcttttaggaagttaaagccatttaactaaggcaaatggtgggaaaaaattaatctgtcaagatgtgattaaattgagtaaggtgttcattttttgtgtagtcatcatttttgtgcttcaggtatttattataagtcttgctatgtagtttttattccccccacacccaagcataattctcttggaattttctagctcttaccaagttttgtttatttctgcaagattgtgaaaacaaaactttgggtatttgtttcccattcaggagatctgggagtgacttcatgtatttctttaacagtctttgatcgtcacctttcaatttagactctagagacagggagattgatgatttctcagcaaagaagcttgtatttgagttgaaagttgaaaatgaaggcaaggtcttcatttaaactttaaaatttctacacatttctttcaagtattaaatttttcttttgcagttattctacctatggaaatccaggcagccaaggctatggacaagcatcacaagtaggttgaaatataaattgtattcttcataagtagttatttttatcttaagtaggtgatgaaacttgagtatttacctaaatttcagagctattctggctatgggcaaacgactgattcctcttatggacagaactacagcggttactccagttatggacaaagtcagtcaggttggactagtttgttaaatttgttgtttcagagattgaaaaatcagagccttcactaaatgatatactcatctaatctttaggttattcacagtcctatggtggttatgagaatcaaaagcagagctcatatagccagcaaccatataataaccagggacagcagcaaaacatggaatcatcaggaaggtaaggaaatagtaaaatactgagattgttttgggcagtggaaataacactgatattaaacagatttaaccaacaaaatcctagctttaaactttttttttttttaaaggaaattttaatggagtgtggattttacaactgtatattatggagaatgtggaaatagcattgtcatttgattcttatgatgtatttgtgaaatcattgtttagctataaattgatgtccttaaaaatgttagaaaattttggacctctgctttatccctgagattaaataaaaacctgtctttagaattaagacttctcaacatctatttttaaatttccattttatttttgaaccatttgaatatattaacttttcagggacaaaaatattttttaaaagggtcaaaacttacgcatatatcagataccctaaaatgtgttttctttgatatatgtaggtgaatatttactgataaatttcaggttttataaagtttttttacctttcagatttaaagagctggtacttaattttatgctatttacttaatagcaagttactttttaaaaattgtgctttacattctgtgaaatgcttttgcattctctaatgtgattgatcttcagataccactatgaaatagtgtcagtgattcccattttacagagggtaaagaaattatttggcctatcaagtgacgtggctaaaaactgaggtctctagtgttttctttctacagtgaagacatttattctaagtgaaaattaaataaaagcattgaggaaagattggtgaggtcaaattatcacccttacagatgtgagagtgttttgaaaagtagaaagtagagtacaaatgtagggaataatatccagaaggcatactacattaagagaaataactcttcaagccttgttggttagttttaaatttaaggagaatcgttttataaatgatgtatttttggaagcatgacctataaatatagtctgaaaagaaatgttaagtttgatttgacagccattttaaagtgctagggtttggactgtggttgtgttgtgctttcgacagggagttagggaacatactgatcttttattagattgttctgatcctctggtgaagaataaaatgtaaactattaagttatgagatcttttttgtccccccccagcccatttttataataagtaaacctactggaactcaaatccaattaaatgttgccttttaacattcccaccctgagagcatgtaattaatacagtaatattgttctgaagatacttagaattttcctttcaaatcgctagaataagcagtctcattacctgatag

SEQ ID NO: 86114 - DNA, 5055 bp, Homo sapiens
tggcgggcacctgtagtcccagctactcgggaggctgaggcaggagaatggcgtgaacctgggaggcagagcttgcagtgagccgagattgcatcagtgcactccagcctgggctacagagcgagactcttgtctccaaaaaaaaaaaaaaaaaaaaaagattggggtcgtgcttttcatctaagttactaaggttcttgtagctaagattgtattttaactcatactgttccacattactgttttgccatgtcactttagcagaatggaatttgacacagatacattactgttttgccatgtcagtttagcagaatggaatttgacacagataaaattctcaaaaacatgtaattccagatgattttatgatgacttgcatttgagttgtgtgcacatgtgccattttctataaggatatgtgtggcctaaagagccatttaacattgttatttgaagctttagaaatgagagtggttatttgtgtgtaatattttcttttttgtagatgaccgtcgtgatgtgagtaggtatggagaagataatagaggatatggcgggtcacagggaggaggtagagggcgtgggggatatgacaaggatggaagaggtcctatgacaggatcaaggtaagtatgtagataaagatgcgtacatttcttcttcttcctcttttttttttttttaaggtgttacttggctggatcaattccagcatctaatttagttaagagactttaaaaagggattatatattggagaaaaaggcagaaattaaaagtgtattttcagtcttaatatctcacataaatgaccttagaattggctatgttagtagttagtttatgtggtacatgttaaacaccagtagagaaacaactatggttgtgattaaatcacttgactttcctgccagagctagaatcttaactcctttaaaagacgactctgggaaatccagtgtttgtatgtaaaaataaaaggtaagttaattctagattgaggggcagaggctatttcttaatctccaatctccttgggaagggaaagtattaggaggcagtaatggagtagaaaggtggggatggcaaataagagaaagatttaatgtaacaaaactgttttgtccctcttcttaagtaaataattattggaataattagtgtaacatcacatagtaatgtgtattttgtcttgactaagttgtgtaaaggaatgtctttttaattcagcttttcttttctccatgctagtgttatcaggttttggtatttatttacttacagcatatgttatgaagctggtttgaaaattggttttagatatatctgcaagtttactactttgactgtaaaaaaaaaaaaatgaaaaagtagttgacatctgtcctcagaagaagtttgcaggttgcatatttgtgtgtaaatacacaggctaaaaggtaatttatgttccttgggaattgaaatggtcagtggcccgttacagaaacttatcagtcatatatcagcaccagttcattcttttgcaccttagggaccatctgtcccctgaggtgacctgagaaacaaccagttgcccacagactgttatttcttcaagtgagccaggatttgatttcactgccttatattctatttttagtgtacagtgctttgattttttggaaaaactaaattttaaacatatttgaaaaatgttataagacttggacattaagtctgttgatagccaaagtcagtttaccaaagtaaaacaaataaattctatgcttcttcattgtcaaagagcagtctgccatcatgtggatataaatggactatgtaaagtgacatggtgcttactctctacctaataatagcctccctcctgttccaaacaagataaccaacaggtatatttaatttaccagttaatatgttttggataattggctgccttgaaatgctatatgttttatagtacatcatagctttagttttcttcataaggaaattacagttacatcctaatcgattattaaactatcactgtgtctaagaatggtggaagaagatagggaataggtagggaagtcattataaatatattttcactggccaggcatggtgacccatgcctgtaatcccagcactttgggaggccgaggcgggcggatcacgaggtcaggagatggagaccatcctggccaacacagtgaaaccccgtctctactaaaaatacaaaaaattagccagacgtggtggcaggcgcctgtagtcgtagtccgaactactcaggaggctgaggcaggagaatgttgtgaacccgggaggcggagcatgcagtgagccgagatcgtgccactgcactccagcctgggcgacagagcaagacttcgtctcaaaaaaaaaaacattaaaaaaaaatgtattttcatttgtgactcatcttgtaactagaggatcgaaaggactttgaatgatcctcctgacaaaggagggaagcagtaccttaatcaaccctggggtccaattaagtacttttataaaccccttgcaacatacttcatataatttgtggcctagatactgacttataaactaaattttttattttcctttaataccccttaatacaaaatcatatgcagaagtccaatatctagttggtccaaatgatgtgctgatctggtttcagtgggggaaaggtcgggtgaggaagggatctgcaatcttgccttatactctgttatttgttgagatgttcatgaaaggccttttttagaaatccgtatggatgccgattactctttatattgagttggcaagctgtgtgaaaggccagatagtaaatgttctgggtttggtgaaccatatggtttctattgtaactattcatctctgcccttggagcaccagagcagccgtaattaatatgtaaatgaataaacagagttgtgttccagtaaagcttcatttatggatactgaaatttaaagttcatataatttttttttttttttttgagatggagtctcgctctgttgcccaggctggagtgcagtggcaccatctcagtttactgcaacctccacctcccaggttcaaacagttctcctgcctcagcctcctgagtagctgggactacaggcgtgtgccagcacacccggctaattttttttttttttttttttttaagtagtgatggggtttcaccgtgttagctaggatggtctcgatctcctgacctcgtgatctgcccgccttggcctcccaagattacaggtgtgagccaccacgcctggctgaagttcatattatttttatgtgtcataacacataaaattatttttatgtgtcataacatctttttaaagatgtgctttttagcttatttattgggataaaatgttttgaatttgaatatagatgccctgttttaagatttttttttcccacacagttttgcatttaagtaccagaatacccaaacatttttcattagtcttcatcaacactcccgtttgtgttctcagtcaaattaaaaatagcaattcttggccgggtgcggtggctcacacctgtaatcccagcgctttgggaggccgaggcatttccactaaaactacaaaaaaattagccgggtgtggtggcgggctcctgtagtcccagctaccctggaggctgagggaggagaatggtgtgaacccaggaggcggagcttgcagtgagctgagatcgcaccactgcactccaacctgggcaacagagcaagactccgtcgcaaaaaaaaaaaaaaaaatagttcttttgggggctgtttgaagaatatctggcattagttgggtttatattaaaagaagaaggggcatgggccaggtatggtggctcacgcctgtaattccagcactttggagggcacagcgggtggatcacctgagatcaggagttcgagatcagcctgaccaatagggtgaaaccccgtctctactaaaaatacaaaaaattagctggacacgatggtgggtgcctataatcccagctactcgggaggctgagacaggagaatcagttgacctgggagttggtggttgcagtgagctgagatcacaccattgcattccagcctgggcaacaagagtgaaactccatcgcaaaaaaaaaaaagaaggggcataatttgtggatgaggattggatataaggtaaaggatgggacattcttggacttacagatggtgtgattgcctggctagaagaagaattcccggtcaaaaagaaaccatcagctttccaagtgtgaaagagagataaatctgtgaagattatagggactacaggaaacttaatctttttctttgaaaaagcaattgtagcaaaaaaaaagaaaatttcttactgtcatctaaaattgacatggacatcttagtggactagaagttaagggcataaattctcccagtgatttttaattttagcattgtgattaacaccttctaaaattgccagaacttaataaataattgcttttcattattagtatgccatcaaatttagtagctgtttcaggctttaatgtgtcaagcctaaaatccagatttttgaggatcttctccctcttaaaagagtattcagttaactgccgtagaaatacacatgtatacaagggcactgtatacatcagtctaaaaaataaaaatatgtatacgttctggtgagtctagcacagcattgcccaatagaaatacaatggaggtcacaaatgtgacccatatagttaattgtaaattttctaatagccacattaaaaagaaaacagcacaaataaacaaatgagaaaatctatttaactcaatatattcaaaatatttcatcatgcaatcaatataaaaaatttctttttgttggtcatgatggcctgcgcctgtaatcctagctacttgtgaggctgaggcaagaggattgcttgaggctaggagtttgtgactagatgggcaatatagtaagatgtcatcttttaaaaatgaaaaaattagctggccactgtggcacacgcctgtagtcccagctacttg

SEQ ID NO: 86115 - DNA, 1576 bp, Homo sapiens
ttgggggaactgtctgtgtttgggtcaagaatatgcaactggctgggcacattggctcacgcctgtaatcccagcaatttgggaggctgaggcaggtggatcacctgaggtcagggcttcaagaccagactggccaacatggtgaaaccccgtctctactgaaaatacaaaaattagctgggcatggtggcaggtgcctgtaatcccagctactcgggaggctgacgtgagagaatcgcttgaacccgggagttggaggttgcagtgagccgagattgcaccattgcactccagcttgggcaacaagagtgaaactcttgtctcagaaaaaaaaaaaaaagtatgcaactagctgggggctgtgacgcgtacctgtagtcccagctacttaggaggctgaggtgggaggatcactgatgctcaggagttcgtgaccagactaggcaaaatagcaagacaccatctcaaaaaacaaacaaaaaaaccagctagttttcttatgcagggggtactctgccaataaagttgagtatgcttatattgtgtttctgttaaatatctctgctacttcaggaattctttatgtgtaaatgttttctgctttttctgggaattaaagcaaatttgttgtgtcaacatcttgactcagatgttcaagtacctttgtgtcttgatttgccttagcatgtagaaaagggacttgtaacattaatgcagatttgaaagaaagattgttaacctcaggcacatcttctgttaatatctaatagtactacttgaaggttattttctgtatttaataaattccttaaaaaggataattttctaataagaagagagaaaatgattgaaacgtttgaacttgaaagaaggctttgcataaaattacagatcatctagatcaatgcctaaaccaaatgtctagacattttagacttaaatgtgcatatgaattacttgggggatcttattaaatgcaggttcttattcagtaggtctagggtggggcctgagatcctgcttttctcagaaccttccaggctatgcttacgcttatattccatcatgttttgattagtaaggggacagacccttattttgttaaggagattgaagcttatggagaaccactgacatgtccagattttcaagattgattagttatagttaagactgtaccctgagtttcttgaagactagttctttttccagtgtactatggtatttccaaatttatggccatgtgttgaaatcttcagctgctttattttcaaaggaaatgcacagtaaagatgacgttcaaggccgggcgcagtgactcatgcctgtaatcccagtgctttgggaggccgagacgggcggatcatgaagtcaggagattgagaccatcctggctaacacggtgaaaccccgtctctactaaaaatacaaaaacaaaaattagccgggcatggtggcgggcgcctgtagtcccagctactcgggaggctgaggcaggagaatggcgggaacccaggaggcggagcttgcagtgagccgagatcgcgccactgcactccagcctgggcgacagagc

SEQ ID NO: 86116 - DNA, 3038 bp, Homo sapiens
cgggcgtggtggcgcctgcagtcccagctactcgggaggctgaggcaggagaatggcatgaacccgggaggcggagcttgcggtgagccaagattgcgccactgcacttcagcctgggcaacagagcaagactccgtctgggaaaaaacaaacaaaaaaaaacctctgagataccttggtttctattaataatattttcagcagtttaatctcaactctgttggcttccctttcttaaagagttaggcagtgatatacatgtcatttagaagtaaagggagggctttagtactgcctgttctgaagtaggagtcttagaaattcagtggcaaactgtataggaagggcctgagtttcatattgtctatattgccttgaaatagccttagtctcctgcttaaaaaggcatcctggaaatcatataaaaagtaacaacaaattaaaatgcatgtgtctgtacctaaggcagctgtaagtggaaatatttttacctcatagtgaaatagaatggatgtattaagaagggagaattttttttcagagtgttttatctcagtgtggctcagaaaagccatttatagggtagggtaatcactagagttgagggttcctccccccaccccccataagattggtatccataaagcagagatttctaagcagtgagagacttcagtattttagattagattcttgggttataatagaataagatcattagtagtagaacatctggtatcagaaaacttgagtgtttttattgccatgttagcatatgaatcttaaaggattacagaattcagttaagagaaacaagcttttattggatgggtatttaaagagtttcttgataagagagaccttagatttcttacgtaaagccatgttcacaaggaccactgtccttgtgattctaatttgccagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaagttgtcctgtttggaatatgttgcctgctgtctgtaatgtgcactactgatagtgtacagagcatgtggcagcatgaacctccgtagctctgatgtgaagagatgtagtatagtgggtatagagtaggagggcggtttttaagtgatgctcttttagtcttttataagggttttgaatgatttgaaattttaagactgcttttattcagtctcaacttttgtgtatatttgtatttcacttttaaaattcatctcataaaatccactatttggtatcatagcagatcctaatactcaagtttttattctctcccgttctaccatcaaaatcttaaccttgctttgtattcttctagtcttttttctttttctcatatttagaaaataaccgtttggaaaaaatacttactctagtttagtatttttcatgctgtgcctccagctttatgttatggtttaatagtatccctttggcttggggttgggaagatttagaaataagagtatattagatatgtaataagcttgaaaagacatcttgtggaaatagatccttgggaaaacacttagatggaaacaacatttagaactctgtgaaatggaatttactgaaaacttagaggtgctactgttttcctaagcactctacttgtgacagttaagtgtagattgagcccagggctcagcacattagagacttaaggaagaaatcatttcttcaatttttcctctgcagtggtggtgaccgcggtggcttcaaaaattttggtggtaagtgctgagtatcccaaaatgtttcagtggaaatgctatataaatctaaaagccaccaatatcccgcagatgtagtcaaaagtcctttcttactctgttgaggctggtgtgtgttgtgtgctttaaaaaaaattttatatatatatatatacacatatatatatcaaagtaaacattaaaaagccaaagttgatctcaaaacagtccaatgggttttctacacagtgaatttgcatgaaagagtctgtggtgaccaatgaatgacaccttcactggattttgacaatttgttcttataaaggtagctgacatggtgtttttaaattattagggttgtccaatcagcctttacaaccagagcttaacaaaagtgatactagcataatgctaaagtggcaggtgctgtctaggacaagttaaaggaaatgttgacattcatcttgatttcctaaactttaaataaaacataatttatatatttactttgtaaatctgtgatggttgactttcaaggattttggaagtattgacttttcatgccttggtttattactattttttttgttaatgattttaaataaattgccttaaatagctcttttttcttttcttttcccttaggtcacagggattatggacccagaacagatgctggtaaggtttatggtggtttgtcactttgccattaagaaaatgttagttttttttttgatgggaaaagtgtgtgtttggaggggcttagtacaggaggaagatttaatttgatagtgctgccagaactggggagctttatttcttttttttttttttttttttttgagatggagtttcgctcttgttgcccaggctggagtgcagtggcacagtcttggctcactgcagcccccacctgccgggttcaagcagttctcctgcgtctgcctcccaagtaggtgggactacaggtgcgcgccaccatgccctgctaatttttgtatttttagtagaggcagggtttcaccatgctggccaggctggtcttgaactcctga

SEQ ID NO: 86117 - DNA, 2031 bp, Homo sapiens
aatacttgaatttttactgctagttagcattaattatttaaaattattgcaaatcagattaatgaaagaatttatatcattgtggaattagaagtagaaaaactatttaagaaagaaaatcctacgttggattggtagtctgcttaagtgtgctgacttagtgaattcaagaaacctaaattcatacatgagagaattgtcttattttgggtagaggtcactaattttctgtggctttttatttaaatgaaattcaaggctacagatttacctgtggagcctgttgaaagttataatttagaggttaaaaatctatttgagctaaaaatttgaaatcagaacttttgtttttattaagatgccaaagtattctatgtggatggcaatttctgaattatcccttcatggactgaattcttatacatctttctttctttgttgtactaatccaaaagtgtgcatgtcaggtaacatgtacaaggtgcctccgcactctggtatatacaaagcttattgcaatgaatgggaaaccagcagttctgctttgtggcttgcttggaagttcaaagtatcagatttggagaattttgtactagagaatcttaaaaatgtttaaccgtaaagaattagagttctccagagaaagaaatgctaaactaactccatctcttcatgacgtttagccctatgtctgaatctgaagagtgaggtttgtaagatcatccttaattggtatataggtatttcacatagtgtggacttgatccactttacttgaaatttagttgtaagaattgatcaaccaaataattactgtgaatactttgcatgtttatataaggttgttcttatattggtcctttccttttggtcatagaaacaattgaatattggacaataaattattgtctttgattactgaacagaatgtcataaccaaggaatatgtaaaattaaccatcactttttttctcttagattcagaatctgataattcagataacaacacaatctttgtgcaaggacttggggagggtgtgtctacagatcaagttggggagttctttaaacaaataggaattatcaaggtgagtaaaaatattatatgttgaaaatctcataattaatgttctgattacaatacatagactatgtagtaagcctacatacttcagtacgccttgtctcttaaaattttgtgatgcacatgctcgtttatgtctgtagacgtttgctaaatttgttgaatatatgaagattttattccttgcttgtgtttacctttccacagtctacctgtgctttagcttccatcttaggactctaaaattagtctctgcttagttcttataactgtgagaaataaaggagttgctgagaacattttatagactgaaatatatgcaagttcaagttgttagagctcttgggaggggttatttaatgtttatgctagagataatacgttatcttgtaattgctcattgttcactaaagcgtcttttgcactattttcatgcatatgtttttcatctcttcaactagaaagcagccttagtaatgtttagatagtaacagtttcttgaaatcagtttacatctgcccttgttttggtgtctgtggaattactcttttttttttttgagacagaatctcactgtttcaccaggctggagtgcagtggcgcgatgtcggctcactgcagcctctgccttccgggttcaagtgattctcctgcctcagcctcttgagtagctgggactacaggcgctaccacgcccagctaatttttgtatttttagtagagatggggtttcactgtgttggccaggatggtcttgatctcttgacctcaagtgatccgcccacctcggcctcccaaagtcccaggattacagtaggaatgagccaccgtgcccggcctactcacttttttctttctttgggagttataatttgttaaggaattaattacacacaaaatatgtaattttgttgttgtcgttgttgtcttgagacagggtcttgctt

SEQ ID NO: 86118 - DNA, 1050 bp, Homo sapiens
cacttaatcacagcactttgggaggctgaggcaggaggatcgcttgaggccaagggtttgagaccagcctgagccatatagcaagaccccatctctacaacaacaaaaaagccgggcgtggtggcacttgcttgtagtcccagctactcgggaggctgaggtgggaggatcacttaagtccaggaatttgaggctacattgagtatgatcgtgccactgcattccaacctgggtgacagagtgaaaccctgtctcaattaaaaaaaattatacatagataaaacagtatactatatcatttttatagcttggttttcacttagtgtagcttagagagttatgcttgtctaaacctacaggtaacttattaggtgcatagtattttatagtatgaatgtgtgaattccttgtaaaaaaaataaatctttgattatctaaatgatacatgattacttattttaaaaatgctaacaccaagtgtttctgtttttcctcagacaaataagaagaccggaaaaccaatgataaatctttatacagacaaggacacaggaaagccaaagggggaggcaacagtgtcatttgatgaccctccttcagctaaggcagccattgactggtttgatggtatgcctcattcgtatagttttcagcatgaagttggataaatgttttctagtctgaaagtgagaatatgctctgggtgacagtgattatattcatgtttacttttgcagatattaagaatacaggtcagaatttttatgtacctttagaaatgagatgagctctatcgttgttggtctagcatatttcgttatatcatgccttgtgcatgaggctaccctgatacagatgtagagagttggcctggttgacagtatgttattttttctttttaaaaaaataaatttaaaaggtacagagatggcattttgttacatggatatattgcatagtggtaaagtctggggttttcctgtatctatcacttgaataatgtacattttacccattaagtgatttctcatcccctgactttatagtttg

SEQ ID NO: 86119 - DNA, 1030 bp, Homo sapiens
agtaatcctcctgcctcagccttctgagtagctaggactacaggcgcatgccaccatgcctagctaattaaaaaaattttttcagagaaagggtctcattacgttcctcaggcttgtctcaaactcttggcctcaagtgaggcttctatctcagcctccaaaagtgctgagattacagatataagccactgcacctggcctttttctccacccctgacaccatctccttccccaggctggtctcgtgctcctggactcaagtgatctcccacctcagcctcctgagtagctgggagctggtgctacagacacataccactccaccttgttttttgtttttgttttttttttaagcttagtaagaagtgactgtctcccagtgacagatatgctcttttcagtagataatgtcacttttagcactgttatcttgactctttgcatttgaatttctgtgaggacatgtcagttactcctctgaaactaaagatttccaagactttttcatttttgttgacaggtggaggtatagagtagcattgcttcaaagctgatttcttttttcttaggaaaagaattccatggcaacatcattaaagtgtcctttgccactagaagacctgaattcatgagaggaggtggaagtggaggtgggcggcgaggtaagatccttgctgcgtacagtcctggatactatccaagggtttaagtttgagttcatactctgtttctatttgtgtgaacttgctactgctttttctctcgctaggtctttttccctctatcttaaaatgagttcaggtactgaatatattaggtaaatgagatatcgtaatagctaagaaagtagtgggaaatggttgtagaaatccctttggaaagctttattgtgatttgctgttcacttggaaatcaggaggcaattttttttttttggtttttgtgtttcttttgagatggtgtctcactctgttgctcaggctggagtggagtggcgtgatctcggctcaccacaacctccgcctcccgg

SEQ ID NO: 86120 - DNA, 1044 bp, Homo sapiens
ggatacagaaaggggttctgagtccattagaaactatataggagcattatattttcctcctttcttaggtcatgcggaaatatgaactttgctcgaaggaattcctgcaatcagtgcaatgagcctagaccagaggactctcgtccctcaggaggaggtgggtcagccttttaatagcatctgcatcgtgcttatcttctgactagcattaagggggctttacgttgtttctgctggcctcattgtttgcatttctaccttgcagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaaggtgagtattagaatgtgtttattaacctttttacctcactgcacctagattgggggatttgaaccacattttaacaattttttggaacttgaatttcccattgccagttctctcaggatggagaagatgatttagtttcctgcttagcaatttctaaaattttgttttggaactttttattttttaactttaatttttattttttagagacaataaa

SEQ ID NO: 86121 - DNA, 1106 bp, Homo sapiens
tgaacactgcttactgtatggccaatactgtaaagtgttcttatattctttagttctagtccttctgtcattcctatgaagtaggtatacttcccattttacagagtcagtcatttagtgtaacttttccaaggtcacatagtaagtggcagatccagaattcatacatgtaagtgcttgctcattccactatgccactctcctatttagagtgctggaactgggacagtttctgatcttctgaaatatttgtggtttggagttttaagtggaaaatttttaagagagtgaagcaaagcttcttctaggaactttgtgaatcttaaagctggtaaattagacatttaagtatcttctaggagtacagaaataaatgaggcatggtgtcattctttagaaattgtctagctgatgccaatcactagtaccctgaagaagtgtctaatgctcccccttcgtagaaaattagaatttagtccggctctttatttttcattcctagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggacttttgtacatactagtgcattgttctgtcacactcaggactcagttacattagactctaatcctaaagaattaggaaatgaattatatacttcagtaaattaaaatgttactttaaacaatatttattgagctcctactgtgtttagtggttcccaggaatgacaagtcagaatcacctgaagtttgttaaaattagattcctaggttgttaaatttagattcctagattcccagccctctaggtctgctggatcagagctcaatgaggtatgg

SEQ ID NO: 86122 - DNA, 1043 bp, Homo sapiens
ctgtttttgaactcctggcctcaagtttcaccacattgaccaggctgttcttgagcccctggcctccacctgcctcagcctccccaggtgctgggattacaggcatgggccaccaggtccagccaaccaaacctttttcgatgagtgattccagcccttgatgcataggagggtagggtctgtaggagtgtagccttaactgatcaatttgaaatctctgggtgatgtgagacatgtgccaggttcttggctcttatctcccttctagtacctcaggaacttccctactagatggaggtagtaaaaatgggccctgccaggatgtacctataacagagccattcaaccatacgcttgtgccatctgcccttagtcatgaaggttttgagctaagaatcgtggatgcttttttattttttaaacatatagcaattatcattcaaataggcaccttaaatccatttgttttggttggatttaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcactctatagtatgctttcatttgctaaattatttcacaccaacaggctcaaatttgttctgtgtgacatttgtgaaaaaaaatgacagcaaatattgtccccagtttacagatgtgaaaagacttgcctcagttcccacagaaaatgtttaagccaggtcttctttaattgcttacctatcatacagaatagtgattataagttttggacgcatggatttgagtcctaactctgtctcttagatttttaatgcaattaggccgggcgcggtggctcacgcctgtaatcccagcactttgggaggccgagatgggcggatcacgaggtcaggagatggagaccatcctggctaacacgatgaaacc

SEQ ID NO: 86123 - DNA, 1048 bp, Homo sapiens
ttttttgagacagtctcactctgtcacctagggtggagtgcatggcaccatctcggctcactgcaacctctgcctcccaggttcaagcgattcccctgcctcagcctcccgagtagctgggactgcaggcacgtgccaccatgcctggctaatttttagtatttttcgtagagacggggtttcactatgttagccaggatggtctcgatatcctgactttgtgatccacctgcctcagcctcccaaagtgctgggattacaagggtgagccactgcacctggtgttatttcatcttttaacgggttagtaacttggggagggggatgggtggtgggttcatcttatctatattcaggtcatattctcaagcaggaactactgaatgggaagacagtaacaatttttcattgcacacttggtattgacaaatctcagatctatccaaaataaaatctctagcggttgtgatatttatgggtctatctcctatgattttaggttcgtcttggcaccagacataaggcagttcaacatcaagcccttgccctgaacagttccaaatgccaagaactggcgaattactactttggtttcaatgggtgttccaaaaggatcatcaaggtaaaccttgtagattttttttcacttaccacactctcctttcaacattgaaatcctagattttagacagaagtattgaactggattgtagggaggagatgtgagaggcctctaccattgaggataaattgacatgtctgaattggcctgctacctagaattaataatctcagtcaattggatggtggtatccgtaattttctccactgtttttgtggcatataataaaaaatggttgtctctatctagcaattcatttgcaaatctaacttgattttgaagccataggacacctcaactgttagcttgaatgactggagtgtagttgttttttgggttttcttttttttattgggtttttgttttgttttgttttgtttttgagacagaggctcgctgtgtcatcaggctggagtgcagtggcgc

SEQ ID NO: 86124 - DNA, 1015 bp, Homo sapiens
ccgattctggttcgcccaatgtctggacttgtcctttgccaagaataagcagatgagatgggcggatgaaccccaatgtccctgcaagattcaggaagtcccagccagaaagtaaaggacgtttagttccatgtattgttttcttttttacatgcggggcaacacacctggacagtgtcgatggcttgctccaagccacacggccgcatagggacagggactgggctacataacaagttcttcgacgctgtgatctaatcaaggaaaacctgggacgcagctaatagatgcgcatcgagtgtatcgacgctctaagtacgagggctggaacagtgagcaggatcagtccattgcttttgcctacctgctgagcgctgattggtccccgtttaggaaacggaaaaaggggcgtgcacgcgggcgcggctgcgtgagaggcgcgcggcggcgcagtaaacagtctccttccacaaaaccatggcgtcgctcaaatgtagcaccgtcgtctgcgtgatctgcttggagaagcccaaataccgctgtccagcctgccgcgtgccctagtgagcggggaggtcgcggggtccaggggcgcgggtgtccggccatggcgggagggcgggaggccgggaggccgggcgggagcgggcgggctgctggaggggccggggaccctcggggctgacgcggcctgtggcctctgttgttacagctgctcggtagtctgcttccggaagcacaaaggtgagccccgtccccgccagccctcgtaccactgcgcacggggcagcccccacgtccagcctccgtcttgggggcgtggacccttgggctgcgcttcctttcccgcctcgggtctccgcgggttctgcaggaaccttgcttcctctgacttggtccctggtgtctctgtgtgtcggacagttccctctgttgtccctgcctgtaatcgctctcagggttttggtcagtagcctttcttctaccccgcttctccttctgcgtgttactcttt

SEQ ID NO: 86125 - DNA, 1019 bp, Homo sapiens
ggggtttcgccatgttggccaggctggtcttgaactcctgacctcaggtgatacacccgcctcgacttcccaaagtactgggattataggcgtgagccaccgctccaggccctaagctaaactttcatcacctcctgctcctgactcatctaaagccttggttctcacagtgtggttcatggagcatcagaatcagctgggagcttgctagaaacgcagcattgcatttggaaatgggactagaagatttagagatgctgaaataattagaagcagtttttaaaaagataaagggctctggaagattcccagttataacaaaataaataatccaaacctgcagctgatggggacatgcagccctctggtttacccagtagggttagggatggatcttgtcccagcctcagtctcattcccgctgtgaacttgtaggctttgctcctgctgttctcaggaacaaagctgtcatggccatcacacacaacgtacctgaggcagcgctcggatggacgtgacaccagcctggtcttgtgctgtctggacagtgtagctactggggctgcccctggggagctggaggcaagcccagaccactaatttcctctgaaagctgcctacacccatagccgtattggccaggaccagtcccaggggccagaggcggattattgcctccaggagcctggtctgcagcggcgaggtgctcagggaacagggagcttgagagaagtgtttttcttccacaccatccagctctttagcagcaaggcaggccattctgatcttaaaaagcaaatatccctttatagctttagatttatctagccctcttagcagaaaatggaaatcaaaactatctttaacaaatcatcttaacaaggtgaactgaaggcacctggttgcaaacagctggctgccctgaaccaaactggttccatatgccacaagtctatacaccccaggcaactgtgcttaggccttacatatgctacttgaaaacaagataagagtccatc

SEQ ID NO: 86126 - DNA, 1042 bp, Homo sapiens
agtaagacccaagaagtcggggtgggcagtggatcaattttggggaccagatggacccgagtgggaatgctggctctgccactgcaatgcaggtggccttgggcaggttgtttagcctctctgagcctcatattcctcatgtatgcagtgggcacagtaacacctaccctgcagggtggttatgtaggtgaagagtggtataagcaactctgggaatataccaaactctgggatgtacactttagaagactgggttttatggcatatcagttatatcttgatggactcttatcttgttttcaagtagcatatgtaaggcctaagcacagttgcctggggtgtatagacttgtggcatatggaaccagtttggttcagggcagccagctgtttgcaaccaggtgccttcagttcaccttgttaagatgatttgttaaagatagttttgatttccattttctgctaagagggctagataaatctaaagctataaagggatatttgctttttaagatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcaggtacgttgtgtgtgatggccatgacagctttgttcctgagaacagcaggagcaaagcctacaagttcacagcgggaatgagactgaggctgggacaagatccatccctaaccctactgggtaaaccagagggctgcatgtccccatcagctgcaggtttggattatttattttgttataactgggaatcttccagagccctttatctttttaaaaactgcttctaattatttcagc

SEQ ID NO: 86127 - DNA, 1057 bp, Homo sapiens
cattttttcttaaagtaattgctctgcaacttttttcccttcagtaaataaactggctctttttgcaacaggggctgtgcaaatgtcctgtggtcagaagctcactctatctgtgttcatcacactttatctgctcatcttggagtgacttgtaggcaaaggctttaaaagcctttgacctcaaattgtgacctgaaattagcttgaggcagtggtaactagtctcttgctgaaatggatttagtctggcctcagctgccctggaccattttcaactcggacgatctggttcccccagcagagcttctcaggctattggctctttgtggagtttatgaaagcaggggaccctctccccagaaaggtgcccaaggtctcatgtgcacatgcacacacatacactcattctggctcatctcagaggattctgggcccctgaagcccttacaaggcctgctgaagaatctcagaactcaaggtgagagatcatccttaaccacatggccagagggtggaggtacccacgtaatctaccagaaaaggccaggaccccaccttcaccactgtgctacatgctgtgggctgagcctctggctttaccacaatctatcaaactcctaggtgatgtacaaaggcacagggagacagagaggcccattcagccaaggatctgaagcaggaactgcgaaggctctagatcacctttggggcctgccttgccagcagacagctgagcaggttctcttcaccttgctgaggctaaagcagcctcctgaactttaataatgagctgaattctggccaggaatgtagcaactttcccactcagaaagaggccacagacgctgcttggtgaaacctgggagctgtgccctgatgtgtccaggggtttgaggagcagggagaggaaccagtctgtcttatctcccaccctgggcctgtgcctattgcctgatgttgtctggcccaaccccggacaggaagagcacttgtcggggtcctccccaacaaggggccagagtaactgctcaccgcgcatagatcagtttggccaggc

SEQ ID NO: 86128 - DNA, 3572 bp, Homo sapiens
ggaagtggagggatgatacatcaagaatgggcaaaggaagatagggtgactcatgcctctagtcccaattactcaggaagctgaggcagaaggatcacttgagctcaggagttggaggctgcagtgagatatgatcatgccactgcactgcagcctgggtagcagagcaagactccatctcttaaaaaagaaaggaaaaaaaaaagataggcaagggaggagaaaggacctgttcccttggtgcttattcttgacctcagacagccgtctgagccaggctttctctcaagcagactcgggccaagggaaccaattcattagccagcctaaatttaagccacaaaaggcaggtgatgaagacatggggctacctctctcagaaggtacagctgttttacatcaaaagctgaactgtctcttcccaaaaaggcctaacccatggttcttttcctttgcaacattcctatagccttatttctaataaggctagtagcctggaagtgctacttgcaagtggccggagctcttggcagaagagatagcatttgttgagtacatgctgtatgccgggcactgactaaatgctttgtatatctcttcttttcttcccaataaccttgtcagttgagtttattttcctttatttacgaataaacaaactgtgactcaaagagggtaacttacccaggctcacagggctactaagaggcagaactgaaatttgaacccaaccagactatgataccagagtctccttctactatacaggttcccacccttctgtagctgccagctgttttgagtaccagctgtcgcggccttcatgttttttggttttttttttttttgagacagagtcttgctctgtcgcccaggctggagtgcagtagcacaatgttggctcactgcaagctccgcctcccgggttcacgccattctcctgcctcagccttccgagtagctgggactacaggtgcccgccaccatgcctggctaattttttgaattttttttagtagagacggggtttcaccgtgttaaccaggatggtctcgatctcctcactttgtgtcctgcccgccttggcctcccagagtgctgggattataggcatgagccactgtgcctggcctcaccttcacgttatctcttccaggtcaatggccacaatccggggtctgatggccaagccagggagtacctcagagaagacctgcaggagttcctgggtggggaggtcctgctgtacaaactggatgacctcaccagggtgaatcctgtgacactagagacaggtatgggcctcccattcctcaggagtatcatctccaggaggttggaggtgtaatgagagtagtcagcacagcttctccaggtcagacggaggtcggcaggactcctgatctggagccaggtgggctgctccagacctccgcctgagggagcatgacagctgcacctgggctccccagggcatgctttgcttcagatttggagctcatcttaattagatcttgtatcttttcttcagggagctgctgggatttaatgattcttggctaattgcagaaagagggctgttacttaagtagatgtgtgtctgtgtgtgtggtttgactatatttgagcccgagtttgctaaaggcatctctgcctcagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccaggtaaggctctgccgctgcctgtggcctcagggctcctctacctcccgctaaacctctttgcagttacccctgtccttattcatctattcaccagcaatgtggtcattcagagtctgctagtgccacggcctgcccaataggagctggcagaattttgaaccatgaagaactgactacaggacagaaggtgcaaagtggggaataaataaatatttgtttaactgagtttggaacctaaaataagagacataagagaaaggatttttttttcttgtttgcggttttattaacaggaaaggatttataaaggtattatatatttgtttatttaacaaactacctttttattttttattattatttatttatttatttatttattttgagatggagtttcagtcttattgcccagactggagtgcaatggcatgatctgggctcagcgcaacctccacctcctgagttcaagcaattctcctgcttcagcctcctgagtagctgggattacaggcatatgccaccacacctggctaattttgtatttttagtaggcatattggtcaggctggtctcaaactcctgacatcaggtgatctacccaccttggcctcccaaagcgctggaattacaggtgtgagccactgtacccggccctatttattttgagactgagtctctccctgtcacccaggctggagcgcagtagtgcgatcttgactcaccgcaacctccgcctccagggttcaagtgattcttgtgcctcagcctcccgagtagctgggactacaggtgcccaccaccatgcccggctaatttttgtatttttagtagagatggggtttcaccatgttggccaggctggtctcgaactcctgacctcaagtgatccacctgccgtagcctcccaaagtgctgagattataggcatgagccactgagtccagcaaaactacctttttaggaaagaatgaaattatacacgataaggattgccctggaaaattcagcatatgtttatctctgctgaggaaagtaacttattcttttactgagaaaaggataagttatttggggtggggtggtggaggtacagacagataatgagcttgttggtgtaaaagtgcatgatgcattcagggagaggtgagagaaaacttgctggcaggagggaggtcttgggggcaagagggagtagatgagagcaggaagacgagaaagccagggttgtttgtgaagagtctgaagcaccatagcaggcagagagaatctgcagagcatcttcatccaggtagaggtgggactgggaacagaacccactagacgaataattactgtgggagttgggttcaagaaggtgaggcaggaggcagagacaacagttggaggctttgtatccctccaggtgataggtggctggggcaagggcaggtgtagagaggagtggctctgacgccatatggaacagttgccttctccctcagcaagctgtgggtaagtgatcactgctggctgggttagctaggcattgtggagatggcgtggccctccagaagttcatgcgtgatgaggtatccagttggaatccaggggcagtctgtcctgagagccctgtctgctgtctgccctgcctccggaaaagtaaaagccaagtcgtagtcccctatgtttcctcagcatccagcttgattgatgcctagtacattgaagacagttaatagttgttgaagaaaaggggaacagtggctttggaatttaaatcacatg

SEQ ID NO: 86129 - DNA, 1004 bp, Homo sapiens
gagagatgactccagcctctcctcaccaacgactgaaataggatatttctgtctaatgtagaggatagggcacaaggcttctctgtctccccagtgtcttactcctcctccatggcacactgacccagagggtttgcagccccaccccaacgcaaaccctaaccctgtaataaaactggcccagggagcctctgaggctctcataaaagtttccctgtctcctaattggcaagggaaaggacaggcccactctccgcccaggcctgccttgcatctcattttggttgcttctgctaggtgggaaggagtgagtgagtcactccagaaaagccctcacctgtgtgtggtccttgtcttctctctcatgccacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtaaaacctcaaccttagataacccaggccctcaagcacctgcagcatctgttgctagccctaacctggaaggaagggaaagcccccttaaaggtctcttttctctcctcaaattgtctctccagtgccttttactcatcatcaagaaactcttcctgatacctaatttgaatctgtcttgtggtttttagctcctttctttgggataggtaaggtgggatgggtaagggaatccttagggcactttggggattctgcagaggaagtcctgagagatgtccctgccacctgaattgttgaggcatagtagaagcctggggcttccaagaggatgtgttccttgaagctaagccttaaagaactagaaagaattagccacttggagaaggaaaataagcactccaggcaaagaggtcagcctgtgcagaaatgtaggagactatgaggaaatatagaaggattctaatgagtggatc

SEQ ID NO: 86130 - DNA, 1022 bp, Homo sapiens
tctgtcttgtacagggaatagctgaagctttgtaaccaataatttcatattattagtatgacatttctatctgaacacattagtgttaagcttcttcccacaatccttggaaggggaatcacaaatcctaggtgaactcattagggcccaaagttctgctctgaaatctagtaataagagtaaaattaagccaggtatgctaattacacaagaatgctgcttttcacaaatccattcctttgctcttgttttcacaggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgt

SEQ ID NO: 86131 - DNA, 1051 bp, Homo sapiens
cacgcccagctaatttttttgtatttttagaagagatgggggtttccctatgttggccaggctggtcttgaactcctgacctcaggtcatctgtccgcctcggcctcccaaagtgctgggattacaggtgtgagccaccacacccggccaaaatatatattccttctaaaatcttgaaaaataactacaaaacaaattacccttagtcatacttctcagggataagcacatttggtgtaatttcagtcctagacacacagatacagttaatatattctgtaactttttgtccttatttatttcactaaatgtaattttgaaaacattttttcttgtcattcttaaacatttttaatggctgtgtaatattccgttgtatgacattctgtaattatttttccactgttggacatggaggttgttctagtttttgctatgaataaactgtaagaacataaataatgcaaaaatctttgcattaaaatgttttctcaggcttttggaagtggaattactggttggatcaaaggataagaaccttttgtaaagttccaggtacatattgtcagattgctatgatatttctttttttttttttcgagatggagtctcactgtgtcacctaggctggagtgcagtggtgtgatcttggctcactgcaacctccgccttccaggttcaggtgattcttgggcctcaacctcctgagtagctgggattacaggcgcccgccaccatgcccggctagtttttgtatttttagtagagacgaggcgtcaccattttggccaggctggtctcgaactcctgacctcaagtgatctgcctgcctcggcctcccaaagtggtgggattacaggcgtgagccaatgcgcccggccagattgttacatttctgcattgcagtttactctcctaatttaaaccaatctaaatagactactctgataagagtttggggttttgttttttttttctttttgttcttgtttgcatgtacagcattaatctggtaagagttcttaatgtcttacactttaaaaaaatgata

SEQ ID NO: 86132 - DNA, 1049 bp, Homo sapiens
gtctcgaactcccaacctcaggtgatccgccgccccccaccccactggcctcccaaagtgctgggattataggtgtgagccaccgcaccaggccatgtacttggatttaacaaaattttttgaggggctagggatgggtgcaaatctggctttcacgggtctatttctggagtttgtaggctgtatcctgttctcagaggggtaaagtaattgatttccgttctgtttgcattttaagatggtgatggaatttcctgataatgtgttaaatctcgatggacatcagaataatggtgcacagctaaagcagttcattcaggtaatagttttttcaatcagtgtttttaatggtgtatgtgtattttaaagactcatttaaaatttagctgtattaattttatataggattctctaggtcttaatattgcactggaattgctctttcaccattgctatagtaagcatgcatagttatttacatgatttatgtaactgccatgtgaaaaagaattggtggtggtgtgttaatattttacatgtccataagactttaattttaaaaccaggccatctttcctagtttttaaaagataaggtatataatttttcattaaaaacttgttggttttctgctgtactaattgttttgttcagacaaagtaatcctatattatgaattttctgatgtttgtttaattcctgagaaatatagtgctttataaatacacttaaatgcaatgtatagtggtccctcagtatccgtgggggatagttcaaggatccctaggcaaaccaaaatccacaatgcttatacaaaatgatatagtaagggctaggcatggtggctcatgcctgtaatcccagcactttgggaggccagggcaggtggatcgcttgagttcagtagttggagaccagcctgggcaacatggcaaaaccctgtttctacagaaaatgcaaaaaagttgggcagacatggcagcatgtgcctggggtcccagctcctccgtaggttcaggtgacaggatctcttgagcccaggaggcaga

SEQ ID NO: 86133 - DNA, 1049 bp, Homo sapiens
acagctgtattgtgcttttttttttttttttttttttttttttgtgagaggactggcctaatactcactgaaccagccctacatttccagatgcagtactgctttttggcatcctaagcagagttgtttatataccctagattctagagcaagggggtttgtggaggaaattccgtacagcatggacaaagctgactactttgcctttctgactcagttgcaggtagagctggtaaaccctggccaggttgtactttactgcacaaggataggaaccagtagtagtgaaagtgtaattttacgtctttttaaaggacactctttcattttctttccctctttcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtaagtataatcaattaggagaaaatgggtttgttaaaatttaaaacagcttggtgacagtggcagcttattttcttgatggaaagattgagtctgatttaataattttattgagtaagttgtatgtaccagtggatgtaaagtttcaactctccacgtggggagaggcagacagaaagcaaatattcaatttgtcagggatgataagttagaaaaatcagtaagggaggtagagaatggagtgggggtagaattattgtggaggatggtcagggaaggcctccctgataaaatgacattgaatatagatttgaatgaagtgagcaagcaaatcttgtagaaaactggggggaaggcagagaagggacagctagtgtaaaggttctgaggttggggttttattggcatgtttgaggaatagtaaggaagcccttgtggctggagccagat

SEQ ID NO: 86134 - DNA, 1612 bp, Homo sapiens
tctgttgatgactcctcttcaaggatgtattgtgtttacataatgttttgtgaggtttttatatattttttaaagacatgggatctcactatgttgccctggctggtctcaaacccttgggcttaagtgatcctttcacctcggcctcccaaatagccgggactacaggtgtgtgcttctgcaactggtgtatttacataatggctgggcaagggaagatggctgagagtcaggtagcagtcagtgttgaaataacgtgagtgccaggcacactgctagatacagtggggatagagaaaagtggtttttttgtgttttgttttgagacttctctctaaaagacagtaaatagagattttaaaatttgaaagtaaaatgaattaaacccttaatatgttttatttttaattaggtccaaactaaatgacatgatagatgctattccaaaaagtaagaagaataagagatgtcagttgcactccttagatacgcacaagccaaaacctttggggtaagtagaattgaataccaagaggctttgtcattgttaagattatatatttgatcatatttagtaaaagaaataaacccactgtttgctttaattcattaattggttatactctatgacataggtcaaaataaatagatcctcttgttatgttggccattttgccttgatatatataaagtctcaatgtagatctgatttaaaaaaatttttttatgttaaatatgttttagaggagggaggttgaagtctttttttttttctttttttgagacggagtctccctttatttcccaggctggagtgcagtggcacaatctcagctcactgcaacctccacctccctggttcaaatgattctcctgcctcagcttcctgagtagctgggactacaggtgcgtgccaccacacctggctaatttttgtatttttagtagatatggggtttcaccctattggccaggctggtctcggactcctgacctcaggtgatcgcccacctcagcctccaaagtgctgggattacaggtgtgaggcaccacactcggccggttgaagtctttatggaaatgtatgcagctaatatgaacgttttcaaagtagtggtaatcattatttgatctacagaatagtcataatgtataaattatttatctttcttgtctctagctgtaatttaccaaggttttaaaaaaagtagttatgacgatattatgacaatatgtatttatgtaactaatttgtagttttctatatttattattattttttgagatggagtctcctctgtcgcccaggctggagtgcagtggcgtcatctcggctcactgcaacctctgcctcctgggttcaagctgttctcctgccccagcctcccgagtagttgggactacaggtgcgtgccaccaagcccggctaattttttgtatttttggtagagacagggtttcaccgtgttagccaggatggtctcgatctcctgacctcatgatccgcccacctcggcctcccaaagtgctgagattacaggcgtgagccaccgcgcccggcctattttattttttaagcaaatattgcctgataataatttgtagttttctt

SEQ ID NO: 86135 - DNA, 1057 bp, Homo sapiens
tgtctctactaaaaatacaaaaattagccaggcgtggtggcaggtgcttgtaatcttagctacttgggaggctgaggcaggagaatcgcttgaatccaggaggcagaggttgcattgagccaagatcgcaccattgcactccagcctgggcgacaagagtgagactttgtctcgaaataaataaataaataaataaaataaattttattagtaaaattgtcaaacatagaaaagtaaaaaatacaatgattgaacctcccatgcacttttaccaagatttagtagtaatcaagagttgccacacttgcttcatttatccacctttttctttgtattttaaagcaagtcccaggcttcgtgttactctattgcatccttccacatgcatctctaaatatatggacattttttttcacacattgccatcataacacctaacaaaattaagtgtaacaatcgaatacccagttcatacttagattttacctgtttctggttttttttttttttttgaatgttggtttgtatgaatcaggatccaaacaagaaccacacattatgttcttgtagcctgaagaaaagaagttttcttaaggatagttgttattttgctgcttgatttgtcagtatcttttttttttctttctttcaaattctttttttttttttgagatggaatttcccctgtcacccgggctagagtgcagtggcgcgatctcggctcactgcaacctctgccgcctgggttcaagtgattctcctgcctcagcctcccaagtagctgggattacaggcacctgctaccatgcccggctaatttttgtatttttagtagacacagggtttcaccaggttggccaggctggtctcgaactcctgacctcaggtgatcaacccgccttggcctcccaaagtgttgggattaacaggcgtgagccacggcgcctggcccaatttgtcagtatcttttaaaaattttttattttttattttttcatcagctcattcttccttctcagatttgtcagtagcttcagagaatttctgactctaaatg

SEQ ID NO: 86136 - DNA, 1372 bp, Homo sapiens
ctatctttcagcttaagaaacaaaacaaacctccacagattttacatccccttctagctacagttccactacatgggaagtcatatgttttagaaggctgtttgctgagtatggaatcagtgtgaatggacttaattgatcttaagtggtgtctgtctcttgattaaggtagcttcagttattcccacaggccacatagaatagcaggctaagcagtacagtatgcttagccaaggctccctctcccttggatggtcaccactattaaatgctactatgattctccattttatgtatttccactccccctcctgctgctacatccccaccccccatagcttttttaatttgtttagtctatttccagagaaagtataatacagttgattaggttttagcctaataaatagaaatctaggtcagcctttctgagagtattctctcatctatgcaagtaaacccaggttattgtctgtctgggagtaagtttgagatctggaagaaagatctaggctggagttgtaggcctgtagtttatcttagagaatgttatgtaagatcacctaaagggaaagagagtaaaagaattctgaggaatttaatggtagaaaagaaattagtaaagaaacctgagaaagagtagccagataggtagaaggaagccaaggtgtaaaagcgttccaaggaagtctgatcaactatattaaatgcggccaagttatcaaggacccaaaagtggacattggatttagtaacaatgagataattggtgatcttgaagagctgagctagtgattgagtggaagcagaatccaggttgcaatgattgaaaagtgaatgcaatgtaaggttgtcatggattaagctgtgaatggagagtatgggagcagaatcagaaagtggaaaggttatttttttggaaagtttgatcttaaaagaataatagaaggcataaggtctagaatgtttataaataaaatcctgatttgagatacagattttttttatagagcttttttttaaaaaaaaaatgccttcacattctaatgatataataatcattctttagctgatttctctttatgaacctttccctcaattatgagagcttgagtttgagagtttttcagttctgggaaattatgcattatactgatcaagtatagttaataaaaggggctgggcggggtggctcacactggtaatcccagcactttgggaggccgatgcaggcagatcacgaggtcaggagttcgcgaccagcctggccaatatggcgaaaccccgtctctactaaaaatacaaaaattagccaggtgtggtagcacacgcctgtagtcccagctacttgggaggctgaggcaggagaatc

SEQ ID NO: 86137 - DNA, 1190 bp, Homo sapiens
tctctacaaaataaaagtaaaaaaaaaattacttgatgatgatctcattaagtagatcaaaacttcttagaattttcaatttgtggaagattggtctgtgtttaaaagggaaaatacttgataattttttcggtcattttgactttagaacattccaactatatttgctcatagaatacttagtttattaaccagttgctctcttgataactacagatgttgttaaattgtatcagataaacttgatagtcaagcagaagtttttatataaagatatgagcacacatttaaatgaacgttatattaatataaagtgagtatgtaatcatataatttgtaaacatgttctaatatcttaatcattaaagtgttcatgattttaatttagactatagaaattatttcttcagattatctcagtgtcactaagctttgtactatactacggtgaagggagcagtagcagtgtcagttcagagaagttaagtacagatgagaaatagtgaaggccacaggaaggacggcaagtataggatcattttccattatggacgtttccagggaacagccaggtaaaaacaagcaatactttaatctgttttttgtttttttaaggttttacccttctgtattctcccttttcactaatatttgttctttctacagaggttgttggatggatgtatgggaactaatgtcgcaggaatgcagggatgaagtagttttaattgactcgagttgtcttttagaaacactagaaacatatctgcgaaaacacaggtaagtctgatggttgttccagtataatgtggaaggtgccttatgtgtcagtcacctagagtggcctgtcactgaactcctttgtataatagcattctagccttccctttaatacttggcactaggcggagcttaatattagagtaggcagttcctttttttttttttgagatggagtctagctctgtcgccaggctggagtacagtggcgcgatctcggctcactgcaacctctgcctcccaggttcaagagattctcctgcctcagcgtctcgagtagctgggattacaggcatacgccgccacacccagctaatttttgtatttctagtagagatggggtttcaccatgttggccaggatggtttagatctgctgaccttgtgatccaccaacctcggcctcccaaa

SEQ ID NO: 86138 - DNA, 1296 bp, Homo sapiens
ccccgtgtctactaaaaataaaaaaattagccaggcatggtggcacgcacgtgtagtcccagctacttgggagactgaggcaggtgaattgcttgaaaccaggaggtagaggttgcagtgagccaggatcgtgccactgcactccaacggagcaagactccgtctcaaaaaaagaaaaagcaactggtaaggtaacagcatctagagatggtgttcttggggcagttctactgtttaaatttgttacaagttgcgtttgtggttgtatgtcctttgactttgaggcagatatacacaattattttgggagtgcctctaaaaatcaagtgaatgataaaaactggtgtcattactttatgtggcagtaagctaatgacttcgcccgcataccaagtttattggtgtttttcttttttcaattaaaaactttctttctttgcctttttggtggattatgcccaagagagtagagaatgtgtcacttacttggagttttacagggactatacagacacaaaacatatatccttcctctttaaatatgaattgatcctcccaaaagatagtttttgcaggtgataaatgacaagttattagagcacatgttttggagtttcttataatggttttgtagattttcctatgtttagggttagtgttttaacatttttagatggattttagtccattttacagatatcttaacggttgtgagaaagtatggttgagagtaataataattaaggcagtgagtgatgaatttagggagattgtattgcatctggattctactaattgtaactgtacaagttagttgactttctgtgcctcaatttttgtcttctttaaaacaaacataggctgggcatggtggctcacaactgtagttccagcactttgggaggccaagtcaggtagatggtttgagctcaggagttttagaccagcctagacaacatggtaaaaccccgtctctacaaaaaagcagaaaaattagctgccatggtggcacaaacctgtagtcctagctactggggagggtgaggtgagagtatcacttgagcccaggaggttgaaggtgcaccatgatcacagtggccgtgattgtaccactgcactccagcttgagcaacagagtgaaacgccatctcaaaaataataaaaattaaaataaaattagcagctgggtgcagtggctcatgcctgtaatcccagcactttgggaggccaaggcgggtggatcacctgaggtcagaagttcaagaccagcctggtcaacatggggaaaccccatct

SEQ ID NO: 86139 - DNA, 1323 bp, Homo sapiens
tgctaggaagagtggaaacaggaaagtcagttaagaagctttaaaaaaaaaaaaaagtgggctgggtgcggtagctcaagcctgtaatctcatcactttgggaggccgaggcgggcagatcacctgaggtcaagagttcaagaccagcctggccaacttggcgaaaccctgtctctactaaaaaatacaaaaaatttgctgggtgtagtggtgggcgcctgtaatcccagcgactcgggagactgaggcaggagaatcgcttgaacccaggaggcagaggttacagtgagcctcgatggcgccactgcactccagcctgggcaacagagagagactctgtctcaaaaaaaaaaaaaaaaaaaaaaaaaaaaaatatatatatatatatgtgtgtgtgtgtgtgtgtgtgtgtgtgtgtgtgtgtatatgtatatatgtatatgtatatatatgtatatatatgtgtatatatatatatatagcataggcaacttaaaccatgccagagggaattgaaaatagggacctacaggagaaacaagaaagaatgaatactagttggctctactcaataggaagacccagggagaagttggaattaactcagatttccagcctgggtgactctgaatggctgtgaatggcagtgttcttattaacagggattgagaaggcacataggaatagaacagcattacccttggacagtgaatttaaggtgttgcctattggacatctgccatgtcttgtcacttttcgatatgggtctggccctcaggcaatagcagagatttgaatggagctgtagagtcacaagtcatctttatagacatgttagttgaagccatacgcatagatgagctcatctgggagatgaatttaaatcaaagagatcaaaatttccttgtttcacttaactaatcttcttagccatttactcttattgtgagcctggcttttccacctgaccaagttcttcttgttccaggaattcaaagataaagaaaccaggctctattatttctttctgattgattgatatttggtttctaaaagaaattttcttccttctctacattcacaaactcttctattcttttgccacattttatacacttaagtttaaaccagtttccatgtatattttgtctatattatgtttgttattgagaaataggcatttttgggaagaaagaatttggcattttggaaataatcagaaaattaaaaaatgcacacaccactttcccattcttctccccaccccaacccctacccctatcctcaaatgcttagctagtgaaatattaaaatgttgtaata

SEQ ID NO: 86140 - DNA, 1030 bp, Homo sapiens
gtctggctacttaaaatatggtaactagttgtaacatctttaattagttattttttcaaggccaaggtatggtggtagtttgctaggctcataggcttctaggagaaattatagattcaaggtttcaactcaaggagttggattttattctcactactttcttaggcagaatgacatgatgcttattctgcaaacactccaattaaaggctttatgtgactgatgtgaaactaaaaagttagactggtttaatttttagctgtcctcctccattacataacattttgcattcttaagtcatagtcttaactactgctttaatttgcaggatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaatttgctgtacatgtttctacttaatatgtggcagtactttagtatttgccacttgtggact

SEQ ID NO: 86141 - DNA, 1086 bp, Homo sapiens
tcttttttaatgatcaccatgaaatccactgggccaggccctggtgttctgctgccatagtcagagtcagagtggagggatgaccccaggaggggacaagaagccaagactgggctggggagccgagaaggagatagataagggggagagggtgcagtggggcaggcagaggaggaagtctggagccctggataacaacacagatataaggtgaaggcctccctctgccaccccagccctgagccacagacgttgaggtgcaagaagatggggattttggccacaactcctttcccatgtcaaagggaagacactgagagcagacaaaggccaagtgcccaggggcacaagaacaagttaacaagtaaaacaattagggacaccacctcctttccccagcccatttttcacatttacaactgaagcaatttgacaagatgatataaaaatctcaaacaaattttctagcccctggtcggggtgtggacaggaagtggtatcccgtgatccagaaatcaacacctaaaatccagaggcaggaggcaagccatgaagggtggggagggaaggaggagctcccacagtcactaggtcacctgctccgtgggcctcatctggatgtctccaatctgtggaaggtacaaggcatgaggcagctgtgacactctcccctggccctgcagggctccctgctcccctcctctggggctggttgggttcctccagtgagtagacagtcagggccagactcacctggatgtgtgcgggggtgctgaggacgtagataacagcctcggccacatcctcgggtttgagacactgagagcaccaggggaatgggttgagacaaggacagaatggactcaaattccctcccaccactgagcttctctgtggcatccacacatccaccccaaccctccaggaggagccacaaaggctggaagagtggagtctgaaggccgagcttccctctgccttcatttagggagtcagtggcttcaccaggctcagagggaggccccaccttcatttgctcataggtggcagctgccttctcagggtccttgtcgtggagtttgaagg

SEQ ID NO: 86142 - DNA, 1169 bp, Homo sapiens
gccattacctgtgggacgggggcgttagtgagcttgtcagcaggaacacgacaggctcagagtcacttaggaagagaatcagcggcccgggataggaagtgactgttggggtcctgctggctggtgatgggctagtgagaagttctgggaaaaatcaccagcgccgggatgtggggagggaggcaacaagactgaattggttgaccaggaaggccaacccatctccttaaagggcccttcactggtgcgtgggtgaatgcggtccccggcctcctgggacctcgaggaacacaggacgcagccggtagtacggccagctcagctcgccgctcctctagccttgagggaggcgctgtgggggacagcctggcagccacgcatgcgcaaaacaccgtcaggaaggggccggggaggggcgggctcccgaacccggaagcgagggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggat

SEQ ID NO: 86143 - DNA, 1010 bp, Homo sapiens
atccaaaataatatcaatttaacatgtaatcattttaattattattaatattattaattttttgagagagtttcattcttattgcccaagctggagtgcagtggtgcaatattggctcactgcaacctctgcctcctgggttcaagtgattctcctgcttcagccttccaagtaactgggattataggcacacaccatgcccagctaattttttttttttgtatttagatggggtttcactatgttggtccggctgttcttgaactcgtgaccttaagcgatccactcgcctcggcctcccaaagtgctgggattataggcatgagccaccgcacctggcctttaaaaaatattattaatgaaatattttacattcctttaaaaaatgttttacatacaacacacctcgatttgaattagccacctttcaattgcttaatagccacatgtagctagtggctactatattgaacagcacatatctagaagcattttttggcttcacttttttgtagagagcccctttctccaagcctgataggagatgaggttcccactcatcacttccagcccctgaacaggtagcttctgaaaacacagaaacactgcagaacatccacttaagctccaggcatcacatctccctactgtcatcagcatctgacctggagagtgtcatccgcctgttgctgtggaagagctggaggtgccccaagcaggggcctgtgctggggccccatcccttcctgcgtactcagagacactgctgtagcaattttcctcctcttcctgcagcatccacttttctcttacactctcttcagcatgcaagcaaacattcccctctcacgctcttgatctcacaccagtcagctcttcctctcacactgaatcaaaggcttcatcaaggtcaccagtggcctccatgttgctgcattccagggtctgttctcaattcttttctgacttgacccatctgcagcagctggcacagttgaccactccttcct

SEQ ID NO: 86144 - DNA, 1020 bp, Homo sapiens
gagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagggtccctctggggctgatcgtcaaggagcttctcaagaaaagaaacctggactgtgaaagtcacctcctaggccctctggggccgtatccgggggtgcctgggaggagggtggaaaggattctgcagtcaccgagctatgggcgaaaatgatccccgcggaccctggtccagaatgtacaggtcctgggcggtgtaagtggctgtgggtctgtggaggacattgggtaggaaaacgcttgcgtagttgaggatgcagacaataaatgtggccgggaaggtgaggagggaaggttggtgctcttcgctgaacggaactggcttaaatgcagagctgagctgagcggcttcggagaaggcgaatttagaaagcctggtcaattttctctccatgtccctgcgaccgattatgttttaaaacaaaagctcaatggaaacgaaaacaaaacaaaacccaccatttgtctaatgtgctgtccccgtggaggagttaaatctggactccaaacctagaatctggagccaagaggcgcactttgagttgcgctcctggccccccttgcagagacgccagggttggctcctgcgg

SEQ ID NO: 86145 - DNA, 1345 bp, Homo sapiens
agattgtacattttttcagatcaggtttgggaaaactggtaattctctaacaccagttgaaatcttactgttcttcaagggccagagcaaatgctagctcttccttagagattagcttaaattcacttgccccacagttaaaatttctcactcttctgggttattgaaattttgtcaaagcacttctgatgcttccttgagttgtaatgttgtgagtctgtctttcccactagctccttttgttagggtaggacccgtgttctattcatctttgcttctcccttagcattttggagattgtagatgtgtaataaatatattgttgaattgagtgcagtaagagattttccccctgatgccacagtgcttaagttgaaatgaagtctatggcttggtattttctccaggtaatacccatttttctctttcttccctctcttctttgtagatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagataggtttgtacatggttttgctgattgcctgtttttcaaagtatctgcatttggtctacttttcatttgtttgtttttggctattctctatctcctgtgtcctttcaattagtttgtgacatgccccacttacccagaagcctaaagccctattcctgtatgcttagccagccatttctgcactgatctgcttagctggttctgctctagtacttcctgcaactggggaagattgaagagaagagtgttttctcctctccttgggttttagcattcccactctgctgtagcaaatacttgcttcatggatactgaatttattttctctaatagagaatatttgtttccatggcattaaactgctaaagctgtggtgcttagagactggtgtggtttcctgttcttccccacccctgccacctcacccccagaatattttattattgaggaatgggattctcttttcttcttttcagcactgtgggacca

SEQ ID NO: 86146 - DNA, 1032 bp, Homo sapiens
aggaaaaggaattgagagactatttggttcccaatgtcttcattttacacatgagagaattaagacccagaatgacttgcccaaagttgcagagcttatttgtgtatggcggagatgaggctccaacttttctaccttatgatgtaggaatcttccctctgcaccacactgcctcctgtgtgctgcttgcctgtgtgcccagtggcactgaaggactggggcagagggagatttagggtgagtgtgctgtgtttgggatctgtatatatctatatctagatattcagagtcctcatgaaagagatatctatatccatagatatagatatatatgtatagattatgtatctatctctctatatatatatttgggaggccttggcctcccaaagtgttgggattacaggcatgagcctctgcgctcagctgagatcaatatgtcttacttgcatgctgagacttcatgttttcatttgctctttaaaacttatttttttagtatcatggagttagagttggaagggacctgaggaggatatctaatttggcatctgcctgtaggtagaaccgccttaagacattcaagatcaatgtgtaggatttcccaggtagggagttcagtgaacgtttcttgtaggtgaatacctgatgtaattaggaatggcttcctagagtccagtttttgggttttgtgtcccgccacacttaaagtctgcttcttcccctgtgggaagtctgggcagtccttcccaggagccttacgtggcctgtgtgggtgaggtgggccatttatatccccgcccctgtctttgcctcctttctctctcaaatagatgacagattgatggttttcaagttttttgagatttttggagcacttctctgctatttttagtgtcctagtaccctaattcctggtatgcctttggaatgagacctagactgctctagattaaatgttttaaatgtttcacgataaggcctgttttcattttgttactcattattctttttgcttgagcctttttcatt

SEQ ID NO: 86147 - DNA, 1070 bp, Homo sapiens
tgctcaaagaggcatttggcagtgttcgaccatgtgagcaatcactcaatagttatcagtgtaactgagcctcactagtcttcagtgttttttacttttttattagtatttggattctttatataatttaaattaactaattgttctggaaagtgttatagtttactaatacttacaatgcagtgttggcctcttacgacgctatggaaagatggctacagatttccttattgctatacccagctactacctccttgaagcgtttaacttttccttgaaatacttttctttggcttggtgacactacctgtgctgtttgggttctcctacctttctgatctcttctctggttccttttgtatcctctcaatgtaaatttcattccgtttagaatcctgtcctcaggttgcgttttctcaatatagtctctccttggcactgtcacttactctgataaccctaactattgcctctaaaataacagacttccagctgtattctagctccagtaaactcctgagtaccatgcctttgtagcttcagcaccctaaactctacttttcagaaactaaatgaatatctccttcctctccacacaccaccccaaacacgtaaacttagtccccagtcaccttggtgttacatgttggtaatttaaacttgaactgtggaagtgatttcaaagacatcgtctgatattttagtggctgcataagtggtaagtcatggagtaatcttaacaaaattaagggattttctgtgcacaaaaccatttctctaaaagggtttgctttttctctctttcttttttttcttttttttttgagatggagtctctctctgtcacccaggctggagtgcagtggtgcgatctcaactcactgcaacttctgcctcccaggttcaagcgattctcctgtctctgcctcctgggtagctgggactacaggcgcatgccaccacacccggctaatttttgtaattttttttagtagagatggggtttcaccatgttggccaggctggtcctaaactcctgatcttgtgatccacccaccttggcctctcaa

SEQ ID NO: 86148 - DNA, 1169 bp, Homo sapiens
ggccttccctatttgtccctaggcaaccactaaatctgctgtcactatgggttagtttgcattttctagaaatctatataagtggaattatacagtttgtatcctttttagtctggcttttgctcagcataattattttgagcatcctccatattttttcttgtgtcagtagttcattgccttttgttgctgagtagtatcccattgtatggatataccacaatttgttttgtttccagtttttggctattacaaataaatctgctacaaacatttgtatagatgtttttatatggacatagactttcatttctcttgggtagctaagaatagaatggctgagtcgcatggtaaatgcatgtttaacttcggaaactgccaagctattttccaaagtggttataccattttgcagtcccaccagcagtgtatgagatttctagttgctccacttcctcagaacatttggtatgttcttaattttaaacattctaataattgtataggtaggttacagaactgagttgctatcctgtctctcattctttgcctttcttttgtgggtttactccttttaaaagttactttttaaaaaagttaccttaatcagtggaatagaatagagagttctgaaacaaattcatacaaataatgggcagttgacttttaaaggtgcaaagtcaagtcagtcaagtcagtggagaatggatagtttctttctttcttttttctttttttttttttttttaagagacagtgtcttcctcttttgtggaggctgaaatgcagtgacgatcatggctcactgcagcactgagctcctggctcatgcagtcttcccaccctaacctcctgagtagctgggactgcaggtgtatgccatcatggcctgctaaattttctttatttttcttagagatgaggtcttgttacgtttcccaggctggtctcgaactcctgccctcctgcctcggcctcccaaagtgctgagattacaggcatgagccaccattcccggcctggatagtcttttcaacaaatggtgctgggacaattgtgcactcatttgcaaaaaaaaaacttcaacctgtacctcatacttgatataaaaattaacacaagacagtcaatttatattaacttaaatataaatcataaagtgttttgaa

SEQ ID NO: 86149 - DNA, 1032 bp, Homo sapiens
ctggagctttcatacattgctgatgggaatgcaaaatagtacagccactttggaaaaacagtctggcagtttttaaataaagctaaacatatattcatcatacgagcctgatccagtagtctctgtcttagatatctgccctagaaaaatgaagacatacattcacacaaagtcttgtacatgcacgttcatagcagcattatttataatcaccaaaaactggaaacagcccaaatgtccaaatgtgcaacaaattgtacattagtcagcaataaaaaggaataaactattgatacatgcaaaaacgtggatgaacctcaagggtattatactaagtgaaatatgccagcctcaaaagattttatacttggaaattccatttatatgacattctggaaaaggtaaaattattgggacagatcagtggctaccatggattaggaatgggagaaaggtccgagtgcaaagaggcagcccagctttcttctttgttttctatgagtttctattttcctctccactaatcttgtttccttggagtattttccacctgttttccacagtggctctctgttgaacccttcagcctggcttgattgttgtgtacgttttgcttggattgagggagggggtatatgtgtgcttattcccagataactctgggaatatttcttatggtaatggatacatgatacagtacttctagggatagaggaatgggccacatcaacctatagtgtcatttttgcttgaaatatatatccttggtactgaaaccttacccagaagagaataatagattacacagagcttctagattttgatgtgggttagaactgaaaaatgagatgtctttaaactctttttccttctctctttgataagtgatataatgtggtttggacactcagagattcctgagattccaggttctggttgatgatttactgcaaaattgcttataaattgaagtagaaaatgttttgcagacctggcagctttctggcttcacacccatttgtcacccagcat

SEQ ID NO: 86150 - DNA, 1044 bp, Homo sapiens
ttcccttatttcaacttgtacttactcccccaattccccacatcattctcttaaaagaaaaaaataagttttgtccactgaatcctctttcttatttgatttaatatatcttgagttgaacgtttctcacaaaaacactttgcattcagaattagcctatcaagttgtttcctccatacactcctgcatagatcgcacgccttctactgtggtgccctctgagatatgaaaacccacgtctgcttttggcttagccttcatgattttagaatataagtctctacattctgctttgaaaagttctccttgtggttattttgtaccataaaaaaaaaattctacttttagtccgcagagctcaccaacaaactgggacagaagtcctcacactattccagttaaaaccatggtcctcataatagcacacacatttatctaaatctgaatatatatacacatatacctgtatatgtgtatatacacttggatatctagaaattctagttggccatatgttggaaatgatagcaacttatccaaatggttgatgttgaggaatttgtaacctgcagtcctctgtcttactggtaacgccattctgcttggggaatatagaacaagcccaaacagtaatactgacagaattcggaattatgatacagtggagccttcacgcaattctttgttgaagaagttagggcctaaatgttaaggcttattgttattctgagttgataatctctgccttgctttaataatttttcctcatgcctgggtagcccgcgagttgcacaataatcactcacacagctttgtaatcaatgcccaaagtaataggattcctctggccaccggcaattaataaatttgtgtcttttttaaaacactagcaagtcgggcctgaaatacgactgactggctctcctcatttgcatatttattgcagtggaaaaattcttaccagatgattgatgctgagcctgcctcttgaattccaagcagcacattattatgaaatgaaaaatgccggccatacagttgatt

SEQ ID NO: 86151 - DNA, 1033 bp, Homo sapiens
gttctagagttacttttgaaggagaaaaaaatgctcttgtaatctgtaaattccaattcaatgtatttatctggggtaatatgaatgggggagtttatgtgtacttgtacataaataattgtaatgtttgcgtatttatttaaaaacaactgtatagatatttaaaaactgataagctttatttactttatacactcactcttcctgttctcgcttcacgccattgccagaaattgtacttactggtttataatctaattaatgaactgtgtgtccatgcccaaacttattcctcgcttacagttttgtttatgttggacagcctagatgaatcagggaaaaaaataaagctgttaggtgaaaatggtttttagattggtgacattttatatatagaatgcttgcatatgggtagcatataaatgaatacctaatataggagtctgtgaatactgtccaatcctagtacaagcagagcttaagatttttaccatgtgaaatatgatttttgatagtaatatgccttctatttttacagcattaaaaaaattctaaaatgccttaatatataataacacagttactatttttaccttattttgtaaggacaagcaaaggcttgtccacattttataaacgagaaaattgagactcaaagagattaaattggtccattcagcataacatgactagttagtgacagtgtcagttgaaatacagggcccctaacccccagtaaagtactgtttacatttatcctctactgaaaattattcctaaagctggtggccagatgctaaggttgaatcttggtaatatgatgaggcatatgtccttcttaatctcctcttaagggaaagacctttggaaatggaccatgtagggtaaaataaacatatatattcttgacagtatccgtttgttttgtggccatgtgccaagagggagagggaagaaagtatatgaatctttgctgcttttcttaacttttaactcttgtaataattgggagaaaaattagaggtgaattaga

SEQ ID NO: 86152 - DNA, 1028 bp, Homo sapiens
ttttttccagacagaatcttgctctgtcgtccaggccagagtgcagtggcatgatcttgactcactgcaacctccgcctcctgggtttaagcaattctccagcctcagcctcccaagtagctgggattacagccacccaccaccaccctcagctaatttttttgtattttttttttagtagagatggggtttcaccatgttggctaggctggtctcaaactcctgaccttgtgatccacccgtctcggcctcccaaagtgttgggattacaggcgtgagccacagcgcccggccgaccagtttttattctgaaagtttttatccgtagactatatacatcatcttgaccagctctattacatatgcatcttattggctccaaggagaaccaggtgagaatatattctcaatgcccaaatttttaatatacaattcaatactgcaaatagaaagtgattcattagcttgggttttcgtatgtgaacaggaacttttccataaggatatgtgttgagagatggagtgaaggatgtggcagctcaaaccagaggcacatgagatctcctgggggcaaggtggaaggtgttggtggtggggatgcctagacaaagtcctactctttaggagaagagaaggaagtgctcaaggagctgactgataaggaatagtccaggaggtcagcaggtaacctgtaggaagatacctaagaaacttaacaccaacggaacaaattaatggttataatgagaggccggggaggagtttgtcaagcttaatacatttaagagctgacaatgtattggactcttactctttgcagacacttttctaagcaccttacatgcatgatcttgcttgttcctcacaacaatcctgtgaggtaggcaacgttgttatttccatttgggaatatttcagagagtatttagttcctgtgtgtatcctgtgcctccccttcactccccacagccagaactgctcaggagtcatgagttataggcatcacctactttggagaattgtagata

SEQ ID NO: 86153 - DNA, 1050 bp, Homo sapiens
tcaagataatttttttctctgtcaaatttttaatgtgctagctttagccaagtaatttgcgactgcttgttgagggtttagccatgactgctgtactgtgtatatggatatgaagaagaacttcttaggaaaattacatgtaaagtcaatatagaacaagtgattttatattggggatacctctggtcttgccctaaaaagagaaagagactttctattaattttttttattcattctataatgtttgataaaattattgccataagtaagtcttaaaagtaatgactagagggtataggaaaaaaagattggtgtggctgcagctgttccctgtcagaggtcctgattcttttttcctcttctcttattatattcatttgtcagaagagtaaggaactctattttgttctagagtgtctaaggaagtacctgatatgggatattaatgctgtataattgtgtgagatcacgggagacaatcaaaaatgttccagtcctcattaattgaagtgtacattgttcgatgaaaagtgcatcataaattaaataggcttaataaaataaagtgaaattactggggagaagttgcctctgttggcaatccttagtctgaattttttttttttttttttgcctggaggtctgtttaaaaagaaatagcattacttgattggcccttcatcccaattaataattttaacttcgataaattctgatttcagagttatgactagtcacatcttagcttttccccttgctggttaattggggtgctggggttaatctaaattaaaacttaaactaatagaggtcagcaaggcagctaaaacacctgagtgaaacaaatggggctgccaggcacaactttatcttggctgtttcccaagagggaagtggcagcaaattggagttgtttcagccttctgtaaaggtgaatgatgggtgacacttgttaatgtacagcatctccggaagcattccagattgctttgctgctacaccaactgctgccatccatgcacagtcagtaggaactggaccagttgcca

SEQ ID NO: 86154 - DNA, 2948 bp, Homo sapiens
tggagactattactctaagtgaagtaactcaggaatggaaaacaaacatcatatgttcccatgggtatgtgggagctaagctatgaggacacaaaggcataagaatgatacaatggactttggggactcgtgggggaagagtggaagaggggcaagggatacaagactacaaatatggtgcagtatctactgcttgggtggtgggtgcaccaaaatctcacaaatcaccactaaagaacttagccatgtaaccaaataccacctgtaacccagtaacttatggaaaaaaaaaatgtatatgtattgttgatctagataaaaacataatcattttaaagttggatagcgtctttggagaccatcaagtccaaactctcttttcacaagtgcagaaaatggagcctgaaggaagtacatgactgttgtaagatttacccacttagtgaaataggacattgaaacctgtgttcttgctcccagtttgattttctttctgacacattatactcccttctgattggacaagtttgaaaatcctttgagaattttattttcaaatctatatctgtttaggacattggagatctactgtatcttttagcactctgatgattcacaagtatcatttttatacagttataaactttattcagttaacatttattagtctgggcacagtggctcacatctatggtcccagctctttgggaggccaaggcaggaggattgcctgagtccaggagttcaaggccagcctggacaatatagtgagaccctgtctctaagaacaacaacaaaaacatttattatgccagatgctagttttataaaggctagtaagaccaaaatccctgcccaaagaatttgtgttacctaagaagagtgaatatctatgcagtcacaaaattaagagtgtgactttaataaaattaaggtggagaaaataaatgttgaaaagagcaatcaggtatttgatacaaaaatgtacatgtggttctctagggttctcacaaacatgcctcaagcattcattagcctactggtttacccctcaacatacacctgatctaattctacagtaatttctctataacttgtaaaaggccttacgaggcactatttgacataaacattggataatacaaattccatattttccaagaatgtaatcattgttggaagccgtatggagttgctggtatccactgttacttatttcagggtagaagaatcttcagattggtgataggtagaagagggttcattttgctattgtctacttttgtggatgtttgaaaatttctgtaataaaaagttaaagaggaaaaaagtcatatttcttttttccttcattcattcaacaaatatttgagtatctactgtgtatttattgagtaactactgtcctaggctgtgctgtctaatgtagtaactgcatgtggctgtttagatttaaattttgattaatttaaatagtataaaataaatggttcagctcctcagtcacactagttatatttcaagtgctaagtaaccacatgtgctagttgctattgtattggatagtgcaaatgtagaacatttccattaccacagaaagttctcttggagctctgttagaggctggaagaaaacaaagttcctgccctcatgagcgttcattctagcttagaggtaggatgaaacagggaactacattgtgacaaatgcagtagagaatgatgaaactggttatggtgaaagcaagccctaggatagggaagtgatggttactgttttaatttaggatgtttaggagataaagatatttgagaagagacctgaggaaatgacaaacagagccatgcagttgtctgggggaagagcattagggacaaaggggatggcaagtgcacagactctgaggcaaaagggaggctagcgtgttccaggaaaatcagggaggccagagtcatgggggtcggtgggggagtaggcaagaaagaggatggtaggagaggaagtcaagaggtaatgggaggccaggtcctgtgggaccttgtaggccactgtagcactttgatgtggctgagatgggaaactaccagaggattttgaatatagaggagtaatatgattggactcatattttaaaaggatcactgatggctgtgttaagagtagacatgagagaatggggggcaaggtggcagacaggggaccagttaaaagactctagtgataatccaggcaagcgatggcagtggcttaaactagggtggttttggaagagagaactggttggattctggatttatgttgaaggttgagctgacacaggatttgctgatgggttgtatgtggtatatcaaaagagagtagtcaagaatgaccattaagattttggcctgagcagttggagggattaagttgctatttacggagttgggaaaaaacagtgagagaagctagtttggaagataaatcaggagctcggttttggttatattgccccctcctcccaacccctgtggacctatgttggctttatttttgttactaggacctatgttggctttattttggttacagattagttatattgtttatgatacttctgccacattcatgtggagttgttgaagagttatatatatatttttggagttcatgggaaggtccaggctgaaggtataaatttgtgagccttcagcatataggttgtatttaataccatgagattgaatgagattacctagaaaatgaaggcagagagaaaaagagattcgaagcccacgtcctggaacattcaaatatttatagattggggagatgggaaggaccaacaaaagtgatgaagaaggagcaaccagtgatgtaagagagaataaaggaagagtgattttccaggttgcatgtaaagaaagtgtttcaagaaggaggagatcacttgagcccaggagtttgaa

SEQ ID NO: 86155 - DNA, 1519 bp, Homo sapiens
gtgactaattgtttaccctacattgcctaaagtgcaatttgtaaagaaattataaaacacctatgtgtttgtttttagagtttgttttccaaagtctttcttatgctctttgctccctggttttgcattgtgattgtatccatatcaatctgttgaccagtggatacaaagcagccatccaaatgtgagctctcagctgtcagaacatggcactgcgcacaacaggttctttgctctcagtcgaatctgctttgttagagtctgccctaatttagacctccacctcttcagtaaaagcttcagcacaattagaagtggaacgtggcagcattacccagatgtcagggcagaatgtaaagtagtgaaggaaggcccttgtgtgtatgcttcatcctgtggttggaaaataaaaagggcatttagaatgctacctaatgaatagtgtacatttaaatagccatgagccataatttgcaaaagcatgaaaggaaacaaaagctgcaagtgccagaatgggattctaggcagagcagccattcgagaaagcagtgaaaaatttgtgttgatgaaataattttatttaagtaaaatattatgtgaattttagggtaggatgttgatatttcgtttatctctggaatgttatagagagctgttcgctataaatttaatgtgatagagcaaattgcatttaagtggtgattatattgtacatttatctgactttacaataaaatagattatggtaattaagattatattaagattacagtaattggatttccctagattttttttttctggtgttgaattttcgttgtataaatcaggtaggatgactagctgctgctgctgtttctccttctttttctttttttcactttagttcatatgagcaatttatgaagattttcttagcctaatatcccttattgaaaaattaattccttcttatctaaaatgactgcagaatatgtgaatcttgtttggattctgatccaaacaagccaactgtaaaattgagacattccaggaaatgtgaagactgactgaatatttgataataaagaattattgttgacttttttttttagatgtggtaatggtattgagattatattgaggggagaagagtccttatcgcttctcttgtatagcaacacgtactgaaatatttatagatgaaatgaaaattaacaatttaaacaatttaaacaatttaaaacaattaaaaactagtatcagtagtggataattatttaaaaattagcaaaaattggaaagcacaagaaaaagcactggaggattaccaaagggaaagttagattttaaaaattcatgcattcaaaccaaccagcagttgcaacattagtaacagaacatgctgcatagctaaaacattaaaagaaaacccaagtagctctactaaatctgatgggtttgcctgcagactggtagatttagtgcttgtcacagcaactccaaatactaaggagcattgtgaaccaaatttgctgta

SEQ ID NO: 86156 - DNA, 1150 bp, Homo sapiens
ttttaggcaggtagttaaacccacatccttattagaacctgcctatcattaaattccctttagacaaatgtgggtctatctgatttttaaagatcttcagagaagtagatttctcaattactttaatgaacttgttttagtatttaacacaactcatcaggaaatgctgatttttctttaactttgcagaagtacacagtatcaacagctttgcaaagtatcgtcctttgatttagggtcgcttttttaaaatctcaggttaaattgttataatttctttacctctttttatgtcttgaaatttccgaatcttcataattctctaggttcatttttagaggtgaagagcatggacttaagacccagactgcctgagtttgaatcccagctttgacattgattagtagttactttgggcaagacccttaaactctgtgctagtttcttcatctgtaaaatggatatgataatatatcagccttgaatggttgctgtgacgattaaatgaatagggtgtgtatggctcttagaatagtgccaggtacatagttaagcactgtacaagtgtttgttgccattattactgtcattattattgctatcagtattccaaggttgggtcagtctcttttcctagtgttcatttatttgtttactgacacgtctcttccgtacctgtctccccccagcccccttcaaggatttaaagaaaaatgttactaatagtacttcataggtgactaggctgaatgattatcttattttttatttttgggatcaaatttttctccaatactgtacttttaaaattgtaattttatgaggacataaatgttctctagaaggaagagcttaggatttcaaatcacaagacttgcgttcaaaccctgactctgtctggtgatatgattttggttgttctttattctctgggcctcacttttctcatttactaagtggaggtaataatccctgctttggggatttggtatgggaattaaatgaaatcatgtgtaaatatctggtacatagtaggcattcaaaaatgttcaatatatcagtttgaaaagaaaaaaccaggattttgttttaatagcaactgctttttatattaatgaattcaactagcttcattaaactgttcattaca

SEQ ID NO: 86157 - DNA, 1875 bp, Homo sapiens
gtccttagcaagctactgagtttcatggcacctattgaccatactacaatgaatgatgatgccaggtgagtaatagattaattatgtgtctcaaatggcttcatgacagcctgatattgacctgctctacagccttcgccctctccatttcttcttatcagttaaccatttgtcattggcatcgcagtaagggtcacatctcttcaccctcataattactataaaaccaaaccaaaaacttgcataaatttcagtgctgcctttggtggtttgtttgtttttcctgttttgttttgaactttagcccagcgccctgggacatgtgagctctctaggacagggcaggtggcccatgttcttgccgtttgtacttggggctgttgtgcatatgctttccttttgaaagtggctctagtgagtgctctggagatgtgcatatgttgtatttgttggggattgtgagtgtttttacaaaagatgtatatgcttattttataaagctgaaacgagagaaatacagaaaaaaagtgtatgctcataatattaccgttcagggataacctttttaaaataatagtttcttctgtatctattaattggcattctataatgaagagcttcctcttctccctcatttatttaccatttatttattcatttatatcaatatggactcatgttttcctattttattcaatgagttatgtttattttgatattaaaattgtcccagatagtggaagtgccgtcaaactggcttgtgtccttcaaagttgtcttcagtcaatctttgagtacttccttactttctggcacaagaagatgtttaatgctcatcttagactttccatcttccagccctgaaatcagtctttcttgaaggagccctggctctgtttagtggattgtggtatttagaaaccaagatctaggtactaggggtgctccttgttagtgagtattgctatttctagacctgtcagcagagacgggaagtgtatgtatatacactcacacctacacagaagacagccacttttaacatcttacagcatttcatttcagtttttgtaagttccctttcagtattttcctgtttttcttttttatattgaaattatattcaggaaatgttttatatactgagagcattttcatgtcgttaaaataattaaaatttttcaatgacgaaataatattgttataatatttatttagccattcactgattgttggacatttaaatggcttttaattgtcatcattgtaaataatgctatgagaagcatttttaaacatatttaccaagtgaaattattggtcataacataggcacaggtggtttttgccagttttatccctcaaactacatataaactttttattttagagtattttgtttgctaccaaatgccatcagattttcccctccttgtctgaaagtatgagatctgcaaattttgacaaatactattattattttttatttggtttattcagtactttgagcacaaaacagcctatggatggttctgagtacatttgtgtctggctttgtgaccacatctgctatcctgtgctttgcaagtgaatgtctagatatggccatggttttttgttcatttctggatccagtctgtttaaaaattgcagagtaaagtgagtgcatcttagattccctgtcaggatgctgtgaaaaaattatatcaagaagaaagcaaaactagattttgaaaattaaaccaaaccctttaaggttacgttattatcccaggcataaaatgaaatctagtttagatattagtggtatcttttgatcatagtactatgaaatcattcagaaatcaactttatgccattcttagttggaatttt

SEQ ID NO: 86158 - DNA, 1489 bp, Homo sapiens
aataacccctgaaataccctccatagagcattttctgttggttaaaaacttgcaagcaagaatggttaaagtacagatgttttctctgaggcttcgtatctcctaaaaagacacaggttattctgacaggtgagacaagcccaggcaaatatgcaacattgatctaatcagcaagaacaagagtgatgttttaactggggctaccttttaccagcgtcattaaaggctcccattactcttttattagaggttccctctcttccttatcagattacagaatgaacataactcatggcagtgatttgatctcttgttaaagaggattacagctttgcattaactcggattgacatagtttataatttgcttgttgattctcaggtgggtagcaccacacgtttgaccccccagcagtgctgaggggaaaggacccgcatatatcatcattaaggatggcgtccagcacagagataggggcatggggccttctttcgccagtaatgtcagaaaggacaaaggaaacactctcaagttcaaacctaaggcttgggccagagttttaaaactgggttggaaaaaaaacactgctgttgtttcttctatttttcctgatttgctgctgttcagtctcttattctagagaacttgcattgtcaaaatgaagccttggctccaagcaggaggtagagtgataaaagcacatcttctagaaagagatttgtagatgctgaacagataaatccttcctcaaaatgggcctttttgactatagttctcatttctgcacttatattctcatcgcttcttcaaaggattgtaaatcctctttttttcccaaagggatgtttcacattctttaaagtgtgtgtaaatgtttctcttaaggacttgttttttaatttttattattattggctttctaaatatattgcaatatcttacagatattgtattaatcacagctaagtaactggcaagttacttgcaagccggtaggcaatagctaagtttttcaccttaatttagttagtcataatcatgttattgatgtgccccacagtgatcactgagccaacagtcgattgctgagataccatttctgtttctaagtgcagttatccttcgctctgatttatccactgtaagtctgtcccctgtgtctgatgggcaatgaaataatatagaataatcatatcatatttcacttactgagagtttactatatgccagacattgcactaagcccttcacatatattttcatttgttcctcatttaaaaaaaaaaacagtgattgatgttatctgcattttataagaatactaaggcatggaacaattaaataacttgcctaagctgaacagcaagtaagtagtggaacaggtgtgtgcatctaagagtgtggtcccaacccccactgctgttgccaagaaattcacaaacttttagaaatatttgggaatcatgtgccacagggaaggcccccatcc

SEQ ID NO: 86159 - DNA, 1042 bp, Homo sapiens
tctgagaaggactattttaaatgtaacccctaacagataattatttaaataaacaaactttgtgttttcacatctgtgtattacgccactgtccctcagcatgcaatacagacatagccatttctgtgcaaaccccaaaaaaagttgggtagaggcttcctgtctgagatgcttttaaaggcccccagcttgtatgtttgtttacagtttgctgtttacaagattatttttgcaactgtcctataagatgaagatgagtttcttgcctcttttgctgaaatctctccaaatcatctcacttctttaatatactttcctctgcttccatgtcactttgtatagatccatattatgtatagcatctaccaccaggttgtttcctaattattcataggttaggtctccatgctaaaccattgcaccgcttgagggccggctccttattttgttcttagctcatggcaatgttggaaaagacccagaatgaaaggttctcctctgggacttctgattccccaccctttgcttagagggtttttggggtcatttttacttaggattgaaccctgggaaaggctctctcaagaacactcttacatgtccatcacttccaagaccctaaactttgtatacactataggttttctcctgctatatactatatactataggtttctcctgctatatactatatactataggttttctgtgctatttaaaccaggtttggttctgatggccttcctataaattattacaggtcaagtgtcacctatcgaattcttgcgtccagaggaatttcgtatttcagattttcttggatttggaaatatttgtattatccccgttgagcatgcctaatctgaaaatctgaaatctgaagtgctccagtgagcattttcttacagcatagttcgtgtcggtgctcaaaaagttttagatttcggagcatttcagatttcagatacttgagttagagatactcaccatgcagttactatggagcatgaagaaccccagcagggctctgtagtgatttata

SEQ ID NO: 86160 - DNA, 1308 bp, Homo sapiens
atgtcagtctcaccttctgtgcggctgggggaagtgattcacgtctaagcagtgaagcatcccctagcttttaacaggagctgttagaggggctgctgtttgaacaaggagcttcatcttcctgaagccagcagtcacaaaaccgtaaacacaacactggccaactctattgcggggaccgtggtggcttgacgttaatattaaacatctccagcaaggcagagagctctgcatcccaggtccggaataaaaataaataaaaataaagagaaaccctgctaaaagcagtgtgatgatttgtcgtctttcctttgtgaggccatttgtcttctctcacatcaaatctgttataaaacagtcaaactgtgaaagtggacatcatcccgggaatatggaatattaatgcgtggaaggagcggcgccccttttgtctgaagagtggctcctcccccacccctctgcttttttgcaagtccgctaaggtaaattatttttctttaaaatcatgtggaagatttgaagctagtagtagggatggtggaagttttgagtatttttcttcctttgttaaagtgcaggggatttgtgactggcttgagtaaggaggaagcacaagtgagaagaaaacctgtccacgtgcagtccccttctcgcccccatccctctcccctctcctccctgttccccagcctctcagttcctttgtttggggcctgaacctgcttcttggaacatttataaatcttgagtctgtctgatctttaggggacaggccagaggccgtgtgtcaccatgtgtaatttagagctgtagggctaaaagcttttccagaggtttgaaggacctagttctgacctgaccaaaagaacgaattggaacagaccttctagagtctccttcaagcactggggaggatggtgatgagagcagacacacggggtaatttatgggctccgctgactggtggctgggtccacttggaaacgagtcgtgtactgccaccttgtggcagattcgggcggctgcggttttgttgttttggaaccttgtgaagagtttcagctagtgtcggattggacatgatttgccttgtatctagatttaggtaattagtgatagataaggggtgtctctgagtcattcttattttgctaagttgatcctgttaagaaataagtcttagctgaaagaagactgctttctttcccctttacctcctttcttctgctttgtggtttttttatgggggtttttgttgttgttcagttttggtttgttttttggtatggaattatgatgagatttcag

SEQ ID NO: 86161 - DNA, 1003 bp, Homo sapiens
tgcaggcaagcgcggcgaggctggaaagggtatgatgtgaagggctagcctcgcgcctctgcatttctttctcatcagacgttgttgtcctaaagtcacactgtccttttgttatggcaactctccctttcacgccatttaattttttgtgtggaaacagctagagagacttgtctttactggcaaataggcaggccatggtgtgatgaagtggagcctgccctgggcaccgaagtatccgtgtgacggagctgctgatttggaagccgtgggtttgcatttggtctggggctgccgtccaccttggcaggcttcgtctgggctgattgaggctagtcacatggatgtgtgtaacagaagagcagaagagatgggtggagccaagggggaagctgtgtcctttgtctgtggcctaggggtctgctgggtagttcagggtgaaggcaccagcacattcttgggataaaattcctgtaataaaattggaggcctgttgttttctggcctgcactttcactgcctgtccctcccgcggtccccaacatgataaggctagcttacatttgtggcttctgtagttcttccttaagatgtttttcttttgacttttttaaagctttgatactctattccttttgttggatttcctaattgtagtacctttattcctatccataactatagtagggtgacttcaaaaaaagaccagtagttttttgtgttgaagccttgctgtttgaaaggtggggttttttggttttgcttttaaagtctgatgtgccgatgctgaccctcagatgatgagagcacttttaaaacaagacggcaggctggaatttgagttccatcttgagaatatccgagcaggtgtagatttcttctggggctcctggcccatgacctcagccctgtgtgcgcctgccctgtctctgtgagggctaccggctgggccttctgcagggcgtggacatggatggctgcctctgcggccacgtgctacacg

SEQ ID NO: 86162 - DNA, 1079 bp, Homo sapiens
agtgactgccaggcctcactgaggctagagacttatactttaggcattgtgtctcagctcctctgagagcaaaacaccaaataaacagccttgccttctcaatcacaattttactaagtaatttgggcttttaactggttctctcaaacctgtcaggttattgaattctcttagcctttgtcaaataggtgggtccctagagtctgacaggacagagtcagggtatgagcaccagagtgctcgggagagccccatggagacttcaggtgtacacctgtgtccataaaggaagagaaggagaaggggcacagctcctgcctcgaggcctacttcctcctcctgcacgatgctgacagtgaaggagaatcgtggacacggagcacacttttggagtaagcaagcactccagatcctgaatagtcagggtgtcccggcctggcctgacccctggtgtttgaccaagagtcatctgtttgcaggcttatgtttgggacaataataaggatctggcggagtggctagagaaacagctgacagaggaggatggtgttcactcggtaatagaggaaaacatcaaatgcatcagcagagactacgtcctcaagcaaatccgcaggtgagaccaacgtggggaactccactagagaaggagggctaatttctttggaataaaaagtttccaaacaaatcatgagatgatcgcagaaatcttatgatctctgcagtctcttgctgtttgagacagctgtagttgacccacaggtacagatatggcctgaagcccaattctttttcagctactgctccccaggggcacttagtaatctcagctagatgaaggcttaattcactgtgcccacctcttagctctgaatgctgatactcaaaccggatgaacaactctgggaggaaagctgattgtgtgtgtggtggtttcctgggaaaccacctcctcacctcctgaagccaagagttagctgtattcttctagaggcttcagtctgctccataggatcggtggtagagactgcaggggcatttttgtaaaagtttatttggaaacatttcacttacagaaa

SEQ ID NO: 86163 - DNA, 1015 bp, Homo sapiens
tcgcatgtacacggaaacaggagctactagtttgtgctcggagtttaggggtgctctcaccacatcccacgtgtggaatagcccagctgctttgatgctggtcagcagggatgggcatggtgtcagtgtacaagtactggcctcaggggaaggaggagcctgggtggtgtcagcaatatgcagcaggcctctaggtcgctacttgcaccttctcagggagaggcatgggagaggggctgccatctgccttcacacttgtgactgccacagggaaaagagggcatgtgggcttcttgtggcaaggtaaagactggtgtggcatcttgtagggccctgttaatcagcaaagagcagagaagacaacggagagccaggccacagagggaagagggggcaggctgatgttgagcttcccgtgattgtggctgcttttgtgcagagagattcctggtcattacagagtgtgacgggcatgtttatctaattgcagggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgtaagtacaatggttgccacttcttgtcagaggcccacatgtgggcaagtgtgtgtgtgtgttgcacacaggctcataagcagggagctatgagggccaaattaaaacaacttctgcagatcaaaacattttcaatattttttagattttcactgtttctgtaactgttatcatcttaaaacaatgtataatttaggtttccattaattcctcaggaggcaagctgcattttactggtgggaaactgagtcacatgtgacttcattggtgacgggtcctcaggatgtgggttactatagggtcaaggctcccgcagcagctaattaataattgatctgcaagttgtttgatccatcttctcaaaacgaat

SEQ ID NO: 86164 - DNA, 1352 bp, Homo sapiens
tctctcagggatatcctatacgggcagctgtctctgcgacaaagcaggtcagcctagatataacaggacatattatgaacccagttcctttggggttcacaatgattctggctcttttagtttgcctagaaccaaactaccaaaattctttttcacaaagtgggtgaaaatggtctcatttttcagactgggaaattgaggccaaaaaagtgaatcatctaagatacaaaataaataaatgtacatcagagtccagaatggaattctcattctctgtgttctccttttctcaggatttcttcagatttttcctcaactgaatactgagcccgaactaaattaaacaaggattctttccttttgtaatctaaagccatttccacagagaaaatctgatttaggagaaagcctgtaggagtggatgttatcttgtgttgccgttctctccccaaatctgcctctttactggggagcgtgctcacagatcacttagacaaaccagcgcacaactgattgactgtgttcaaaaacataattactccgggcacggtggctcacgcctgtaatcccagcactttaggaggaggaggcaggcagatcacctgaggttgggagttcaagaccagcctgaccaacatggagaaaccccgtctctactaaaaatacaaaattagccgggcatggtggtgcatgcctgtagtcccagctactcaggaggctgaggcaggagaatcgcttgaacctgggaggtggaggttgcagtgagccgagatcgcgccattgcactccagcctgggcaagaagagcaaatccctgtctttaaaaaaaaaaaaaatcataattgctatgtattttataagaatgagtaatatttgacttctgagcagctaacttcatctcttctagaatttttatttttttaaatggccttttgtcatcttacatggttagtttgggtggaaagatggtgaattactagtttgcaggtctgtgattataacagaaaatatgtaaatagtgcctacactgattcctaatagaagtaaagggaagaattacctcagaaagaaaagtgagcaaagcccaggccccagagtcttgcattgctgaatcagttctgaccctgattcacagaaccagggcttggtagagtcattgcaaggaggagaattacttcctaccatttggttgccttaaggaaattaaatttcttctctggaaatggagccgcagccctccaagtcctttttgtctctctctgacatccttctactgcctcacaaggccaggagcagggagagtggctgtggagcgggacggccttgctagcctggcctcttgagtgctgtgac

SEQ ID NO: 86165 - DNA, 1038 bp, Homo sapiens
tttgtagagacaggttctcactatgctgccctggttgggtctgttcttctcatgtggctgtgtggtatttcctaagtatttttaaaatttttctctcattgataccctataaaaatgcaactgttaaagaatttgtctttctttctcattatattctttccagagtatataactaatttattcagcattcattcattcagcagatatttgttgagcactaactatgttcaggcactgggcagggatatcgggataccaagatgaaaaatagtttttgaagataaaatttttaaaggatcaatttccattaggtgcacatttgaagagctcatcctatgctaagcatcatgagaataactgaaaagaggtagaatagttccttcctttagtaaacttactgtagtgggagagcacatattgacatgaaaaatactcaacgtttgtagagcaaatgtgaattaatgtggtgaaacgtgagtacagaaattcagagaggatataaaatggaaaggcaatctggaagacttacacactgtatcttgtgaaagacagtgcatctctctgttgctgtcttgtgcttttgaagatcctctggagtcttgaatgggatacaggtcgatactccctttagtctatagggtggccaaacaggaggcatagtataaggaggctcttcgtggccagaggtcctgaacagtgtttaaaagtactgctttgaggaagagaaatttcttgatttctaatttgtctcattctccatagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggtagcgtgccttccacatttccattcactgcctttagggaccctgtagctgttggtttcctcctggagaatgttacagccatggcactacagcaccca

SEQ ID NO: 86166 - DNA, 1357 bp, Homo sapiens
tctgtctcttaaatacgaagggatttcagacaattgtgtgtcagattgttgccaagtgtttcaacctgcctttcaaaataagtggtttggggcagctgcagttcagtctgagcatgtcgattacagagtttatttgtgtgtttgtttatattttaatagcctgctttttgggtgttttgatggttgggctgtgggtctataggtgttccaagttagatggaggcaatatattagtcccaaacatgtcagctttaacaaaccctgatgctcctttcctactcacagtcttggggccgaaaaatacttgtttggcagtcagatccaagcctcacacaggctggtagtgttatcagtatagttttgaacatttctgaacacagaggaaatccagcagcagttgggaatattcagtcatgtattcaagtctctttttctggttttattttactcatcatattagatgttggaaagcagagtaccccagtctcatgctgtctctcctagcagtaagaatgaagtagtagaggctgggcacagaggcttacacctgtaatcccaacattttggaaggccgaggtgggcggatggcttgagctcagcgagaccagtctgggcaacgtggtgaaaccccgtctctacaaaaaatacaaaaattagctgcgcatggtggcacgcacctgtagtctcagttacttggggtgttgatggaggaggatcgtctgaacccaggaggcagaggttgcagtcagctgaggtcgtgccactgcactccagcttgggagacagagtgagaacctggcgcgccccgctccccacctcaaaaaaaaaaaagaatgaagtagtagaatgtggacattagggccaacaagatctagatttgagtcttatctccaccactcactcttatttaagcctcagtttactcacctgcaacttggatatataaataagataatgttctgatgattaaatgatttatatgtgtgtatatataatcatgttccctggtacacaataagctagccatgatgatgacaaaaaggagcccacgtccatttcataaaattaaaaatcacacacacacactcatcttcatttgaaactgtttgcatatactatgaaatctagtatttttttaatagatgaatgaaaatacattttaaataaaatctccccttctttttgagatgtcaatctgttaattataatacagagatagattttgttgtagctaagtctttaacaagaagaagtgagtaaaagagctggaaactttgtcttcacttacctctaactttttttttctttttcaggtagaatgactttttgtgctgtcttttattgctttattttctcc

SEQ ID NO: 86167 - DNA, 1073 bp, Homo sapiens
tttgagttgcaacttgaatggaaaaaagtacattttataattccatacagaatttcagaataatctactactagtgttattgaggtgacctactgttgtggatctcgctctcacagatggatgctggaccattctgatggtgctggggaaatatgattgtgactctgtccctcttttctgggcatatactttgttggtgttactcctaatgttctacagtgaccaagacagatactgaaattagcatttactggaagaaaatgaacaaattcagtaccagaggctgttcagtaccagtggcaatttgtgctatgttatattattatctaacaacagccctgggcctgtggctccagcatattagaccattattacaaaggctctactccatgctatgggaattgctaagtaattaggcagccagtatcaccatttacggagaaaccttgatgtgtagagcgactgtggacactacagggagagccaaaggaaacactacctcttacagtagtgaagccctctgtcccatggccagataattcatggccatgctaagccagagactgcatacctggagggtatgagagtatgctaagtataaattccatctgtcttggggagaatttggggttctaaagcaataggatagggccaggcggggtggctcacgcctgtaatcccagcactttgggaggctgaggcaggtggatcacttgaggtccaggagtttgagaccatcctggtcaacatggtgaaaccttgtctctgctaaaatacaaaacttagctggcgtggtggtgggcgcttgtagtcccagctacccgggaggctgaggcaggagaatcacttgaacctgggaggcagagattgcagtgagccaagattgtgccactgcactttagcctgggcaaaagggtaagactctgtctcaaaaaaaaggaaaaaacagtaggataggttaggggaaggagggaggagtagaaacttttggagtaaatagtgattagaaaatgcttaggatggccaggcgcggtggctcacgcctgtaatcccagcactttgggaggccgagg

SEQ ID NO: 86168 - DNA, 1218 bp, Homo sapiens
aatcctttttaaaaatgaggaacctaagcccccagagtttctttaactgagacttgtcactaaatattgttgaaagacaggcatgttacctttttgtgtctgtgtgcaaagagacttgcacacaatgaggtagcctatgcctctgggtctcagcctcacccaccactgcagtttcagctgagggtggaagtatgctttgcctatctgtggcagctggtggagagaaaggggcttgctggttttaaaattgcaaccatgaatgtgattgttaaaagtattttttgtttttttttaattttttattttatttttattatacttcaagttttagggtacatgtgcacaacgtgcaggtttgttacatatgtatacatgtgccgcgttggtgtgctgcacccattaactcgtcatttagcattaggtatatctcctaatgctatagtaagccctcttagcgcagctggcagcgcgtcaatctcatattttttgttttctaagttttctttttaggaagaagattcagatagtccctcagaacaaccaacccatggagactgaaatctctgttttgtggagaaaagaacccattttagtgcgacttgtgaaatcgaccatgcctttatttctatagagacaaatgtcttttctcttgctcttttctctaggtcctcgggcgggaagtgtacacctccaataaccagctggggggcatccagattatgcacaacaatggggtgacccactgcactgtgtgtgatgactttgaaggggttttcactgtcctgcactggctgtcttacatgcccaaggtgagcccttcctacccagcactgacatggcctgcagagcctgtcatttccaccacagctcactgcctctgtgtttaaggtcttgtctttatggtggaggaatttttttataaaatatttctctgaaagctattgatttctcttttccttacagccatattttgccttctacctttaagatgtctctggatttcatttgttgggcccctttctaatgtcttccagccacggaagccctcatggcctacctaaggctcagatcccagtatattaaggttcctcctcattgtgggttttctcctctgtaatagccattcattcctcagaggagcatcccagaaagcatgggcacactgaaatcaagagtcaaaacacaccactttgtgccagcctcctaaatgagactatt

SEQ ID NO: 86169 - DNA, 1059 bp, Homo sapiens
agcaggagaatgagaaaagagccgcagtgcctgggctgagattaaagacggactgagaggcggatgggagctcagtggtcagataccgtcttccctcttcacgaggctccttcaaaggagctgccagcatgttgctcagcttggggctgcctgtaaaggcttgttctctgcgcttccttatcaaggaaaacagtaatctgagagcaattttgctttccatattcctttcagaaaagtatcttatgcccttcctagctgaagttaaatggaatcaaggccaattgggtcacactgaggttattactttggtcaccaacttcctccatctttggaaggtcccgatgggggtgctgacccagcatgcaggggaacctctcaaagctcctaacaagaaggggcaaaatgggaatatacaggcagactttgctggcccttagttagttagattctccccagagactgaaaatgaatacacgtacggaagaaattttgtattgtcgttattttttaaaggaggaggggaaaggaaaaagaaaaggtaaaatacagtaagcgctctacaactgtttagagctctccggggctaccttagatgactgacaattactatacactcagcagtttgcaatagtcagtgatcaggctgcccggcttccatctgctgggtcagaaaacctccttccctgaaagaaattattaaccagtcttcaagggaaaaagaaaccctgcaatttccaagtccaggaatatcttttcttcctctttttttcttctttaaaggaaactttgtggtttccaattgcaggtgccctttgaccttacaaggattaaattcctccagggatataccagggattgaggccctgaactccctggagcctgggaagggaaggaggaggggaagcatgcttgggtataaatcacagccctgcacccagcacacaaagaagacttgagactcaggggttcatgtatgtatcatgagttgcttcaggtttttgctagctttagggcttgtgcgtggaggccagtgttaggctggtgcaaaagtaattgtgg

SEQ ID NO: 86170 - DNA, 2219 bp, Homo sapiens
cacggttccttaggaagattggtttcttcgtcttcttcattttatattcagttgtgtgttacaccttcatatgttgaattttcttcacctgtctctctttctacatatattcatagctctgtctttgcagatcagtgctcacttgaagctttgctactctgtcaacccctctcctctcttcagcctttcttctcccccaaccccagcctgaagcccaagtaaattagcttatcacccctgccccctagttgtaaaaaaattcccgtactcctccaacagtgtctattcttggatttgcagtcagcaaccatctccaataaccatcaggctgtcagctttgcagctccctaccacctcccacctcccccattactcaccagaagaaaaagagagccagagcaagagcttgaaatatatcatgcaatagtgtatcatgaatttgttgtgaatcacagtggtgaagcaggtttatttatttctgagaccttaaatcaatacaaagtaggtctcttagttctgaagctgggatggagtgtgaaaaaatgagcccattgtactcttacaactttggggaaaggagatgacagctatataattccatttaccaggcactaggggctttaatgtgaaggtgacagggagctctttgtgcatttagagcaccatatcttctaaataaaagatctgtagacttgatagtggagcatagctccaagtttaataatctccaagcattagaccgagccaatatgttcccaagtcagaaaggtcccccttaacactcataaattaaaagtgcaagaaccacacgttagtagattagaaatgcaaggactccagtcttttctagaaggaagacagagctgggccctggctgtgcacagactggtctatgaatatgataaagaagcggaaatgagactgtttagaaacctgactcctagctgttcatcattctagggaatgttccctgtgcatggatccaaatctagctatgtcccttctcattcagattggccatcatcacacagtctaatcagctaatgtacacagtcaggaatattgaattatgaaaggagaagcttaaagagctttttagattgaactacagattaccatgcctgggcttcaagattttctggctgatttttgaccggttcctaattttaataatgtctcagtgtctgggatttaagccttctaaaatagtatgcgcgtctaagaaattgagaaatcagtgttggtaaggaaaagaacccacccaaatttaaccaacagcataagatgcaaatatgagaagtcaagaccattggaacatgtaatcaacttttgagtaacttcattttctacctgacccattggtaaaatatgcctttctcaatagataaagcaggtttatgcagctcagaagagcattcctaacataatatgactttatagtacttagaattactagtttaattttagcccatgtaaagaattttgacagggagggagggagaggggcatctacattggggaaaactaaaaaggtaggaaaattgaaccactccttttgcttcagaaagccactacacattataacactaatatgaaagacttattttgcttatagtggtttaacttgctgaacatactaatcagttgaggttttatagaatacatagaaatgtggtagatcacatgcatttattgcatgcctgttaggtataaagctgttcttatgctgtggcaatacaaagatgattcctgctttcatggagctgaaatttagctaaaagacaataataggcctttcatgtgttctaaaggaaaaaataaaattgctgcccatcagacgtcaatgagaaaacacaaaccaaaaggccacagagatagtaagtcagtgctactcccctaagagcgaggccctgcaaacaccatactcttggggcctggacactggtgagcaatgcagtcagtcacagcctattcagtaaaaccagtaggaggcgactgacaaacagggatttttttaaaagttttccatctttagaaaatacataatctgataaaagattggtatccaaaagaattctcaaactcagtaagaaaacaacccagtaattaaaaacatgggcaagaaatttgaacagacattacaccaaagaaaatataaggatggtaaataagcacatgaaaagatgcttatcattagtcattagggaaatgaagattaa

SEQ ID NO: 86171 - DNA, 2547 bp, Homo sapiens
gactttcaagtttaagggtaagaattaagtgttctgtcattcccatttaggaaaaagttgataattccattggtttaattagattttgtggatgtcagaaattagaggaatcatttgatgcgatcagcttgctctgtgcattcatatgaactctgtatcctcctctgggcttgcttttctcatcaaggaaaggcacagcagtgctaacagtggcgaacttggctgtcttcctccctttttggagagtagcctggaaataaaggttgtgaaccactactactgaagattattattgcagtgggagaaactgctgagagtcttaaggttgttgttttttttttttttaagttgctcttttggataccttcttaggatgagatattgatgaatgccaaagataattttaggtaccattatctatgagaacagaatttttgaaagattttaaaaattctgttctcatagataatggtactttaaaaacctatatttccatgatgttcccatacccagtcagagagctaatttctgaaatatatcttcttatattgagtttctttctcccccctgccccgatactatattatatacaaagaatattacaaaaagcagatgttgggtttttggttttgttttgcttgaaaacttgctagttgaatttcatttgtgccatgaagaaacattagagattgatttcttaaaatctgattgaattgttctaatcaaattcattatattcactgtcatagcttacagggctgcttgttaaaacaaaagcttagttacagggtgaaagataaataaagctatagctttaacttaccaaacaatgctcacttccaaaagggcatatttgtttttagctgaagggagtgatcagatacagaggttacctaatgttgctctgcctgcttcactatcttcatgtcagctcctcttaagtatagagctgtgctgctgaagacacccgattttatgcaaattcgttcagaatatcctattagcccctttgcctataaggtatgaaaaaaggaaactaccatgctcagatggcttcctctgactcactccttctgtgtgttgtctttgtgtgtgctggtgtttttcttcatctctgtttgcctttctttctgtaggtatctctctgtattgtgtactttgggtgtgtgcaagtcaccctgagtgcatgtctctttctgtgtgggtgctgatctttctgtctctttgtgtctgtgtcttgcgtatagatccccctctttctctgtctgtgtgccgccctgtgtgttcatgtgtgagaaagtctttgtgtttttgaaacattatagagcctcctttcttaagccttggccattttgctcatagtatgtacctgtgtaaggtggaaatgtaggagacatgcaagcttatatacagtcttagactgtaaatatttgacccccacatttttgagtcttcatcctttatgttaaacattggggtgaagaataaggagtgggggtgttcagaggttgtaggggaaaaaaatcttgtgtgtgcaagtgccgatcctgttgacccctttgaaaattgaaataatgataatgcacgtctcctgactgcatcaaagtatcagcacatcaaaagccaggaggcatgaaatgcaaatgataaagtgaaagcagatggattgtgcatgatcgcctgatgcccaatgaattttaaaaggtgctggtttgcaggaaggggggttggggggttttgggggggactgaaataaacacgttatccctgcaatttttttttgttcttgatgctcactcctgacaatattttttcacacttgagtgaacaccctctctctctctctcccccctccttcttctctccctttctctctcctctccaaatcccctcctctgccccccccttcccccccacctcttacacatctcaggtcatgtcgctgcagctccggtggaaataataagatataaaccacgaggttgttatttgcatagaaatagcatggagccccaggcagcaagggagaaggacacagggatgatttgtctaaaattttaatgaaaacttttgctgaggcagagatttttaaaaactttctttctccctgcttttccccttccttcccctaccccccaaaccccatcattgattttacttaacatggttcagtttgaagagaaaaggttgacactccacatatcatactcccataatgcagcaacctgtaaattgtttcttcctttaatagatatgaagctgaagagacatgcattttcaacttaatacattgcatgtgtgcgcctggcttttatggctatactccatcttggcatacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtttttctgtatacttacatgttttattcatggacgccatcct

SEQ ID NO: 86172 - DNA, 1114 bp, Homo sapiens
aggctgaggtgggcggatcacgtgctcaggagatcgagaccatcctggctaacacggtgaaaccccgtccctactgaaaatacaaaaattagccgggcgtggtggcgggcgcctgtagtcccagctacttgggaggctgaggcaggagaatggcgtgaacccgggaggcagagcttgcagtgagccttgattgcaccacttcactccagcctgccaatagagcgagactccgcctcaaaaaaaaagaaaaaaggctatctgcttaattccagatttcgctctttctattaaaccatgttgcttccaggtaaaataggcaccaagctaagaaggaaagacatatgaatgaagagtataaaaggaagcacataaagccctggcattaaatataagctttcaatacacttttagccgccttttattggtgattattcttttaatggcttgttgttactgtgtttaacattcataatttgacatggccatatccaataggtacaagataacagatattattgggaaagaagagggaattggacccgagaaccttcgaggttctggaatgattgctggagaatcctcattggcctataatgagatcattaccatcagcctggtaaatctttccagaatgtgaaatttttgaagaactggctgtgtggctaggtttatttttttctcttatcactgctattcagtcccaaatgagagcatttcttgaagattgtatgtctataattatattttaatcacacatgataataggaagataggataatataaataactgaatttttcaaacaaacccagcactttgttttagcttttagtgtaacttctttttattttctttcttttttttttttgagatggagtctcgccctgtcaccaggctggagtgcagtggcacgatctcagctcactgcaacctccgcctcccgtgttcaagcaattttcctgcctcagcctcctgagtagctgggactacaggcgagtgccaccatgcccagctaattttcatatttttaatagagccggggtttcaccatgttggccaggatggtctcaatctcttgacctcgtgatccacccgcctcagcctccaaaagtgctg

SEQ ID NO: 86173 - DNA, 1020 bp, Homo sapiens
aaaaatgcaaaaattggccgagtatggtggcacatgcctgtagtcccagttatttgggaggctgagatgggaggattgccttgagcccaggagttgaaggttgcagtgagccaagattgtgccactacactccagcctgggtgacagagcgagactctgtctcaaaaaaaaaaaaaaaaaattctctacacagaggtcttagtaggagatcagaaaagataggaattactttaggctgggagaagctttactgaggaaatggaatttggatgaaccttttggaatgggtaagatttggacagagtgagaggagaggagagagaaagacaaagttttttacgtagaagttaatatagtagatttctgcttctaatagtgtgtttatcaaacccatgggtattattttcttaatttcgcatgtggggacattgaagctcagtaaaattaaataattttcttaagatcacacagttagttaatataagtgatagcgcctggatttggatctaagtttgttggactccaaagcccatgttcacctttatatgccctatcctttgattagcagtgaaatctaaattattttaatgtaaattgaataatagtgctttcttagatgtttgtccatcatgctacctcaaaactgaatgtcttctgatcaggaatcttgctgcactgagactgggataacactctccattctgtaatggtactttttaagatggggggcggggcggggtggggaggcggtcgatgagcaacatactttggaaagacattgataaagaatagtgtgttcttggtgctgctgtgctgacacctaattagaagtcaatattgcaagcataatgacctagccaattgctgaacttgctgcccaagtgacacagttagagtccccaggtagtaatgaaagataagagtattatttgcctgcccagtgccacatggtcgcaatgtttacattagcacacaaatgctgaagtagattcttcagggcttgtatctaagctgcttctg

SEQ ID NO: 86174 - DNA, 1019 bp, Homo sapiens
cacagcatagctagagttgatggatatgtctttcacccttaaaaaacaaaatcctggcatgttttgcccttagcttttcctgcaaatttctttgttgagcttaatattgttgttttattttgtagtaacaacagcagctttgggaagtgcctgtgtgtgcttgcacattctattcacattgatagtacaattaatgttgatgtcaattttggtgttaattttgggtcatgattagtgttgacactttgtgtcagactaatggcatttatgggcaccatcagaataaatgttaatattatcatgttttcactatctgttatagtaacattaaaccaaggtcctcccagcagaaaaaatacatatatggatagatagataatgcctttctgtatcgctggtgttactcagcgagaaaatgacatctcagggcagaatcctaatcactgtttggagcatcagaaataatgatcacctctgatcggaggttgtgaataattcatttggtttgattttcacgtcctgtccagtgatacttttcaaaccaaatgtgtttctacaggaaaataatggtcccacttcttatggaaatactgtggcacaaatcattttacccacataaaaacagttaaataagactgttctcttctgcttgctttctccttcccatcccctcctccctcacttgagctgttcattccagaatcagaatgtagccaaagaaatatgttctgccttagaacttgtataagggaaacaaatatttatttctgcttatccttagcttattcactgtggctcttttcatcctcttccctttttcactttaagataatcagcttaggttgataaccctaaacctaataaacctgctcgttggaatgttctgttatgaaaaatgatctgaaattaaatattttaaaacttattcatggctatagtaatgacaaaataatttgtagtaagtacctaggaccacttgtttagtcagtgcatgagagaggcagtgatcagagaagacg

SEQ ID NO: 86175 - DNA, 1604 bp, Homo sapiens
taactctttggttgaagatcctttgaaccttgcattagggatctattttttttttttaaagaagaggatgattgaagaggaaataaagtagtgtaaattaaagtttaaagactagctgacagccaggcgcggtggcgcatgcctgtaatcccaacactttgggagaccaaggtcggcggatcacttgacgccaggagtttgagaccagcctggccaacatggcaaaaccctatctctacaaaaaaaaaaaaaaaaaaaaaaaaaaaaaaaaatatatatatatatatatatatatatatatatatatatatataaattagccaggcgtgttggcaggcgcctgtaatcccagctactcaggagactgaggcacaggaatctcttgagcccaggaggtggaggatgcagcgagccaagatcgcacgactgcactccagcctgggcgacagagtgagactctggctgaaaaaaaaaaagactagctgccatcatgactggtattttggttttagtcctgctttatgttctcaggggtgaaatggtagggacagtggggattaggggttcagttttagaactgctagcccaactaatacccatatttaattattgttttaattgttggcaatgtactgatatcctatgtctcccaaagtatagcatctcattaatttttttattttaaacatataaaaaaatacacagtgatatgacaaatacccctgcatctactgaccagcttaaacaaatcttaccattttgactgggctcctcacttacatgttactataatcctttgaatctctaatttgagtatcaaaaaaacaatttaggagttggtagggaaaggaagttggtaagcttatataagcctaaaagattagaagaaattaattagtagatccattttgacagttcttaggctggacctcttaacccaaaggacctcttattttagaaaaaccaccataaccctctgtcttaattcacttggttgacattttccataccctcaaaggaattgcttgggttatcctggactcagattctagtggaaagcattatgttctaaaactctgcctgtagagagtgtgtatatgcttacgggttttggtggtgagaaaagggtaggccatttctcatgaacacaggacccaaatatttaacattagattttttaaattgttttactcaatttaacctcaaaatagctccatgaatgtgatgctaatttggatgtactttaccttgcttttgtttcattcttttgaaatcagtttgccttttcatgctgtgtatagaaattgagtcagtgtcagtcttttagatatgtgttagaaaagaggcatatttaaattgtactatgctgaaggtgagttctgaaatagacctaagcgaagcgggtctgtaaaacaggaccatggtctatgcattgattgttcaacttataaaaagggtctttgccattaatctgtccctaaagataggagaatgtttataagtgctttgggatcctcagcagaaaagggtcaaatacatatgattatgtataattatgattatccataaatgattatgattatacataagtattcataatttgt

SEQ ID NO: 86176 - DNA, 1171 bp, Homo sapiens
aatgttctgaaagccaaggctcaatgtaaatgcattggtgctatgtagacattaaatcatcataatgtggtgttctccaaaagtgacggctctaccaggtcatcattgtgggtggtattgcattaccttcaaggattggagtttctgagtttgaaaactagcacatggatgtaaggagtaagggtaaaatgagagattccttcagagttttcccatgaattgaggtgcttttctccatgatcgaaggcagaaaacctgcacttatcagaccattggctgtatgggtggccagtctttctaatttttttttccaggacagtaaataggtaaaaaggtgatgggaccaggacttggaccaattcagttccatttagttttaggtaacttctttgccatttgaggaggaatattggctgtttcagtagagatgtgacctgcattttgaacatttatgcctgtgtttagagcaggagacagagcttttctgatgctgtattagctactgtctcctttctattttcctagttgtcccttccccataaagaaagatgtaactaaaggagtaccacctaatgcatgatgaaaggtataggagaacacatttttctcattgtcatatttgaatggcattacatttagtatgactttagagtaggaataaaaaagatgtagactaaatctgtgaactacgttacttgcagatagctccaaagatgagttgtccaagatttttcttaatagtttcaagtaaagatgaaaattgaggaaaatgtgattgcagcatagactaaacggatctcatttctagctgctgtgttggtacagtgatgggcactgtatgtaaatacacagctagatgaatgtgtgctgttgagcctggatacagaagaaatgcagctatccaacagttctactttaccacttctcaattttggaggaattgttttcattttcctgccagtttactaacctgttttgatcttttggtggaagctataattgcaggtggggacattttgagtaacagttcgcaatccagtacagctgcttttcgcactaaatcctgttattaaaaagctcaggctaagatcaagccaagggctgtaacggacttgacagagaacaacttaactttgcctggtaggacaaagaaaatcctagccttcttgag

SEQ ID NO: 86177 - DNA, 1048 bp, Homo sapiens
tatcaaaagaatactgaatttgtcctttttaaaaaaatctatgaatataggatttttccaagtctcctagtcaatactaccagtattaccacatttgaattttagtaaagtaatatatgtagtcgtagtaaatagtctgtgtagaattcctgtgttattcacaaatacaagagattacctttatgcaaccatttgtttacaagttctgtctcctgaaagataccttcattcggtatttcccttttatagcattgctagcctaaaagctgagtgttacttctgtttcccaatgccagtgctataaatataatataaatcacattctatataaatataatataaatcacattctaagtaattcttcctatataataggcataaacacagtgattaggacacataggtatgtatgagtcacttgggattcaaatgttgctttgaggcaagcaaagaaagagctgaattagctcccacttcacaaaggatttacttacaggaagttggaaatggaaatcataatattttttaaatgaattggtatgtctgtgtcaaaattgagcagaattgatctgcacatttacaaatagtcacacacatctagtgagctaattcctgtgtatggtcctatagctatgaaaaatattagaaagaggtttcttccctggaatttctagtagaagcttcattctggccttcttggattttctttttattagctgagcgtcatgtcattttcctggatattcctttgttgtcaagtttctttaggattttccttttctttgttttaaggagtcgatgctacttatttagttttttaattttaatattcctaggatagtgttaggtctttcctgtttgttaatgctctggtgctgatttggaatcactcagtagtttgactttttggaaaagtgcctgacttttggcatgtaaaaagtaattacaaatctattttaactgagaatgggagctggagaatttagtctaatgtttacactctgcagaacacttggaaaagaaggcaaaaccagattgactgaatctt

SEQ ID NO: 86178 - DNA, 1051 bp, Homo sapiens
gccagctcaacaaggcaagaccctgtctctaccaaaaaaaaaaaaaaaaaaaaaaaaaaaaagaaatagccaggcatggtgtcatgcacctgtagtaccaactactcaggaggctgaggcagaagtatcacttgggccccagagtttgaggctgcaatgagctatgattgtgacaccacactccagcctgggcgagagagtgagacactgcctctaaaaataataaataacacctttattgaagtgcaatttacttataataaaatggactcgttttgtgtgtgcagttcaattcattctgtcaaatgtatacaccgtgtaagtactatcacagttgtggtagatacatcactgcagaaagttctcttattcgcctttgcagtcaaaggtagaagcaccaaccccggccttaggcaaccactgatctgctttctgttactatagattagttttgcctatcctagaatttaaatcaaacagtgtgtactattttgtgtctagcttattttactcagcataatgtttttgaggttcagccatgttgcatagattatgtgtatgttccttttcatttttggatagtattccgtttcatggatttttttttttttttttgagacagggtctcactatcttgcccaagctagagtgcaatattgtaatcatagctgaccacagcctcgacctccttggctcaagcagtccttccacctcagcctcctaagtagctgggactaaaggcgtctaccaccatgcccagctagtttttaaatttttttagagacagggtcccacaatgttgcccaggcttgtctcaaactcctggattcatgggaccctcccaccttggcctcccaaagtgctgggattacaggtgtaagctgccatgcccagccccatttaatggatttatcgaaatttttacattcatttatcaaaatgtttatattcacagatatgttttggcaggtaaggtgactaactgggagctctgacatgttccaaggaaacaaggctttccagagtttccatcagatatagctttgactag

SEQ ID NO: 86179 - DNA, 3725 bp, Homo sapiens
acacctgtctagaagtatgggtagtgtctgtatatagcaaggcacttcctgatgtgttcattattattatatcccatagccgtaccctttcttcagcttttcctttctaaatagctctgtttggcatatgtgaaatatcatcctattgaacttacagctatggggatgcccagtatttctacctcttggaagggaatgatgcactaaaagtaaggaggaagggctgacatggactctttatctggccctttcctgcccctgctccctgtggttactggactgactctagggagaaagataaacaatctcttcaccaagtgccttatgattcatgatatactgctgcttaagtgattataatagccatttctttattgcctcttttaaactacattaatgttgattattttcttcctgtataggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaaggtacatttctccttagcttctctcccagcactagcaagcataagcacagaagttcattcatatttatctcacttggacttggaaacaggtactccttgttcaggctgttgagcccttaatctgtaaagtttatagaatgtttataagattgagtttctgggacagtgtcaaaaatttgatatagccattgaaaaaacagttctcaaaactgaaggttttggtgttagcttgctggtcacttataagcagtacaaaaacgtgaaaacattttcttttgttggtacctattttatatttgccataatagtggtcctgttttgtattattccctactatttctcatctggaattattaattttactgttactaagcattttggctaaattactgcttctgtgcactaaatgttaatcacctggtggccttagtgagataatgcaccttctcaaagtgtctaacctatctctctttagtgtttttccacagggagagaatttggctgataaggaatttctcatgtattatgtatattttcttccctgaggttctattctgaaatgcattctatataatttaaggaagaaaaacaaggtgattttgtacttgaccttttatcccaagtgtaataaagacaggctgctctctgtttctgctccctctaacgctttctttctttctttttttttttgttgagacagagtcttgctctgttgcccaggctgaagcagtggcaccatctcagctcattgcaacctccacctcccaggttcaagagactgtcatgcttcagcctccccgagtagcagggactataggcatgtgccaccacgcccggctaatttttgtatttttagtagaaacggggtttcaccatgttagtcaggctggtctccaactcctgacctcaagtaatctgcctgcctcagcctcccaaagtgctgggattacaggtgtgagccaccgtgcctggccccttctaactctttctatcatgatactgtggaatttggataggagaaccagtatctccctttttcaagatcagctgtaggcatgaatttttgctgctgctgctgctttttttttttttctttttcttttttttcttacagaaacagggtcttgctatgttgcccaggctagtcttgaactcctggcctcaagcgatcctcctgcctcagactcccaaagtgctgggattacaggcatgagtcatcatgcctggtagacttttgcttcttgaacttagtatctgagatctgagaagtagttttctacctttttcccttaaaaattccaagctaatgatgggttgctttagtttgtaaggaacgccaaggacagggctactcatttgactcaaatctcatcatctagtttaagcaaaacttctcctaagcattctgggactaataagctgggaaacttaaaacatggcatggacactgtacagctgtatttttttttagatttggcttaccttttctctgagtttttcagatcagcctctgctttcattctaaccacccatatacactggctctgcttttctaatgatagatagctgccaattttctgtacataaagattgttggcttttgttccctcaagaaaagaatgggtaaatatctcttggttaacaagcaagtatgataatagagaggttaactccctgaaattcattctaacttaaaattttgtggtgcagaaacaaactgcaagggtggcacatgctactaaagaaccacaagagaaagggaatgtaagatattcttgagattttctaagaagttgaggaagcattttagaaagatacttcatttaaggatacattaagttcgaatagcatgttctagctgcattatgttctgtgcagccatgttggggaaaaaaagttttgctttagcatgtaaataacaagaaatcatgtctaaggccatttagttaaaataactgtcctacccctaaaaactaagagcattaagctgccttggtataaacttagagaaatgtgggaacatctgccccatcttattaaatcctaggtggacttagcagtggccaagcttcagagctctgtttagagagaatgttctagcaccacctacaaattgcctttctttaatttgtgcaatttaccaagagacatatattataaagtttaataaaactgtatgaaaaaaagctcatggtggtaattgctgtgttgatttaaagtcctgtaagtgcagtgaaacatagttaccatgcatataaatgctacttaatagctatttaactagagattttattcttatttggggcttcctcttaaatcccatggcttgtaattttagatactgcagatctttgatatagaatatgaatataattgggaaaggggaaggagttgcagagatttgggtgttattatcgagagaaaaccactcaaatgccaggccagcatgaaattgtccctgacttgttccaagaaagaatagtttggggagaaactatctgaccactttttgtaaggtgtgcatctccacaaaccaacctctttttttttttaccccttctttctcaaatatgagcagacctgaaacaggtcttagttagaagatatttaagttttgtgcttggtgatgtgtctgtgtcagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacaggtacaatactcaaacaggctcctcagagttttgatttggtcctacagataagacactcgtccttgttatagaagacccacactcacaaatcccattggttcacctggtgggattatcctctataagattaaatgattgtatgaatttgaaaaacttcatctgccttataagatttgcctatgttctctatcatggatgttataaaacccttaaccatttgtcatgtattggtaagcactaacagatgccaagtgaacctgactccagaggttattctgcaatttaggctctttttttagaggg

SEQ ID NO: 86180 - DNA, 1006 bp, Homo sapiens
ttatatatctatggatatagtgttccaaagccaaatatctctttaattaaaaaattgtatgatgtttctttgttgagtatttattatgtcctttgtacttatcataagtgagaaaatttttagattagttgggtaagctcaaaacattggcatgtgaagtagatattaatgtgaagcagcctgtaattaatataaaaatgaattatataaagacattaaatgttgtaggagttctaaggaaattgaggattttttgtttgtttttcatgtatatcatcaccacttgtaaaatcataaatgatgaaagtttaggaatatcatcctataaagtacctatataataggtactttagtgcctaatcttatgtaagctgtagcattagccttgaatgtagctcatttttgttgctcattagcacatcatagcttatgtttctattttcaggcatctcttttacattcacattcatagtataattttgtaactgcctcttgtgaactgttttttctctgattcttgtactcagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggtgggtgctgtactttaatgggatgttatccctgagggaagggacagaataatagatatgattcaaaattaggtattatgcttctgctgagagagaacataaaaaaaagatcaggttttcattttttgaatcaaggttcttgttctatttcaatgtttacaaaagtaaatatttcatataataaaggcttttttttttttacaaagcagaaagtgcatctgaaaaaaaataaaaaatgaaggctctttttccactttaatttg

SEQ ID NO: 86181 - DNA, 1026 bp, Homo sapiens
tttagtggaaaagaaagcattttttattactgttttgtttttgaaaggaaatggttttgatcctataaatgtacataattaaataaatggcatcctaaacaaacattttaattaattagctaataatagttaaggcggaatagaaaagtgtgtgcgtaaaatatcatattatcactttccttgacttttctttcagagagttccatggaaagattttgtcattcttccttttttgacatttgttactttttaggtaatgctctgaaagctgtacctcactagaataaaaccaaaactaggttatataaaaccatgagcatgatatttatcgacacctcagctgaatgcatcttacttaaccttgaagtcagtcctatgtgcttcactctcataacgggtgggggcggtgtcagagaattatttagaacaaaacttgaggagaagttcagtcctgtgtaaaatccactttaaaaaggcttttaaaaaaggatttccctgaggttggtaaatgagctcctaggaaccttttaaatgcagtcttacagttaaaataccaaggaaaagataaaaagatttattaactgtgcaagctttagttaaggtgagagtgaggtgtaacacttatggaacgtattcaagaaattttcaggaaattcaagaaccacaggtttacagcatgagttttgctttgtttgctttctgctttttaaatttaaagtcttaatttctgtgtttttgtctcatcaaagagaaatcctctaaatgaggaatttagattataataaaaagagaaaggtaatactctgcccttgagagatcagagggcatgggctctggcactagagagacccaagtttatcttccagctctgtgattctgagcatatacttgagccaaggcttctgcaagatgagggtcacaatatctacccctagaggttgttgagagcatcagataggacaacacatgagagtacctgccaccagaagattttcagtccatgtttccttcacatttcctaaagct

SEQ ID NO: 86182 - DNA, 1700 bp, Homo sapiens
ttggtttggttttagcaattaagataatttggttgttaagccttgcttgtttgcaacaatgaagatggcacttgagattctggaaaggactttctaaactcaaggacctatgtgtgattgcttttattacctttttgtttattaggttttcaagacttgacattttgttttccttcatacagttcaccttgttggtctagtctatagagaaacaagagagctaagattttctgaaatgctttaggaaatgttgtggactgcatgactcccctgtgttattgatgtcaggaaatcaagcagagtgtagatatatgtcaatcaataactttagataggaaacggagtcagtggagaagtatgaggagcttaaaaagaaccctagggctttaggaagaaaaatcaggagcttagagaataaaattgatactttgggatagaatatgaaagcccatggataaacactgtggctggtagatgctgatcagaactaaggtagacatgccagagccaggccctggattttagaagagtattgtgctaggttcttaaatgttactgtgctttttatcaccgactttagaataacagcatattctagggaataacactaaatttgtaaaattgttttcctttttgctaatggattagatggaatcttcacatctatagcacactaactggtttctataataaatacactgatcaactaaaactgttcactaaaatttttagcaaaccaaagtgattagttctcactgacattttctcatatatgtaacacataaaaaaaccctttcttatctctgaatctatagtgtatagttataaatatgccctagtattaagagtatacttaacagctttaaaacatttttttctctctgctgtcctgatatttctggatctaggtttaatagggacatgtataggcaaaatcggctagaaaatgaggccagcagggggtcttccgtgacaatcattgtctgattcctatatatagtggcatcaagtgggaaatcacttaaattatcaagtgacttgatttgtcatgagtgtaggaaaagctgctttagagcatagagaacattaaggtttaagtgaggactgcatttgctctgaagaattgaatggcagaggagttggggtgtttttatgttagtccctttaaaaatgataagtgattttgcaaggtgcaagggcaactattaaaccgaactccatccagaatctattatacaatccaggatctacactagccaggaagcgttggcagaaactgtacaaatctgggggtcactgtcgtggtgctgctgtgagttcttttgctgatggtagcttgacattcatgaaggatgcttatttagcctctgtcatgtcatctgattgtgcttgccccatagttagtgtactgtgaaaaagaggaagctttctgggagtgtcagagatgaatcccttgatctctctggcttcttgataatccactgtgatgtatgcagcctcccctgtccaatgctgtggaatccctatattattgaatggaagagagaatttgcacttgagggagcaaggagaggaggaagtttaccaagtttgattcaagcacattggttagtggaataaagcaagctgtgctgttatatagttgttggtctttcaaattgcctcagaaccagaataagacaaatgagggccagagtaga

SEQ ID NO: 86183 - DNA, 1023 bp, Homo sapiens
ggcaggtcacacgtctctttatgatgaggataaggtataatgtcccttttgggagactgctttgttcccctcagacatgggacttctactgtatactatctttctgactttgaactattataggaaagaattcatccttttaccccactttatagtatttaattttgtatgcctcaccaaagtattttctggaaacaagtggaatataaatcctaacttaaaaaaactatattaattttggagtccatagtatagagtgggctcagctatgtccattgcagctgcctctgaatctctgaatgttgttttaaggatttgggctttggttgctggaattcttactcagccatggcttatatttttgcatagtggtgcaatcatagtcctcagagaatggaggactttagattacagaaaaaaagtaggcattttgttgaaaactttgtctttttattaaatcatttctttttatttatcagtaaataaattattctttctctatgatgttattttttcatgatttgatacttccattgtttgataaattgtaaggaaatatattatgtgggaacatgtccagatggcttatatcactcattttccttcacattctgtgaagagatgtggcaaatagtttcacccccattttattggtaaaaaaggtgagacatagtgatcttcagcttcatgccaagtaaagattgggccacctgttactaatgcctctgctgccttatcttttaaaatttatatgctttacctgatttaatctctctgtggctattgggcagtggtttcaatttgctcattcctactgctgggcaaaccaaaatatcctgtggggtgtatctctttttcaggtattctaccaaatattataacttctatctgcatctgtattggccagcctcataatttctttgacttgtgttcttgagttacaggttcccagggatgaaccaattcacattctcaatgtggctatcaagactgactgtgatattgaggatgacaggctggcag

SEQ ID NO: 86184 - DNA, 1705 bp, Homo sapiens
cagctgttcaaaaagcactacttgaaaagcctcagtatggagaagctcccatctagctgtatatgatagggggtttatctgccttatgtccggccttgctagcaacatcttcttttgctaagttctctgtgtagtttggggctttcagaggagaaacccttaaggttactcctatcctggcaaattattcacagtttttacaatttttagtttctctaatttgcttctccttttagaggagtgcagatccagaaatagctgatctcatgttttatcagtttgttagttaattttctaaagtgttaaaatgttatgatagtcagtttttatttcagacctataataagattaacattggaaaagtatatttaagttttgatgtgtttaaccctgtgtggaggtttccaggctaatataacataagtgatattttagtattttgggtttctcctgtctcttgaaccaagcaaggcaacacaatgcaagtttgagaggataacaattctgattggaattgaatccacaaaatgcaaaagcaatagtaagttgatggcaaggtctttgcagataatcagctacacgtggaactatttatagatttacatttattttgtccctctccctttaaaatattaagtaatcaagactaatcatagcttttagatcccaatttggatgtggagaggaaagggaatgcttttaattggtcttgtagtcttcccttggtgagtgggcttggctcattcctgcctgcctttagccaccctggttcacaagcatagcagtgaggggaaactgaatagtcgatatttcccatggggttcagttgagtgaaaaagctacttaaccccatggttgccacaaacatagtttgttaacttcttcagagggagttccctttaaatgtggtctggaacccttttatctttcctgtctaatgccaagcaagtagaaaagatacaatgcctcacaaacttgcttttttagtaaatatatttggtgatcctagaaaagaggaggatgatagcacttctgtggtaatacaactctgaatcccagtttctagtgagcaccatgtgtaagacttgcttgatgtgtgtttcatttgtttgtttcattcattgtatcaatggtttcctctcccactttgccttctactcccaagtactgtcaaaagatgatgtaccttttccatagtcatcactcgccaaaggaataaaaacctggagtgtcagtctctatagtctgtgtgagcagcactcccatcctacaaagaattccattgccttgtaattatgatttgcgatagggtacaatatgtacccagatatcaagtccacgttgtcgtctctcttccccctgcaacaccgcaggtggtgtacttcaaggagatttttggggcagttccccaaattcaagtgccattgccttgccctgaacttgcttcagatcagtatgctggtaacatgtcaggcaagtcctggaggcatcctttagcttggtccttcctaacaggctgtcctgattgagcattcagaaacactttacagtattatttatcagtacatactgttaaggtacatcaagaaatatagagattcattgtttttagattgagcaaatcagttcagttctcttcaggcatctccgtttagcagctgcttgtcatgcttacacatactttgagacccatgctctgcccttt

SEQ ID NO: 86185 - DNA, 1115 bp, Homo sapiens
atcctgaatgtctgtattttgcacaattcattgactcatttgaccttcaggatttcactaagctttgggcatattaagtgcctcaggataatctggaaacaaattcttcagtcaactagtatttgatcttttaaaatatagttatatttatacaaacatatgtaaagtatattatcccataaattgtgcctatacatatgactctgtataatataatatgacagtctgggagtacacaatttaaaactccaaatgatttttataattaatatacgctagtgaacatgagtaatctttttaacctttactctgtgattcaaataagaagcatcacatttgatgcaggagatggaggtgtactttgttgtacgtttctgtacatatataatgggtgaggacctattggtgtttatttccacctatttcatagatggaaatccatgctttagttaagtcggattccactgtaccttctctgctgtttgctacttgtgaatttggccttctgtgttataatgttttaattcaaatacttcccttttctcaagtcttacctccagaagaggtcggctgtgttttcccctgatagcatgtgttttggtcatggctgagtttaggctgcttggcatccatcctcaatgttcagctgtcagtgggcggcctctggactttttattcataaggaaggttagaaatcaggagccttccatgtgactaattggtagccaactgccattctcaagaattctgataatctttaacacccagagattagacctttctttggatagtactgagatactcagaagtcatccaacttgtagcattgtttctgcagtgggagcacttgttgtagttagcaagccagaatgagctataaataaatgaaatcttacagtgcttgcttccttcattcagggtagtctgctgataagatgcaagtatctggcagaagagaagattctcagcaggtttaagtgcttaccaaagtgctttcctgtatccgtggctcagcttctagtctctgctgtgttattttggcactctagacttgtaagattggagagttgagtttaaaactctcaatatatcattagggtagcccaaggtccctt

SEQ ID NO: 86186 - DNA, 1050 bp, Homo sapiens
ccctggccacttgcacttctgaccaactggctacaaatttgagggtcccctcaattttctcagtttgataattccctcagaacaactcacagagttcaagcactacagttttattgtcaggatcagccaaaagcacgagacgcttagggtgaagtgtgggatggtctcaaacacagagcttcccagtttgttccctgtggaatcagagtttatcaaccctctcagcacatccatgtgttcaccaaccaagaagctccattgaccttcagtgtccagagtattttaaaatcagggcttcattacgtaggcatgcttgattaaatcatagcctacgtgattaaactcaatctcccctcccagaggtctggctggctgaaagccctcaaccttctaatcacacagttggtctttctagtgaccagctcccctcctgagtcatctcatctcttagcataaactcaggtgtgatccaagggacttaaaataacaatgacactcctattacttgggaaattataaggatttagtctctcttccaggaaccagagacaatggccaaagtctttattatacaataggcctgctcatcttaaacagaaatctaagctcttttagatttagctagttttgagccaagtacttttcttctttttctaactccagtactttttttgtatgttattgttttgatcaagcaggcgaaaagcatattgtttctcattctacagaaagaagttacagagggctaccaatatttgttccactctgtcctgtaaggctcagttatgtccactaacctctagattaatgattctcaaaattatctgaggggtaatttgaaaatacacatattggagtcctgactttcaagacccgattcattttggattagagtccaggtgaccactttgaaaagctcctctgaactctgatgaacagctataattgacagttactacttctaaaccagtactgtcaaatagaaatataatacaagctacatgctatttaaaattttctattggccacatttaaaagtaaaaagaaaca

SEQ ID NO: 86187 - DNA, 1092 bp, Homo sapiens
aatctcaagctctgggggagaccttaaagatcatcaagtttaatgatatttacatttctttttaaacagaaatttctcgtctaaagaaatcatgagagagtttagagtaagactggggtttgagttattcccaatctttcagtctttaaggtacacccacctccccaatttttaaaaaatttaatgaaattgaggcccagagaggtaaaatgattttcccaggagcacacagtaaattgctaatagaactaggccttgaacccagatcttatatccaaattgcctgactcctagtccagtgttccttttactaaatcacattgccagtttctgtacaaatccatccaagaaaatccttatgatgtttcttctcactgctcgtctcataaattatagacagtacaaaacaaatagcatgtaaatgtgaacatttatacatgggtgagaaccagttcttttcatggtgtgcaggtcactatgacaaatgtgtattcgccctccgagaagagaataaaagtgacatgaacactgtactgaactacatcttctctcacgctcaagtcaccaagaagaatcttctggtcacaatgcttattgtgagtaccatttttcagaacttgtaaagaccgtcaatgatatgcaaaaagtatttttttccttttgatggctatggccagagaaaaaaaactactgccttttataattatgggatgaatggggcttgagctgtggattaacagtttctcacgtctacctttgtccttggtctgaaggaacctgctttagtgagaaaatgactcttctggccattatgcatatactcattcacaggaacttatacctcctaactctgtttagaaatgcctcgtgcttcaccattcctgtggtcatcatgacagcagctttaaaatttcatcttatttagccaatatattctaattttaactcttgttccatagatacaagcaatggctctcatgtcaaacttgaaaaaaaataaatagaaatccagcactccccctctctgaccagagaaatttaaatgtattctgcatcttcattggtccctttttatttacattgaaaatctaa

SEQ ID NO: 86188 - DNA, 1050 bp, Homo sapiens
taaatgataaattgtctcttaagtgtgaaataaccttggctaaaattttaaagctgtttactgctgacattgcttcctgccacaagatggcagtgaaacatcacagaatttgaaacattatctgaaatttgaaacattttcctttatctgctccttttcacttcctttaaaagcagcctatgccactcatgaccagcaaaaatcctcatgtagatatcagcaaaccgcatccaataacatacaaaataatacataacaaccaagttggctttatcccacgcattcaaggttgatcagtttggagaaagtcaattaatataatttatcatgaaatagatgaaaggaggaaaaacatgctcattatctcaagataacagggtgtggagagggagcatttgacagaatttaacatccattcatgacaaactcttggaaactaggagtgaaatggaacttttaaaatcttgtaaaagggacccacaaaaaaatctgcaggatacatcatgcattatggtaaaacgttgaaaacattatctttaagattaggaataagacaaggatgcctgctgtcactacttctattcagctttatagtggatgtcctagccagtgcagtaagacaaggaaaagaattaaagggtataagagctagaaagtaataaagcaatatatctgccattattaaatatgatagggtgtctctttagaaagcctcaaaggattcacagattgattattaaattatttaaaatctaacatgattgctaaatacaaaagtcaacatacaaaattcaacagtatttgtttacagtagagcaattgtttagaaaagcagttcaggaaaaaaaaaattaaaatagcaggctagatgtagtggctcatgcttgtcatcttagcactttgggaggccaggacaggaggattgcttgaggccaggagtttgagaccagccttggcaatatagtgagaccccatctctacaaaaaattaaaaacaattagccaggcatgatggcacatgcctatagtcctacctactcaagaggctgaa

SEQ ID NO: 86189 - DNA, 2482 bp, Homo sapiens
ttggtattgaactcatgggctcaagctatcctccctccttggcctcccaaagtgctgaggttacaggtgtgagccaccacacatggcctattggtagttttattttcagagacattcttactaccttggcagcatctttactctttacccataaagcagatgtatgtgtagggaatataggtagataagtggggagtgatgtttggatcttgaccttgaacagatattggtaagatgatagtttttgtaatgtagtcattaattcatctgggaaagggtgacaagggatgaaatctgcttgcttatgtagcgtgattctctatatagactacgcctggtaacttccagctgctgccaacatgtgagataggaactgccatgttataagaagaagattcctactggtcgtgctatagaggctgatgctttggggcattttgttgggttgggcctcatttttttcccttttttataccttagattgcaaacatcctagatagccatgcagctacattgaaccggaaatctgaacgggaagtcttctttatgaatactcagagcattgttcagctggtacagaggtagtaacttgtaactccagattcccagacctgtccatactcatgtcttcctttctttcaagtggtcacaaaaaaatttacctcagatttgacttcaagaaattggaaagcatcttatatcttagaaagtaccttgtcttttctaaatatcttagaattgtgagctaactctcatgctcaatatttctgacttcttaatattctacatttttttctgtcaattatttattattattattattttttgagacaggatctcactctgttgccccgactggagtgcagtggctcaatcatggctcattgcagcctcaacctcctgaggctcaggtgatcctcctgtttcaacccctctgaatagctgggactatagctgtgcaccaccacatccagctaatttttgtatttttagaagagctggggttttgccatgttgcccaggctcatctcaaactcttgggctcaaatgacccacccgcctcggcctcccaaactgttgggattacaggcatgagccactgcgtccagcctgtcaattaataaggcacagaaattttgttgttttctttttccttgccattttgatgaagctcctaatttttcttctgtcacagggcccagtatgacattttttcttcttagcttatggagcctattatattaggttggtgcaaaagtaattgtggttgttgctattaatactaaagggatattcacagagcatatttatttatttatttatttatttattttttttggagacagggtctcacactgtcatccaggttgtagtacagtagcacaatctcagctcactgcaacctctgcctcccaggctcaagcaatcctcccacctcagcctcttgagtagctgggactacagtcacatgctaccatgcttggctaatttttttgtattttttgtagataagaggttttgccatattgcctaggctggtctggagctcctagactcaagtgatcctcctgccttggcctcccaaagttctgggattgcagatgtgagctaaggcaaccggcctcacagaacacttttaactttaagatacttataaatttttcagatatctcagccatttcaagagtatggtaataatttctacttagcagtaggaactgaatcaaggtgttggtaggtggggctatgcaggattttgttgtcttctttattaaaaaaggtcttgtctatagtgagatttcttttaggcttagaatttaagttaattttgtagttcattttaggctgttctttattcagagggaaagcagttcagtggaatgtcgtggaggtaaatttggcctttgggtttattgcttaatagtgttggattgtcaggtttttcagtggagactttctatttgcctaggtaccgaagtggcatccgaggccacatgaaggctgtggtgatggatctgctccggcagtacctgcgagtagagacacaattccagaatggtaagcctcttcctgaggactctctagctaagaaagccttgattctgataaccaacccaaactatccctataggactgtgtaagagctaagccccctcctgtcaacaacacttcccattaataaacagtctcctatcactactcccttaaaaactaaacctctatatccactagctctaaagaaagaacaacgaaacacagcttgatgaaattaggaatccagtgtgcttctgagaaagggctgaagtaatttttctaatagagattaccattcctgttgatatctttttgaccttgtgtagtgtaagttggttgagtcatcacaggctgaaattgagaaacccatatctgaagagcttgattcttggcagctaatccatgaattgaaccagaggcatctaggaagagcaagttcaggttttcc

SEQ ID NO: 86190 - DNA, 1043 bp, Homo sapiens
actggagaataggggcaatgttagatgcttacgttgcaatttcaaagtactctatgatagttggctcacgcctgtaatctcaccactttgggaagctgagatggaaagatcgcttgaggccaggagtttgagaccagcctgatcaacatagcaagaccccatatctattgaaaattatataaatttttattgaaaagaagtagtatatgatagtgaattcagatatagttgactcttgaacaatacaggtttgaactgtgtgggtccacttatatgtggattttttcagccaaacatggatcaaaattacagtattgatgagatatggaacccacaactatttctatacatgggttccgtagggctcaagtatgtgcagattttcatatatgagtggtggttctggaaccaatttcccacgtatacagaatgacaactatatatctttttatttgggggattgtgttaacttgggtcctattttaccaatgctttctttctaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcaggtatttataggataacactatatttttttctggctaccaatgccagagtttatgttgtaggattccttcctatttggatcctccttactttttggatgttgtgcttgtatacttttaagcattgtattcctcacaaaactgcctcagggtacaaacccaacagtgaaagtactgtatgtgaaggataagtatctgtagttatgagaaaagcacacttggatcatgtataccttatagctttgttcctggggctattccctaattagaggtattttcatgaattgaaaatagagtgatattagttgattgattgattcattcattcactcattgatttagagatggagtcta

SEQ ID NO: 86191 - DNA, 1915 bp, Homo sapiens
tgtaatcctaccactttgggaggctgaggcaggaagatcgcttgagcccaggagttcgagactagcctgggcaagatggtgagaccccatctctatgaaaaattaaaaaattagcggcgtacagtggcacatgcctgtagacccagccactctggtgtctaaggcgggaggatcccttgagcccaggaattcaaggcagcagtgaatggagattgtaccactgtactggagtggtacaatttgtggcctgcgtcacaaatcaagaccctatttctaaaaaattaaaaaaaaaggtaacagattggaaataagaatgaaaaagaaacatcagttggcttaattagaagtgcgaaccttaagatttttaaaacacataggcaaatgaggaatctctagttctaaaaatagatactaggcaatagcacttgttgaatgttaggtgtcctaactgctggctatccagagaaaatacatggaggtggggcacaaaacagacaagaaatgtcatgtgattaattttaagagagctaagcatagagtgcagagggtcacctaacccaaatcaagctaagcttgtatgggaagatattctgaaagaagagacatttgatcttagttttgaaagacagatagtgatagagcaggtgaagaagggcagggaagagtgcttaaagttgaaggaatagcatgtacaaagacagaagcaagacagcacagtgtatttagggaactgcaagtatgtgttggtgtggcttgagaatagactaaggtttaatggggagggacaagcaaaggtgctaaagaagtaatgtgagatcttgaatgtgaggttatgaaggatcttataaaccatactagtaagttttcactatcctggaggcagcaggtaatctctgaaagatttaagtggaaaagtagtatgatgagatttggggtctaggaagattgcttttcgtgaccttgagggaggtatgtagcaagtagggagatctcttagggggtctttgaagtactttgggccagaaatgaagaaggcgtaaaccgaagagatggcaagagaggaagatttttgagaaaggtttagaagatatgtctggctgggttggtaattggtaggtaagggagaaagaggagtgaagaatgatccttaggttttggcctggttgtcttagattggattcactggtatgaggatattaaattgttccttactttctaagtacaaaacaaatataatcacaaattatgccaaaatggttgtaaaagttagaaaggagaaatgtcaataactgttattaattcctaaagtgaggtactgagagattttctaattgcttgccttgatagtccctaggagatgatggtaaattcccattttttcttggtcaaattaggtgtggtccaacttagatgctaagggaaaaattttagttcttttaagcactcatctgtgtaaagagagataaatctgagtctagtttatttttcactataggtaatgaagatggtaatgaccttaacagctgtggagtctggctgtatccattacgtcaagcgacctggagcagctcttgaccctggctgtgtactagccaaaatgcaactggacaaccccagcaaggttcagcaggtgagtaggaaggtgctccgaatattgctctctaagagctaaagaacttggtggtttggagaggcaagtgatttcaatgcttggtttgccagtgttttctttagctttgtcccctattaatcttatgccttgtatttgtgcctgtagtattatggaactagagtttgcaagagttactgtagtactaagattctgtaatttccttatgatgtttcctctattgacttccctcctggtagctgggtatgatgtctcgattttgaatgataactcttaagtgcagtg

SEQ ID NO: 86192 - DNA, 1053 bp, Homo sapiens
agaccgaggctggcagatcacttaaggtcaggagtttgagaccaacttcgccaacatggtaaaaccccgtctctgctaaaaatacaaaaattagccaggtgtggtggcaactgcctgtaatcccagctactcgggaagctgaggcaggagaatcactggaacccaggaggctgaggttgcagtgagccaagatcacgccattgcactccagcctgggcaacaagagcaaaactccgtctcaaaaaaacaaaaaacaaacaaacaaacaaaaaacagctagttttgtgtgactgcttcttttcgacgggacataaactttgtagttaacacagctcctattcagtctgcctcactcatttatgttcccagactggcctctgttggcatttaggtttaagtcctgatttggcagaccactgtgtattttcttcagggaatgtcctataacccaatccagaagccttgttccttatttctgaccagctctgtacatttgtctacagtacaaagctaactagcttaatttttagcatgttaaaaatacgttatctacaataagtctccttcttgacactatgccaaaagttcattcttcagcttagagctttctttgtttcttatttcttcatttcattaggtctatatctcagcttggggtttggactcttgtttgccagaatgccccaactcatatattccagtatattccagtataatttcccatgggtcataatctaaataccatgagaacaggactgtgtcttgttgctgctatatcccctgaacatagtaagcattcagtaaacgttggttgaatggattagccactcattcctatccttatacctctgcttcaatcataccattccctgaactcaagctgtattttccttttttttttttgagacagagtcttgctctgtcgcccaagctggagtgcagtggcacgatctcagctcactgcaacctcttcctcctgggttcaagtgattctcctgcctcagcttcctgagtaactgggattacaggcacgtgccaccatgcctggctaat

SEQ ID NO: 86193 - DNA, 2476 bp, Homo sapiens
tctaactagttagctatgtttctagaaagaagaggagcatattggaaatactggaaactggacaagagtctgtccccatgtttttttgtctgcatgcatttatgtctggtggggtgaggttgcttttgatgcaaagtgaaaaatgctcttttctcccgatttttcattgagtttttcatccttgtccagggatattgtataataatcagaaatgtgctctcatgtggctaaaagcttttgatggctcttatacacactgaacagttgagtcagtgagaggctgtagtggtctagcagttggataaggtgagatacttatgtttgcttatctctcttctttgagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccaggtgagtctccctgatctgggttgcagagcctagaaaagtcagagaggcctgaaaaatgggtttaaccagtgtgtgataagagaaaagcacctcctatctgagtcacacctaatggtcatttctctttcaccctgtatgtgttatgcatgtgtggtttggttttcctgatgtagtacagacataggaatgttattttttctagccagacacatctgatataatgtgtcatgttttagaaataaatgttaataatgtatgctttattcaattatttagctatagtaaacttcacaactttgtattataattattccctactcatttttgtttttttactagtgttctttattgaaataattctgcatcagagattagtggttgaagtttttccttacaagagtgtggtagcacacatatatttttataatttgtaaagtgcttgctgtcaatattattgtcttctctcagcccaggaaacaaatattatggaaagcagtaatagttaatgataaggcttgatattatttttatctaacatttgcccacatcgagaacaccttctgggttcctattaaagactaaagatttacttacttcctccagtggtttgcagggatggaagagataattatgacacaattaagactttctagctgtctgtttttggatggctattaacatttactcctctgttggatattttcattcttattacgtgatggagaaatgacaacaggggaactggtgtctgttgcattaggaatgtggggacttctttagaagtggagaatattctaactacttatctgtagtgatatattgtatttcaagcaacttagagttgatgattgtagaatacaggttataaaaatagaatgttttagggagtggctccaaaaataaaaatattttaggttatctgatagcctctacactttaagggaagtaactgaaaaattaaagatgtgtgttttattacctttcagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgaggtaacccatcacttaaaaggtttatacctccttttaatgaactttaatgttaagatagtatctgaaagtatacttctgaaatatcttgggacttcctctggagtgggaaacatagaggtttctcagagcagataagtaaatggttgttgcttcattggttacttaatcccacttaagtcactgtagagtcttcagtgggtctgtggcactgggtcttggcctttatcatttttgtgtgtcttctctgcttctgtgtgtgattaacagagaacttaaacaatgaatatataaatcttctcttccttcgaaacataatatggtctctcattctttattctctaacagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcgtgagtataatagcatttgattgcattttacaaaataaatttgtgctaatcttaagtgaaggtgtgagcatgggaataggaatcatctgctgtcaaagtaataatatgaacaacctttttgaagaaattttgaatatctttaattacacttgcattcatgttgtattaaattatgcagtgcttggcagatgtttttctgtttgttgttctgagccttttgaagtatttttcctttcaaatatttttgataaatgtataaaattgattgctttaaaggtatcttatttttccacaggaacagtatt

SEQ ID NO: 86194 - DNA, 1088 bp, Homo sapiens
gaggtctatttcctatgttgtgtatatattaggatgtactcttgaactgctgtaataaagatgccttcaaaatacagtggcttggccgggcatggtggctcttgcctgtaatcctagcactttgggaggctaaggcggacagatcacttgagccctggaattcgagaccggcctgggcaatatggtgaaaccctatctctactaaaaatacaaaaattagctgagtgtcatggcacacgtctgtactctcagctgcttgggaggctgaggtgggaggatcacttgacactgggaggtcaaagctgcagtgagccttgatcatgctactgcactccaacctgggtgacagagcaagaccccatctcaaaacaaataaataaataagcaaaatacggtggcttaaacaaggtgtaagtttctatttctctttcatcatagttcagagatgagctgttaccagaaacaggtttattgctcacctgttgcctgtttttgtaaataaaattttgttggaacacaatgatgcttatttatttatgtgttatttatggctgctttatcactacaatggtagaattgaatagttgtgacagaggctatatggcccacaaaattgaaaataattactatctggctctttaccaaaaaagtttgccaaactttgctcttggacattgtcatcttcatgattaagctaactcacacaagattatgttcacattgtggcctgtgggaggaagagacaggggatgtggagggcaagcatatggaagcatgatcttgaagtcacatacatcacttctgctcacattccactggacaaaattcagttacacaattatacctagcacaaaggatgttaggaattgtgatcactaactgggtgaccatgtgctcagcaaaaatttcgattttattcctaaaatgatgaagtagagaaaagtcactggagggcatttcataatctgtgcctcagtctgttcctctggctacctattatccctttatcctttttcctactttcagagcacacatagcctttgtccaaggaagacaacctgaagccccatccagttactagtaactgg

SEQ ID NO: 86195 - DNA, 1001 bp, Homo sapiens
actctgctgaggccaataaaaccgccatttctatttccaagggctcataaagattgaattatttcccagacctcttggccctggagcaggcctgaacacacagtttgaaggtattttgcctgctgagttgctgtgagaagtatgctatgttctttttttgtttgttttgatcttgtacgtctttgcatttttataagttgctccctgttagttcggctggcttttgccagcgttaagaacccaagttgccgggtcatgctgtggctaaatcctgttaaccccaaggactgatcagggttttatggcatccttctttctcccatccactctcagttttgggtaaatatgatagcatttcaaagaatgcagagcagaaaattgacaagagcagaagatcttgtaattgccctaagttgctattgtctgttgcaggtcttcgtgtggactggcaggaaaatgatttttcaaaacgtatcttaaatgttccccaggagctatatgaaaaaggttatgtgaaagatgtggatgatgggctacaggtaggttactaactccagggagtgatacctttcagctgaccagttatagtcacaaatgtggagattgggagcctggctcgtgatatatacccaaggtggtgttagggatgtaagaccaggaggtgtagtttgaaagtatagaatacgctggtttctctttagattgcataagtcttttgcctttaaaaagtacagattgaggaagtgactttaaatgtaaacaatctaaattcattttgaagcaggctgctcatctggacagaacatttcttaggtgattaagtcagagttttaaggaggtgctgattctctctctctctaccacctgttagtgtgtgagggcggggacaacaaacaacatactttttctactggttgaattcagaaccaagaagccaggaagcagagatcaaacagtcagctttattatgaacagagatgttgatgaaaatggcttaagtg

SEQ ID NO: 86196 - DNA, 1050 bp, Homo sapiens
gtaatatatgtgtctcagtaagtagtctttctaggcaggatttttcttccctgcttaagggggttagacctccaaaatatttgtcagggtctcttttccttttaagggtttaacccacaatcttttctgtatccgttttgtaccagctccattcctattctcaagctttggtgcataaaaccttagtttaggtgtctatatataccactactttggcctgaaaattagaatcgtggctcacacttgattctaagttccctagtagtggcgtgtttcctttctacgtgcttactttcccacctgacctgcttttccccaccgtgcagtctgataattggtattatttgttttgattggatctcagaaattacctctttagaccgagctgtgctcctccctctggatttcatgagcccattattttcttggcttaattgtccttgtaaatttggtctttttgtcctgggctttccctgtcatgtgctcctggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaaggtaagtgttaggctaccacatttgggtaatatatatatctttaaaaaaacagtaaggtactgacagctaagccc

SEQ ID NO: 86197 - DNA, 1044 bp, Homo sapiens
actccatctcaaaaacagaaaaaaagaaaagaaagtgcaggaaattttattcctgcttcctatctattggttcatcactatcaagctttgacatgggaaataaggaaattggctctggttttgtttatattaaggctttgcttatggatagtttgagagtgttcttatgtattgactttcttagcatttttcatttagctttcctgagcttcttcccttcccctaatagctctccaaactttctactttcagtgctccttccttgatattctgaggttcccagttgccatggtgcctttgtagtgagtagacagagaaggtcattatgagatctgcaacttggtactcctttgctgagggaactagtttcctctttccatctcccatcctccccttctttccattcagaaaacaggagctgtctgtggccatatatgtattttagtctctggagtgcattctataaacttagctaattgtggaaatgaaattatgaatgttgtaagtaaggctcggtacagctgcttgacagtgtttattacttttattatttcaagtgtaatgcatgcatttccccctcttttctttctgttagcataaatttacaaatgaagtttgcatttactactttatattgttaaattattagaagtaatgtaggtttattattagaaaagtaggaaatccaagaagtttttttttccagatagagtcttgctgtgtcgcccaggctggagtacagtggcatgatcttggctcactgcctccgcctcccgggttcaagcgattctcgtgcctcagcctactaagtagctgagattacaggtgcccgccactattcccagctaatttttgtatttttagtagagacggggtttcgccctgttgcctaggcagggccgcctgccttggcctcccaaagtgctgggattacaggcgtcagccaccgcgcccagcctcaaaaagtatttaaaaaaatagaaacactgaggaatacaatcattccatagtaatcactattcatattttatatatttcctttct

SEQ ID NO: 86198 - DNA, 2021 bp, Homo sapiens
ccagttccaactcactcctcagctagctaatgttctaaaatagaaaaaacgttttctgtttatccattccttaagtcacttctggatatggtgacctttggggtaattttaattgagtcaaattcatttgataggtgaaagacctctgttatgacatctgccactaattaggtgtgtgaccatggacagtacatattatctccttggagtcatctataaaaatgaagatattgattcagatgctccttttcactcctggaactcaaagttaaatagagactaagttgagtttaggatcagctcttagaacgaatagcctaatccttcatgggtgacatagattaagggggcaggtacattcctaggagatgttaactggaggtcatctgaaaccaaatgaagtaattgccataatgtaagatgggactgagtctctctctcaagtttaggtgctgagaagtctagtggtatgatggatgagcccaaatagaaaatagacttttcctgcgatggagatgatttgccccatgtattttctagagtccaatgaaagactgggtgaatcactttcttttttctttctttcttttttttttttagagggagactcgctctgtcgcccaggctggagtgcagtggtaccatctcggctcactgcaaccttcacttcccaggttcaagcaattctcctgcctcagcctcccaagtagctgagattacaggcacccgctaccatgcccggctgttttgtatttttagtagagacagggtttcaccgtgttggccagactggtctcgaactcctgacctcaggtgatctgcccgcctcagcctcccaaattgctgggattacaggcgtgagccagcatgcccagccttttttttttttcttttgagacggagtttcgctcttgttacccaggctggagtgtaatggtgcaatctccacttaccgcaacctctgcctcccgggttcaagagattctcctgcctcagcctcctgagtagctgggattacaggcatacgccaccacgccaggctgattttgtgtttttagtagagacagggtttctccatgttaggctagactcgaactcccaacctcaggtgatccacctgccttggcctcccaaagtgctgagattacaggcatgagcctgtaatctgtgcctgtcagcctatgcctgaccctggccatttttttttttttttttttttgagacagtcttgctctttcacccaggctgaattacagtggtgcaatctcagcccactgcaacctccgcctcccaggttcaagatattcttgtgcctcagcctcctgagcagctagtactggaggtgtgtgccaccatgcccggctaatttttttgtattttagtagagatggggtttcaccatattggccaggctggtcttgaactcctgatctcaggcaatccgcctgcctcagccttccaaagtgctaggattacaggtgtgagccaccatgcccagctggatgaatcactttctaagctttatgacccaaacatttgaaaataagaccctggctgggcgtggtggctcacgcctgcaatcccagcactttaggaagccaaggtgggtggatcacctgaagtcagcagttcaagaccagcctgaccaacatggagaaaccccatctctactaaaaatacaaaattagccgagcacgatggcacatgcctgtagttccagccagtcgagaggctgaggcaggagaagtgcttgaatccgggggtgcagaggttgcggtgagccgagatcatgccattgcactcccgcctgggcaacagagcaaaaaaaaaaaaaaaaaaaaaaaaaaagaaagaaaagaaaataagaccctaagtaaaaagtagttatagcttggtgggaatatacagacctcattgtagacaactgatttggctttttatttttagatatgatcagctagaggttgatatatcagccaggttgatatatttctggaactcactagtattcaattgaacat

SEQ ID NO: 86199 - DNA, 1045 bp, Homo sapiens
tagcttttgtcaggggtggggaatggggtattgtgattggcagccccaccagtatcacatgaaatgtgggagggtcagtttcccaaataaagatggcagctaaggagagaaatgatgctgagtagagaaagccaacagttgtttattagaaatatgtagcatttgcccctgccaccctcagtgccccatagacccagatccttcctcataaaaaagaaaaatatgtagcatttatagaggaccaggtaccatgctacattacttatatggattatgatatttgattataacatttaattctcacaactttggaaggtaggcactgttatacccactacagaggaagaaacaggttttcagaggtggaataatttttcaacattacaaagctaagatgtggcagagctgagtatgttgcatatcttctctttatcttgtccctttgaatgattttctgatccatgtgccacttttgtttgttcctagggagtcatcaagctttggtgtatgtgttggccggttctgaagtcttgaagaagctctgctgaggaagaccaaagcagcactcgttgccaattagggaatggaccgtttgggtccctttagcagtaagtacagtgggaacaagtctcaggtgacttattattattttttttttgagatggactctccctctgttgcccaggctggggtacagtggcatgatgttggctcactgcaacttctgcctcccggctttaaacggttctcctgcctcagccgcctgagtagctaggactacaggcgcgcaccaccacacacagctaattttttttatttttatttttagtagagatagggttttaccatgttggccagactggtcttgaactcccgacctcaggtgatccacccacctcggcctcccaaagtgctgggattacaggtgtgagccaccactcccggccttcaggtgactattaatagcaaactagagtggaagttgatcaaggaagaaaaataaacgatgaagttaggcaataaagccctttgactctgattctaa

SEQ ID NO: 86200 - DNA, 1058 bp, Homo sapiens
gcaccaccacgcctggctaattttgtatttttagtagagacagggtttctccatgttgatcaggctggtctctaactcccaacctcaggtgatccacctacctcccaaagtgctgggattacaggtgtgagccactgcgcctggcctcagtcatctttctttaagtggaaaagaaaggactttttagtcattatttctgtgttttagactagcaagatatggaacaccagattacaccaatctaggcttatatttatgtcatttttctgctgatatctttttgatatcaatttggaaatatgagagtatattatatggatgtgacttaaaatatgaaaagagcaaatgatgcttttagtattatgtgtaaatacaagtaccacttctctctttttcccacaatcctctaggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactgtaagtgcctccctatcttgataagatatacttagctcatccttgggccctgtttcagtagcagataaagagtgatttgatgacttggacagctaatgatatcacggaagataggaggagttagtatggcagctattgagagtcaggatcgacccagcatggtggcttgtgcctgtaatcccagcaccttgggaggctgaggcgggtaaatcacttgaggccaggagttcaagaccagcctggccaacatggcgaaaccctgtctcaactaaaagtataaagattagctggacgtggtggcagacacctgtaatcccagctactggggaggccaaggcaggagaatcacttgaaccgggtaggcggagattgcagtgagccaagatcacatcactgcactccaacctgggtgacagagtgagacttcatctcttaaaaaaaaaaaaaaaaagagtcaggattataatgtggcaaagaaggaacatactct

SEQ ID NO: 86201 - DNA, 1369 bp, Homo sapiens
aaagtcatgatttcctttcattttaggaaagcagaaatcagaagaaatttccccatatttacttaaaggattgcctgagtcttggtttttctttttaaaaaacctgttttcataatactttatctttttcacatttccttttataaaaaccattttaaattttatttattcttggactattatgtcatttttttcatgccaatattgtattagttaactcagaaaccttctaaattcttccagctacagatgaccctccccgacctacctttgactccttgctttctcgggacatggccgggtacatgccagctcgagcagatttcattgaggtaggataaatgtgtttttagcacaaagtaggaaaaattcatttttgtttctcatgagccttctgtctcacccatagattccataccactaaaaggagatttttcaaggcactataatttgtaggacctttaggcagccacattttcttaggtttgagtgccttttctcatttgtaaacattttcacatatggaacagtaaaaattctttaaacaaacaacctatttctggccaggctcagtggcttacacctgtaatcccagcactttgggagctgagaatggaggatcgcttgagtccaggtgttcgagactagcctgggcaacgtagtgagaccctgtctctacaaaaaataaaaaattagctgggtgtggtggtgcatgcctgtagtcccaactacttggcaggctgatatgggaggatcacttgagcctgggaggttaaggctgtagcgagtggtgatcattccactaaactgcaccctagacaacagagtaagaccctgtctccaaaaaacaaaaaaaccccagcaaacccacctcttaagttgcatcagtgctggcttccacttccttaggtatgaaattcctatagtctggttctttttttttttttttgagacagagtttttgctcttgttgcccaggctggagtgcaatggcatggtcttggcccattgcaacctccacttcctgggttcaagcgattctcctgtctcagcctcccaagtagctgagactacaggttcctgccaccatgcctggctaatttttgtatttttagtagagatagggtttcaccatgttggccaggctggtctcaaactcctgacctcaggcaatccaccagcctcggcctcccaaagtgctaggattacaggcgtgagccactgcacctggcttgtagtctggttcttattgtacatctaggggctttcaagattgtactgtatcaggggttgacaaacttattctattaaaggccagatagtaaatattttaggtttagtatgctataaagtttctattgtaactata

SEQ ID NO: 86202 - DNA, 1395 bp, Homo sapiens
atgaattgactttatttatttatttcagagacaggctcttgctctgtttcccaggcagtcttgaactcctggtctcaagtgatttttccacctaaatctcctgagtagctgggattataggtgcatgctactgtgcccagctcagactaattttagtttttagagcagtatgtttagcttcattcctaaactcataactattccaattttttgttgtcactactgcttgtaagcctcttagatttttcccatgacttcctattacctgtgccagtattgtggccttttgccatatttagactttttaaacaactgtttgcttgtgttttttctgtttacttctaaagcatggctgctgtaaagacactaatcaaagccgatgggtttggggtggggatttttttgttcccctaaacaggaatttgacaattatgcagaatgggacttgagagacattgattttgttgaagatgactcggacattttacatggtaacagtttattttgtcaaatgtttatcgagcgccaactgtgtgatgacactgtcttgggtgctaggaattgaaggatgaatagaacatgtcccctgcccttatagaattcagaaatctagtggttaagttgctgaacttactgtgttgttggattttgaccacagtgaataagacttgtgatgagggtaaaaatattgattatataatagtagtaggaaatatctgttggactgtgtgattttacttttatctgaggtaaatctacactaaggtaattggttaaatggccctcacttgcattcttagaaggaagggaatcagtttgaattcttgggacttcactagcaactgctatcactaaatgttcactatattttgttacccggaatttcccctagcaaggaaaaagaatggaaattcctcaagagtttttaggcccaaatggggaatttcttgtttctcaggactgttgaattttcaacactgctggattcttttttatgtttgtttttgagacggagtctcactctgttacacaggctggagtgcagtggcgcgatcttggctcactgcaacctctgtctcccaggttcaagggattctcctgcctcagcctcccaagtagctgggattacaggtgtttgccaccatgcccagctaatttttgtttttttattagagatggggtttcgccatgttggccaggctggtctgcaactcctaacctcaagtgatctgcccgcctcagcttcccaaagtgctgggattacaggcgtgaaccaccacgcctgccccagcattgctgaattctaatctttgattagccctctaagggtttatgttaactcttttcctaaaacttatgtggtgaatgccaaagagctgttaagagtagatagtt

SEQ ID NO: 86203 - DNA, 4219 bp, Homo sapiens
gtaagatgtttagatgagtgcttttattttttattttttttgtgacagactctcaccttgttagccaggcgggagcgcagtagcgtgatcttggctcactgcaacttctgcctcccaggctcaagcgattctcgtgcctcagcctctggcatagctgggattagcgccaccatgcccagctaatttttatatttttagtagagagagggttttgccatgtttgcaaggctggtctcaaactcttggcctcaactgatctgcccacctctgcctcccaaagtgctgggattacaggggttagccaccgcgtccggccctaaatgaatgcttttaaaaagatgataacacttcagatttgggtatggttggctcacacctgtaatcctaacactttgggaggccaaagtgggaggatttcttgagcccaggaattcaaggtcagcctagacaacaaagtgagaccccccacctctaaaaaataaaaaagatgataacagtttaaagaagcttgtcagcactacagaccaaaggaatgacttgctcatgccacagagaggtattttgtttacagctctgagtctttacagcagctcctgtggcagcatgaccatgtccaggagcatattgtccctgagctgtcactcgcagaacactcagtgaagtgcactaggagcccatggaaagtcaggaaggaatgaaaaggggctttataagcacacctggaacagttagaggggcacagattttgtagaaatcaggacactgattcagcctctggcttgcttctgagtcatggtataatcatgagtaagtgcttggaatcttgcttgctgtttctttatgtcctctgccattaaagaagaggtgacactgattagtcagagtgtaaatgtctctaatgaaacatggtacataattcagatttgtgttgttaccattccattataccattatgctcttaatattactgagcattaacaacattatttttatggttcctcatttagaactactggaaggttgcagactgtttggctgggttttgtatttagaacctatccagaatattggctgatgccaccaagaccttttcctcacccacacaaagatttttgccttgaatcatggaatttgtttaataaatttggtttgcatggttcattatagagacctgggacacaatggagggataattgtattgcagccataccagaaggctttcagaatgtatttcaaatgtatactgcaagtgaagcagtatccaaggaaaaataaggaagttccgtgatccctaattggtacttactcatattttatggaaataagcagaaatgtttggttcagaaagagagagagagaagactcatatcttagaactgtcttgtctcatgtatgttgtgagatctcaatgcacatgcttagtgtagttccttcttgctgccatctctttccccatctcctttcatttgtaaaaattcttcctaaatttttagagtactctttccctgagtttctcaggatcctaaagtcctggttgtaatgtcttccaagtcattgttgccccataacccaggcaagcaagagatatgatgagctcctcctatgtgttgggtctgtgtttccagtacttctcagggttgcaccttagtacagttcacaatttcttctccctctgttctggaaaggtaattttagaaagttttctctcctaggcttggatctgtggaccccttcacctttcactgtatttttcaaattgtatttctttggcacatattattagcctttaaatcctttaacaattagtagagcagaggtccagcctggtctctgtatattcacctactggcagttcctttcacttatagtgatttcactgttttttttttttattttttttgagacggagtctcgctctatcgcctaggctggagtgcagtggcgcgatcttggctcgctgcaagctccgcctcctgggttcacgccattctcctgcctcagcctcccgagtagctgggactacaggcacccgccaccatgcctggctaattttttgtattttttagtagagacggggtttcaccatgttagccaggatagtctcgatctcctgacctcatggtccacccgcctcagcctcccaaagtgctgggattacaggcgtgagccaccgtgcccggcctgatttcactgttttatacataggatattttagacatgaatactatcagtaataattgctaatacatatagcatttactattagttaccattctaagctcttcatatatattaagtcatttaatcctcaaaaccttatgagttgcatattattattatcctcatttttgtggatgaggacattgaagcatagaaaggttagataacttgcctgagatcatacagccagcaagaggtagagtcatccccaagtctgtgttcttaatactgtacaatacttagctgtctttacaatcttgattttttttttttttttttgagacagggtcacgccctgttgcccatgctggagtgcagtggcacaatcatggctcactgcagcctcaacctcctgggctcaaactatcctcccacctcagctacctgagtagctgggactccaggcgtgcaccatcacacctggctaatttttaaaatttttttgtagagacagggtctcactatgttgctcaggctcaaccttgaatgtttgttgctgtttcatttttgtgaggtttcacatttgttatcttctatagcttcaacacattcctgaggaatagatattttcctgttttacattcagggaagcagacaaagaagttaagtaatttgcctaatccaggggtgtcaatcttttggcttccctggcccacactggaagaagaagtgtcctgggccacacataaaatacattaacgatagctgatgagctaaggaataaaaaacaaacaaactcataatgtcttaaaaaagtttacgaatttgtattgcgctgcattcaaagccgtcctgggctgcatgtgactcacgagcgacaggttggataagcttggcctaatgcttcctggttgcttactttagccattagatcacatgatcttccctgcacaaaattgtttgtgtgcatcttggccaaaagcttggggggaaatgacttaaatagtgttgcttctggggaatacctgtgtcacaggtttctacttgtttggtcgcagtagggattttgattggcctccctgcagttaaggcctctgagttggttttcttgccaagcaagcagtaagtgccttctgtcaagaaaacagaaacatgttgttagctattttgaacaatgttagaaatacattgcagtgggaaggagctgcctctgacttctgcccacttcttgaaatattttaaggctagccgtttggaaactttatcattctccagtgtaatcacagggagactgtgcttcccccaaagctgagatttcaggggccttgtagcaatggacaaattacaggtgattttggtttgtttgtttatttttaatgatctctggttctctgtttgctagcttatactgcagcttccagctgctttaagtagactgtgagcaagtgattctcattcttgtagattctgccttctcatttctgttctgcctgctgtgctgttgtcctccctaggttattcatacagttaagatattgtattcagttgctgctgagtgtgctcagagatagcttcaaatatgaatttttatctgggagaattccagttctcctcccatttgctcctatgtgtttcttttcttccttttgttctccagagccagttgtacaagtttaaactactgaagtgatcaaactgtagtaccaattatcagcagtatttattcagaggcttttttttttaaaagaaacagagtctcattctgttgcccaggatggaatgcagtggtacaatctttagctcactgtagccttgaattcctgggctcaaatgatccttccgccttagcctcacaagtagctaggacaacaggcacacgccaccacacttggctaatttataaaaaaaatttttgtagagacagaatctcaatgtgttacccaggctggtctcaaaactcctggcctcaagcgatcctcccacctcagcctcccaaagtctgggattacaggtttttttgttttttggctttttttttttttttgagacgccctctgta

SEQ ID NO: 86204 - DNA, 1755 bp, Homo sapiens
aaccctagaggtcttctggttattaaaaaaaaaaaaaaaacctgtgggagttttttgcttctgaagtttgtttttttgtttgtttgtttgtttgtttgtttgtttttttgagacggagtctcactctgtcgcccaggctggagtgcagtggcgtgatctcggttcactgcaagctctgcctcccgggttcaggccattctgctgcctcagcctcctgagtagctgggactacaggcgcccgccaccatgccaggctaattttttatatttttagtagagatggggtttcaccatgttagccaggatggtcttgagctcctgaccttgtgacccacctgcctcggcctcccaaagtgctgggatcagaggcatgagccactgcgcctggccgcttacgaggttttttaaaatacacatttcattttcaattaaggcagatttagaatatagcataaacacagagaaagtaaacatttagacaatttcagtgtttttcctacttaatactctggaaccagactgcttatttttggatccctgctgtgtacttaacagctgtgtgatcttgggccatttgttttgtatgcatggtgtatagggcatatgcgggagtgataggaaacaagaatggggccgggtgcagtagttcacgcctgtaattccagcacttcgagaggccaaagtgggtggattacttgaggttaggagtttaagaccagcctggccaatatggcgaaaccctgtctctactaaaaatacaaaaattagccaggcatggtggcgcacacctgtaatcccagctacttgggagactgaggcaggagaatcccttgaacccgggaggcagaggttgcagtgagccaagcgcccctgcactccagcctgggcaacagagcgagactccatctcaaaaaaagaaatgagtcgaaaggtaggcgtaatcaagacaataaatagtcttgtgtaacatgcaagagtttgaactgtacgtggatgggaagccactgaagaattataagcaagggaattacaccattacattgtgctttaaaatatttttcaagtaccatttggaagaggtgagttacagtaaggcaagaatggagtcgataagtgagtaatgatgcctctcctacaagatagcatgaagatgacaggagagacaagatgcctgagctagggaataggattagggatgaagggatgaatttgagagatgtaagcgttaagtgcagtgtggctaagactcatcgactatggaggagaaggaggaagaatccagattgagttctgtcttggatagctatctttactctgatgcagttatccaatataggagttttagaggataggaaaggggtagaatataagtttgcaactgaagggcatgtgagtaaattatatgcagtaggaactggagcttaaaatagatatcgagtttgaaattatgcattttgatggtacttggacccatagaagtagaggaatttataggactaaggtgaggggtaaaaaggaattagaacagaatctttggaactctgaagatggaaagagtggctagggaaagaaagaaccagaactattacactgataaaacttttactatttacagcctctttcctccttcttccctgtgtctttaacatgagactaaagccaggaaaggattgggtcccaggaaaccaagcagggcttttacactggttaggatacttgatggaacttttcactacagaatgcaaaactctacac

SEQ ID NO: 86205 - DNA, 1414 bp, Homo sapiens
gtgttgttcccctctatgtgtccgtgtgttctcatcatttagctcccgcttataagtgagaacatgtggtatttggttttctgttcctgtgttagtttgctaaggataatggcctctagctccattcatgtcctggcaaaggacatgatcttattcatttttctgactgcagaaagcagaatttataatctgagtaatgccataagatatataaatagcggaaaaataactttacttattgatagacaaattctttatgctggaatatttttatgttttctagactagtgagtgtggagtaattagcaatatgaggttcaaagtttgggtaaaagatttatttttgtcttggttttatttatttatataatatatatatgatatgtatatatagtatatgtatgaatttatttgtagctctgaagatggctgtggtagatatctatcattccaggttaaaggagagacaaagacgaaaaaagtaagtataaaaaaccatcctggcctcctttcagctttggattattgttttgtgtgtgtgtgtgtgtgtgtgtgtgtgtgtgtgtgtgtctgtgtctgtgtctgtgagagaggcaaggtctcactctgttgcccaggctggagagcagcagcacaataatggctcactgcagcctcaacctctcaggctcaattgattctcccacctcagcctcctgagcatgtgggactacagcagtgcgccaccatgcctggctaattttttgtattttttgtagatacggggttttgctgtgttggccaggctggtctcaaactcctggacttaagtgatcctccctcctcagctcccaaagtgttaggattgcaggcatgagccactgtgcctggcctcagctttgagtgattgaccacatatagtccatgagagaatgctccacttgtgactcatcttttgaccttggagaagactcttaccctccttagacctcaatttttccttctctcaattgaggatagtaattcctgtgttatttttatatcctctgcccttatcctttattgacgttatgatgaacaatgaataatatgggtacactgttttaagctatttgaagtaaaagaacaagataaaataaaggcatcaagacagtattgttacacttttttttttttaatatttgtgaatcattctttgcttttgtctttttttttttgagatggagtctcgttctgtcacccaggatggagtgcagtggcgtgatctcagctcactgcaagttctgcctcctgggttcatgtgattctccagcctcagcctcccaagtggctgggactataggtgtgcaccaccacgcctggctaatttttgcatttttaatagagatggagttttgccatgttgtccaggctggtcttgaactccccaccttaa

SEQ ID NO: 86206 - DNA, 1876 bp, Homo sapiens
cagcctggttcctaactggtccatggcccaggggttgggaactcctgatctaaagtaaaacttactctctgcatgtctggagttagcttccatgaaatgctgaagaagcatacccagttgctcctatgagaagcttcattgctagttatgaatacctctggtataaatcagattcaagacacataactttgcctggtttaaattctcttttgcttaaaacacaattcgagctagagagtactgtagaactcagttgctgatgttgctatcaaatcttttgttttataatgccctttcattaaacatgcacaatatttatttctagtaccgccagtgttgtgtgaatgcacagttgaaaatgttgaatatgtgatcatggtgccctttagcagatttctctaaaatggctgttctcaattatttccacaagctgaatagattaactttatgacatggacagagattcctttcggtttcatcttaagtgacagacatgtgtttttcagcatttgtgagtggttattgattgattcattcgttcagcaaatagtcatggagagtctactatgcccaacaagaggaaaaacccgtgatgcctgagagtctaaaattgggttagtgattcactgacctgcagaaatttgtgggagtgacttctttggacctctgtattgtattccacctcagcatgtttatgtctgatgatagctatatgtgtaaagcattagtaaatgtgaaaataattctaatgcacaaattattgtggcttttcattctagaattataagagaccatggattaatcaaccttagaaagtttcaatgtaagtattagcagttttctttattttacaatttttttccaatattattgaataattttaaataaatcacgtattgtagttcttaatccaagttgcatattagcctggctatcactccagactaatgaagtaagaatctctggggttggaggcacagcacctgcatttttaaaaagtcttcagggcaattctgatccatagtgagagtttaaagtattaatttggggccaggcgcggtggctcttgcctgtaatcccagcactttgggaggctgaggtgggcagatcacgaggtcaggagatcaagaccatcctggctaacatggtgaaaccccatctctactaaaaatacaaaaaaaaaattagccaggcgtggcggcatgcacctgcaatcccagctactcaggaggctgaggcaggagaatcacttgaacccaggaggtaaaggttgcagtgagccgagatcacgccagtgcactccagcctgggcgatagagcaagacttagtctcaaaaataaataaataaataagcaaataaataaatgtattaatttgtagtcaataaaacttgtattaaaattcttttttaaaaatttgtatagtaattacagtgtgaatattaatgaataattttctggatagagtcatgttttgcaactatgtgttaagcataacataaccttaatcttcaggttgtaaaaatattttagataaataacagaaagtgatctttattttggatggttatagacagacaaaataaatgatatttaatattatatgacggtgataaaaatacatatagtgatttttaaaataaatgccacctttgaccttactgtggttttttgttgttgtttgttttttaagagacaggttcttgcactgttgcccaggatggagtgcagtggtgtgatggtatcttgctgcagccttgaactcctgggtgcaagtgatcctcccacctcagcctccttattacaggctcgagctatcgtgcctggcctttattattttaaatatcagagatacctaagcagggcagaaaaagtc

SEQ ID NO: 86207 - DNA, 1048 bp, Homo sapiens
taatcccagcactttgggaggccgaggcgggtggatcacctgaggtcaagagttcaagaccagcctggccaatgtggtgaaattccgtctctactaaaaattcaaaaattagctgggtgtagtggcgggcgcctgtaatcccagctactttgggaggttgaggtaggagaattgcttgaatccaggagatggaggttgcagtgcgccgagatcaccccaacgcactccagcctgggagacagagcgagactccatctcaaaaaaaaaaaagacagtagatgtgggagatgagtagtgctcagtggtggagatgatctccagtgttaacaacatccctgtgggatagttgctatggtgctgtcattatgattagcgttttgcattcttggctttcctgtttgcttcctgtcatggataagttagtcatatgaggttatgaataatgttcttccattttactaattgtaaaaaaaaaaaaatgctgaaaactcagggatccttacatttcccatgacacatttatgttttattttctctgtagtaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctctctttgttcccctttattaccatgagacaaatttgggactatgggggtggcagaagagaggttaaaaagccctaatgacttcccccattgccccagataaacaataatttagtagtttttctccctactttgtatcatgggaactttcaaatatatatagaagtagagataataatatgatgaactcccgtgtatccatcatccagcttcagcagttttcaacacatggccagtctggtttcatctttaccactcactcttccctcctgccctcaactggatta

SEQ ID NO: 86208 - DNA, 1050 bp, Homo sapiens
ctaagaaatatggagaagaggtactacatgtcaaagagaactctttttttgtaattctaattgttttttaaggaaaggcatatgcttatagcacttgtgtgactttgaaaaaatttataaaaatagaaaaaacaggaagcaaatatgactatagtaaaagttggttactttttgagagtggaaatatgagcaattcttactttctttgtacttttctgttggtttttttccccttatttcttacagatagaaaaggaatacaaatgtttaatatttaatacttagtattaagaaaaggatttcagactagggaaaatctacttgggtcttggagaaataattgtgaaagcagttttgcaaaggaaacagactttaagaacaaaacccaaaaccggtttcttggtcagttaggaagcccttcagttctgctgcattgtcattgtggtcattgtgttttctatacccccaggtgccagaacctacgatcacctcaagaagacacgggaggaagagcgccttaaacgcactatgctctcagaagttctccagtatatccaggacagtagtgcttgccagcagtggctccgccggcaagctgacatgtgagtaattactccagggtgaaggaggcattctttctgggatgccttggccttcacatatatttttgggcaccctagatggcagagtaataataattgagtagctggaagaattcagaaatattttagcagtccatctcagaaacagtgccatactgacagttttgagaaataactgacctcctagaatcatactttactactttgatcctattttttaaaatgagtgtattttcccccagccttctacccatgacttcaactctctcttcatacctagattttcactggggaatcatgtttgtatcccttccccttgagtggtgttagtggtgttctagattacaagctcttcttaacaaatctgaggaatttttcttcctcagaacagattttctttcctgctcaatacagtgagatatctgtaaaacatagttcagtctatctc

SEQ ID NO: 86209 - DNA, 1049 bp, Homo sapiens
caccttgttagccaggctggtctcgaactcctgacttcaggtgatccactcacaccagctccaaaagtgctgggattagagatgtgagccactgcaccggcctgattaaaaaattatgtgacctactttttccagttgcaatcatcagacatgtcttcatattgattttatctgtttctaaaatttaaagccagcctcataagagtcatcatcaggagttttcagaaaactttgtcacatctctgaagtctgttcctcttttggaggagttcctcttttgctcctcatatgctccttttataattcccaaggtcagttccccatctcccaccatatatcattagttcagttcagataataaggaagggtcatagtgtaggggatagtgttagtcttattttatccaccaggaacagtaaggattagtttgggagtggaaggaaatgtatgtagtatctatgtattgctgaaggaggtcataggtcagcctgattcaaatattgaatggcctggaatttcaagctttttttatccttacccacataatggtgacctcagactcctcattgctggataatgtggcaattttctagatttttagcagttaaagttacctcctcttagcaaggtctctttatctcctttccctttgaagtaggaaatgtaatccccaaagcagggactactgctttatgctgacactaaaaacaatgtgatgcagccttgagaatccaagtgtctgtgcattctgcccccactgtgccccatggctcttccctgaccattggtgctgggactgtacctgggcatttagtgtttgactcctgaaagagccaggctgctcctcaggagcacatagttgtaaatccctaacaaacccaggcccctgagccagctggcatgtgctaaaggctcttctagtatcacaccctggctttctcttcctgggtgtgtgtccttagggagtgttctctccagagaggaagagactaaatggaatgtagtccagccacccatcagctcctataaatagttggaggttgatgtca

SEQ ID NO: 86210 - DNA, 1371 bp, Homo sapiens
atggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcacctgtaatcccagcactttgggaggctaaggtgggcggatcacgaagtcaggagttcaagaccagcctgaccaacatggtgaaacagtctctactaaaaatacaaaaattagctgagtgtggtggcacacgcctgtaatcccagctactcaggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttgtgggtgtgtcaaatattctggtaactgaaacacacttaaggtgttggatgcctgccccatcacgctgcactgtctgctgtcacatgtgtcctgaactcaccctgtttttgccctgggtttcccaggataccaagcccctgaggatggagatgatgcaacaaacctcagctttgcttggattgtgacttgaaccctatttctcaatggtgaaaggctagcctgcaataaaagctgcttttaaaacagaagtaaagcagctttatatatgggactcactagatatgagggtaagtagccccaccacatgtaaaacttggtcctcaaacgtttctgcagaataagaagccaaacttatggttatcttgtttctgttagaaacaaagttgtatata

SEQ ID NO: 86211 - DNA, 1180 bp, Homo sapiens
aacagagtgactggacggctttccaagattgagacctacccttttaaccattgtgtgtgtgtgtgtgtgtgtgtagtgaattagataatgcatataaagagcttagtatagtgcttgaaagtaagggcgtattagctgttgttctatttatggtctttagctggtgaccttcagatctctccacaagcaggaggcctgtatgtgtatccaaccacctgcttatatagcatgtggccttcgctgtcccacaggcagctccagctcagcttggaccaaactgaactcttctcctcagcttccatcctcaaacctggtccttctctcacgtgtcttattatggtgaatcctctcagctgcccgggtcccccaacctctcccatccagcaggtcacccaggcctgctcattctcctgcctcgtcagctctttcacgtgcccatttctctccattccccaccgccgctgccttcattctgaccatcggtatctgtctccaggactgctacagcagacttctggctgaggcctgtgccctgaggattgccacccccaattcattgcctatactgtagcgagagggatctgtcagtaatacgaacctgggcctgtcgtgatccagttggaagccttagtggcttccaggatgctccttatcttccttggagtcctcgtgctgcggcttcatctcctctttccctgggccctgcccccaccctctagattccttcccataccccatctttagctcagagcctttgcctgtgctgcttgttctgcatagaatatccttccctcccctacctcacccaaccctcctgtccccctcacctagcagctcccatctacactcagccaaggtgattttagaatctaggaagcaggccaggcacggtggcttatgcctgtaatcccaccactttgggaggctgaggcgggtggatcacctgcaatcaggagttcaagaccagcctgaccaacatggtgaagccctgtctctactaaaaatacaaaattaaccagacgtggtggcgcgcctgtaatcccagctactcagaaggctgaggcaggagaatcgcttgaacccgggaggcagaggttgccgtgagctgagatcacaccattgcactccagcctgggcgacagagtgagactctgtctccaaaaaaaaaaaaaaaagaaaa

SEQ ID NO: 86212 - DNA, 1096 bp, Homo sapiens
taactaaatgtaaatgccaactcaaggctaatgtgggtttttttaagatcagattttacagcccaactcttaattttagtacaaactctaaatttagctaatttcaacatagtataaaactaatcaaatatgctaggcattttgcttctacagagtttagggcattttgcctaaattgcttgcctctaattgtggggtcttatttccctttcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggtgagtagcttccaaggtagattttactattgtggtttttttccactgagatgttagatgttcttaagaataaaatgttgctctctggtttcgcaggaaatagattgttctaatctttgaaatcagggtcaattacagatagctataataaagatttccctgagacgggagtcaaaatcagcatccctcagataactgctttatgggctaaaaacaagcacagcatgcaggtattgctcattagctcgtttggttagaggtgtgctgtgttaaaagagccagataaat

SEQ ID NO: 86213 - DNA, 1643 bp, Homo sapiens
ttttgtctaactaggggggacacgtgagacacttccaagtttacagattcaggcagaaattgtaaagtcctatagcttttgcatatgtcaaattggcaagtcggaaaacaaaattgcatccatcctttggttatggaaatgttgtaggtattgctaaacaggctgctgaatcaggagcaagttagcagagacattgcatgtttcatgttgctacttgctaaggtatttttcaaatgcagtgggcggtctgaagagctcctgtgcccttgactgtctactttctgtctttttttttttttttgtacttttcctcagaaattttcttatttttttgctgctgtttgtttgatagagtgattgtgggttttgttttgttggttttttttttttatgagctgcttgaaccacagcagttggttgcaaagtgctctgttttctgaacaatattggatttttatttaaaaatctcataacatgtatactagccttttggactctgaagttattaattagaaactatttttctgaaagtgaatctatattctttcacagtgccaaggtagatgtctttatgaaatgaggctaatccgggtttggggtgtctttttttttcccccattttatttggaggttggtttttttgaccaagcttgttcttactgacctgttaaaataatcttctgtgctcatgttcttttatgtatgtttggaacatcctcagcttggagcctgtaatgttcaagctaactcttcagttggaggatattcttaaaagcagattgtttcctcccattgatctgtaaacctcctgtcagaaaggagcagtatccctttagagcggttgttaaaaggggttgatgtctgaccaatgcgctatattgctgttgtgcaaaattgctgcatcaatgtattgtagagggtaaatggcaaggacttattcaaagtaatgtagttttattttatcctcatgttcaccacagtatctcttgctctcttagtttgagggttaaaggtacttcttgttggagaaataagaagtgagctgatgaagagagaataaaacctggtagattgctatctgcggaccttaatcctgtttagaagccctaacttaactctgaaggggatactgtctcttttaactcttgctataatcatttgtatggaaggtagataatactgataacattgcctgatttctctgcgtattattacatttaaccctttgaggccttgctgcatataatttcaactaggctgttttttccccctgactaaatttaatctgcggcactgaagcatcttgacgtgcagtcattaaaatcatatggttttattggcagcaagagctgaccctcatctgtgacattttcaaagggttagcaagacttctgtagctacctacctacctatctgtaaagtagctcttctttgacattgaaaatctttgtattttaattagcacctttttttttttttggctgcttttctgatgtctttttttcaatttagacattttctgtgtgaatgtgccttcaaatttactttagtatattcctctgcaaatactgatctgcatgcttattctgatgacttcttttccagctcttctgtatcactctcttttgtgatctgtaagtctt

SEQ ID NO: 86214 - DNA, 1024 bp, Homo sapiens
acatacagctctgacttgactacttccatactttccttgaatgaaactatttttttttttttaagacggagtcttgctctgtctccaggctaaagtgcagttgcgcgatctcggctcactgcaacttctgcctcccaggttcaagtgattctcctgcctcagcctccctagtagctgggactacaggcacgcgccactacacccagctaatttttgtatttttagtagagatggggttttaccatattgtccaggctggtcttgaactcctgacctcaggtgatctgcctgcctcggcctcccaaagtgccagaattacaggcgtgagccaccatgcccagctgaatgaaactattttggttttatctagaattcatactcattattcatttattcatccagcaaacatttatttagcatttgctatatgccagacactgggataggcatgagaaatacagaagcaaaaaccacagttcctgctctaaagacacttagttttatctggtatttaaattatctgataacattctcttaggattagtccttaaatgtacatataaaatgtattccctagtttatgataatctgtactccacattgttttaaaaagagatttgttaaatcatggtgtgaatagctaagcctaggaaagaccattttggacagaaaatgggcattacttgttagagaagatgaaagggcaagtaaggttttaggagtagaccgggatggagaacattgttggtctgtgagaaaataacattagttaaggacggcaccagttgtgggatggcttatgacttatgacatactctattttaaagcattttatgagtaagaagtggcacaatgaaagtgattattgctactgtgtatagaataaattcagttgccatggtaatcttgctgtgagatgatgagaattactcagggtttagagttatagacactgaacagtttatatctgagaaattggctagactcggtgttaaactagatagtcaaaggagagatggcagtt

SEQ ID NO: 86215 - DNA, 1050 bp, Homo sapiens
cggggatacatagagtaggttactggattatggtgagcacatttaaattcttaggttgtatctttcagaaaaactgctaaacctgaaattaaaatactttagtttttcacttctcagattagcaaaaatgttttaaatatataatatttaatgtcattgaaaaagtagggtaaaagtgactaatacactctaggcttattgtacagccttgttgaaaggcagacttggcaatagcaatcaaaattctacatgttgagctgggcatgatagtgtgtacctgtagtcccagctaccctggaggctgaggcaggaggatcacttgatcccaggagttcaagtctgcagtgagctatgattacgatcacaccattgcactcctgcttggcaacagaaggagactgagtttaaaaaaaaaaaaaaaaaaaagcctcagcatgtctatatcttctatcctagtagtcacattattagaaatctatcccaagaatagtaactcgaattagcaaagatatacaagaatttttgttgtaacattgtttgttagagtaaaaagtagaaatagctaaatatccaacaggaggagaaaggttaaataaatttcaattccttcacacagtggtaatcattaaactgaatgagatagatctacatgtactgcatggaaatgtgtctttgttatatagttaaagtatagagcaatatagtgtaatctcatttgtctttaaaacaaatgagctgttaacagtacttctggagtgtgggattaggagtcagtgtccactctttgtacatgtatgtgattggttatgatgagcttgtgtcacttaatttgcaaacatgcatgatatagctgtatgtctttttttttttttttgtagcattttgacctttcctttttagtttttttttttttttgagacagagtcttgctgtgttgcccaggctggagtgcagtggcacggtcgtggctcactgcaacctctgcctcccaggttcaagccattctcctgcctcagcctgccaagtagctgggattacaggtgcccgcca

SEQ ID NO: 86216 - DNA, 2396 bp, Homo sapiens
gggataacttatttctgttatataagtagaataatccagtgatgttggcaaataaacatgcacataaatgtatgactgctgttgaaattcaacaaaacaagtgtctagatttttaagttctggggtcttgacattccagaaaggtgatttaaaacttttgctcctcaactaggagcactttaaactgccttataactttaaaagaaatcttctgatttttccagaagattgttgtttgggagattcaccgatatcattttcttaagaataaggagctaggaaaggcttctttagaaagtactctttcagcttcagtgacagggcacttgggggcagaagcccaggttgtccatttactgtcaatttgtccttggtgtgccttagattttgtcatctataaaatgaatagagacagctacacatcctggcttgagacagggtgctgggagggatcttggcagacatgtacttagtccagactgtctcatttgatggacatggaaacagaccaagagatgatgatgatgttactggccagaggcctccctaggagttagtggaagtgttatcttatgtaggttgtcagatttcaaaggtagtgctccttccactacactcttccacctactgtctcatagaattctttagaatcacagtagataattatgtttacattctctaaaatctctgaagtctctcaagtcctatacaaatgtgcagtgattgaattatttcaacgtttacttttttttttttttgagacagagtcttgcactgtcatccaggctggagtgcagtggcgtgatttcagctcactgcaacctccgcctcctgggttcaagtgattctcctgcctcagcctcccaagtagctgaaattacaggtgcccgccaccacgcctggctaattttttgtatttttagtagagatggggtttcattatgtgggtcaggctggtcttgaactcctgacctcatggtctgcctgccttggcctcccaaagtgctgggattacaggcttgagccatggtgcctggccacaatgtttacattatacgtggcagggcctccctttagaatatgggggtgagctgggcaccgtggctcacttctgtaatcccagcactttgggaggctgaggtgggtagatcacctcaggtcaggagttcgagaccagcctgtctaacatggcgaaaccccgtctctactaaaaatacaaaaattagccaggcttggtggcgggcgcctataatctcagctactaaggaggctgaggcaggagaattgcttgaacctgggaggcagaggttgcagtgagctgagatcatgccagtacactacagcctgggtgacagagtgagattccatctcaaaaaaaaaaaaaaaaaaaagaatatgggggtggagatggatggttaaaaagattagacatatacagttatatacaaataatccttcatgctctttgtttaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgagctcgtgaagcattcagcaaaaaacttgtttaaccaaatgttgctcaaatgctaacaccttaagcattaatcttcaaatgaatgctgcttgattttgctaatcgaaattttgcttgaaatatatttaatgcattcctttctccaattaacccctaagattttgctctgaattctttcaacacactgttactcctttttaaaaatgattttgataactggttttcttaattggaatcatttctgatttaaaattttctttccttttattttataaaaactctcttttttccccccttatactttctgttcttccataaaggttgaaaagttaaaatgtaactggaaaagtcaccaatgagaatatagttttggtttctctaaaataaatcatatgcaccactgcctaaaagatctaaattgtataaattcaaccctcagaaatgaattagaatgtgggcagccaaggaggcaaacttttgggaggatattttattggacagaaagcccccaaaagtcctatatatttaagacagcagtatcatatgtaggttaaaaaacaatgaaactttgcaaagaagcattagtaaaaactgcaagtaaagcttggacaattaaatatttttagatacataattttaaactatcatctatcatgtttttttccttaatttgtaatacatgttaa

SEQ ID NO: 86217 - DNA, 1039 bp, Homo sapiens
cggaggttacagtgagccgagatcatgccactgcccgctccagcttaggcatcagagcaagactccatctcaaaaaacaacaaaaaacaaattcaacgttttgacattttatcagctgattccaagaaaacatacctaataggtgaacagttttcataaatcatttagccagccaagaaagtactatcttctgctggaaaatgttgcattgataaattttatcttgaacccttgtattatagtacctttcatgggtgatatcaagagggaataatcactggcatagtaaccagttcttgatttttccgggacaactttgactctgttctgttaatttcacttaagattcccattccaaaagtatgccccaaaataaaatatacaagattgaaaagaaaacagatattagcaatcaggctgagattagaaaggaaaaacatatctaaaaatgaaaattataaggtgaataagctagtcaagaagtaatttaggaatatatattagaagttaatactaaaactagacctaggctggaggttaggaaaagtagagaaaggcagtcaggagttcaagaccagcgtggccaacatggtgaaaccccatctctactaaaaatacaaaaaattagccaggcatggtggcacgtccctataatctcagtcacttggtgggctgaggcaagagaatagcttgaacctgggagatagaggctgcagtgagtcgagactgcgccactgcactccagcctggacgacagagtgagactccatctcaaaaaaaaaaaaccaaaaacctagtcctaaagtatttataaaaagagtttccagccattctaccaccaaaggcaccttttaaatttctctttatagattgtttatcttaaaatactgaatatacaaactatattgatcatataactttttttttgagacagggtctcattctattgccctagtgcggtgacatgatcacagttcactgcagccatgaccccccaggctcagacaatcctaccacttcaacctcgtgagtaaccggg

SEQ ID NO: 86218 - DNA, 1449 bp, Homo sapiens
gaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaa

SEQ ID NO: 86219 - DNA, 2450 bp, Homo sapiens
tccctttgagttagctctgtaaatcctattaggcgatctcgtttattaaagtagttacagccccaccttaaaccagtaaatggttttgtaaaatgaattttgtggctgagcgtggtagctcacgcctgtaatcccagcactttgggaggccgaggcgggcgggacctgaggtcgggagtttgagaccagcctgaccaacatggagaaaccccatctctacttaaaatacaaaaaaaaatttagccgggcgtggtggtgtatgtctgtaatcacagctacttgggaagctgaggcaggagaatcgcctgaacccaggaggcagaggttgcagtgagccgagattgtgccattgcactccagcctgggcaacaagagcaaaactccgtctcaaaggaaaaaaaaaaaatgaattttgtgatcaaggatcaaaactaattttagctttaactcttctaattgaagttgcacttaattcttttccttttttactttgtaactttcagcaaacaaaagaaaaagatgattaagaaaccattggaaagggagagcattagtacaactccaaaatgtttcttagaaaaagctaaggataaacagtaagtatgtggtaagaaaaatggctgtttgacaccatcataaagttatagtaggcattatttttccttaggtaaatttttagaagtagaattgatactacagtctgttataaaacgttataaaaataatatattttaggttgcctataattgggaaatttgtttgtttgtttttttgagacagtgttttgcactgtcgcccaggctggagtgcagtggcgtgatctcagctcactgcaacctctgcctcccgggttcaagccattctactgcttcatcatcccaaatagctgggattacaggctcccgccaccacacccagctattttttttttgtatttttattagacacggagtttcaccatgttggccaggctgagctcaggtgatccacctgccttagccttccaaagtgctgggattacaggcgtgagccaccatgcccagccaggaatttgttttaatattggaatttttctgtaccaatatgttgatgatctgtttttttccgtcttggaaaatattatttcaattctctataaattcgaattatactgcccaccttctctacacagcccacattaggacatgctactaaggccaatagttaggaccattgacttacatggatctagtcttctttgaagctccatattctgggcaggatttcaatatgatctcaggcttacgcagatgcacattgtaacacctgtaagaagtattacttaggtaaatttgtgctagcttagctgagttttatgagaatattaaagtatagttttttagcattcatacaggctaccttattttgcccagtaatactaggaagctttatattttgaaaaggataggccaagatattttgaacagttatactctatccactatttaaggaaaatggcactcttcacattctaccagaaccaggttattatatactctaatagaattgttcaagtctataatttattgtttttttctcccctgagagtgctatcaatggcctaggatattaccattgtgaaatatgctaatgcttatatccagttatctcacatctgttctatagaagtcattagaaaaaaactgtttccatcaaccagtaggcatttaccaagttgttctgcaaggtacttggtggtggtagtgtatacaaatgaatataaaatgagatcctttcctgaagttaggtaaagaagattcgtgtacatgacagaaaattagagactggcttttaaataaaataggagataagagaaagatgattgtgaattggtgtggttacagaagtttcaacaaagtagaactatctttaaggataggtaaaatttaggcatggagaagggaacaagatgaatagaggcatgaaaattagagtgtgctttgtaaataagtgaacaagagttttcacatgttggtattgtctatgaggaataaaagtcggttcaaatatacagtgtatatatagtgtctcaaaattttatcatacttttaataacttgggaaggataagtgctacaaactgaaaaaagtatatttgaatagtcaatcaatcaataagtacaaattccatttgtacttattcagttttgggaatgcttcacaatcacatttactttttttttttttgagatggagtcttgctctgccaccctgtcgcccaggctggagtgcagtgtcgcaatctcggctcactgcaacctccacctcccaggttcaagtgattctcgtgcctcagcctcctgggtagctgggattacaggcacccgccaccatgcctggctaatttttttgtatttttactagagatggggtttcaccatgttggccaagatggtctcgaactctcaaact

SEQ ID NO: 86220 - DNA, 1097 bp, Homo sapiens
tttataattttattttgacaatagtttagtggaaaagaaaaattgaaataatggatataacttaggttatggattatctttgggttttagttacccgtattctttacactcattcaaagggaatttaagggcaatgctcagaaactttgttggggtgatggtggcatggatggatgatgttaggaaagcagatatgacttgaaagattagattcattatgtaaaattgtatttgtttttttctatggctggtagcgttatttgaccaggctctgaaaaatttatgtactttctttgtagtatttaatataccctatgtttttagggtcgggaacttctggcttctgctccaactggatctggaaaaacattagcttttagcattcctattttaatgcagctgaaacaacccgcaaataaaggcttcagagccctgattatatcaccaacacgagaacttgccagccaggtatgacttgtagcttttgaagagtatgcgattggtttttacttcagtgatctttcttatttgaaggtaataaaaagatcttaaaaagcaaggcccacgtcttctgtcatggtcaagtatcctctacacagcacagtgctccggatcttactccatgtgggcaagtcttttaagtctttctgtaagtttctaaaacacagtgattttaatatttacacttctttggtaaatgctttaaggtctttgaagttgaaaggctaattaaatatagccctgcttggacatttatttttctcatctaaaaaaaatgaatactcatcttagttttggtttttatttatttatttgtttgttttttagccacagattcttactctgttacccaggctggcatgcagtggtgtgatcatggcttactgcaacctcgaactcctggcctcaagagttctccctcttcagcctcttgagtaactgggactacaggcacatgccactgcgcctggttaatttttttctttttgtagaaacaaggtctccctatgttacccaggctggtcttgaactcctgggttcaagtgatcctcccaccttggcctgccaaagtacagggcttacaggcatgagtcatt

SEQ ID NO: 86221 - DNA, 1046 bp, Homo sapiens
atgcgtgtgacatgtgtttcttctttctctaactggtgagtatgaactctggagccagattatctgggtctaaatgctaagtctgccagttactcatttttagacctacctcaagttacttaatttccgaatgccttggttttctcattcgtaatactgctatttaccttatagagttgtaaatatgaagcaatttaatatgtataaacatgcttagaaatctgcttgacatttagtaagcatatatgtgttcattgctaatattaatttgttactattatgaggtcagagaaggtctcttcagattccatttgtccagacacctgttagctcgacagatacttggtgaaagggtagaaaagatgaggagtcattgaacagtcttgcttgaatgaaagcaatggtattctgtcagtaggtttcattttacattttttgggttttagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcaggttagtgtttgatttctgtcatgttttttctctttaatttttttcagttataaaaataatacaggcttatggctacaagtcagacaataaggtcatttgtcagctgatggcactcaggttgtttccaggtatttgtcattagaaatattgttacagcaaaggtaattttaagtaaagatatttatacataaatccttttgtacaggtactgttatttctgcagaataccatccgaaaagtagcatcatatggtgaaagggtatgtaccctttctctgaaaaatactacaaagtgacttcccaagtccttgtcagtgctgaatattattggtgttaatttttttgccaagctaatgaatgaaactttttttttttgagacagagtctcactctgtctccagg

SEQ ID NO: 86222 - DNA, 1071 bp, Homo sapiens
cccgaagcccagtttcccttctatgcagtattgccacaatgcctctcccacgatgtcaaggactcctgtctgtcctggaggtgggagacaaggaaccaccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccacatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcactacccagagtctcatatttctgtctctgatactttccctgccatggttccaccgagaacccctggcccctggtctccttggaattttctgtatactccactgggatcctgtagtgtgtcatctaggggtgtagagaggtgggtggccttctcttgccgtcatgctcccagtgtctgtgtaggctttactgctgattgaggtgaagaagagttgaatcccccagtaagactccacaagtcgctcagagggaatctggccagagcaggagctagcacccttttcttccctgcaactcacaggggtaaagt

SEQ ID NO: 86223 - DNA, 1136 bp, Homo sapiens
gcaaaggttgggcctcactgcctcggcaacccaaccatcctggttcttgccacggatcttatctggtttaagggttttcagaggagcaaacgcttttgagatgatcctagggccgctctctcattgccagaatatactcccctggaaataatgtgtggctctgatcagtttcctccaactcctggttcagccattgccctgtgagggctcactcggcttccagggagccctttaccctatttgtctccttccctcttcttctccctgtgtggctgctgactcagcggtcattctacactgaggaggctgccttatgggtgggccagatccaaaccgcaggcaaacgggtcgtgatggcgtggcaaccctcactgtgttggaggatggcactccggccacctcctccatctctggccatatcctgcccctcgctcggtccggctgcctcaggagaagctcagtagcctttggggacggccactctgttggtggcctctgcttgttggcttccgtgtgtcatcagggttggtgggggtcagtcacttgaaatctttgcagcaatgagttgggaaaaactgaccgagtacctgctccatcatgcttgattgagtgctcctgtgtgctgggccctggcctggattagaatgcctctgctgtgggctttgggtttgtcaggatggaatcctacagcctcctcgggggaaagcacacctcatgctgagcgctgtgttaggcacaggctgggatggagcacttcttctggtccttcattcttctggcaaagctggcttcctagaatggatgtgctcactggggtctgtgtggtgcccatgaggacaaagtgtagcagcctcctgcctgctccaagaaaagggcttgcgaaaggaaagccaaacactgtttctaactcaggggtgattctgaaacctgttggctcccctcacctgtcggttgcccttctgatgagaaaggcctgagggctgggggctgacccaagtgttgaggggaccaaagccaccaagacaggctcggagccatcagctgggtggtgtacaagcatttgttccatgcctgctgtgccctcccatagcactgcctcttccagggcctctgggagcctgacagtgcccagcatg

SEQ ID NO: 86224 - DNA, 1005 bp, Homo sapiens
agcctcccaaagtgctgagtgctgggattacaggtgtgaaacactgcaccagctacatgtagaacttgataaagactggctttcaccgtgtatgagatggggagccatcttcagttctaatgcagctgggactacaggtgcgtgccaccacacccggctaattggttttgtgtttttttttgtttgttttctgttttttttgtacagacgggtttctccatgttggccaggctgggctcgaactcctggtttcaagtgaacctcccaacttggcttcccaaagtgctgagattacaggcgtgagccaccatccccgccccctcaaaatctgttaggacgacagtctcgccaaggcaatgcagtcgcaatatgccgtttccattgcaatcacaatatgacatttccatttactttggattatacgtcattatgaatattaacaagacttaaaaaggacaccttcgggtatgtcagatgaaagtacaaaaattgcgttgtggggctgcagtttgaggacagtgtctgcagccgtcacgtggtagcaaaacggtgttaagcattgcaggagagtctgcatctacgacagccagagtccatacgtcgggaggtttatttggtttgagagggaacaacaggcaggatgggcaccacccggggctggacagtcaggcgggctagggtgcggttcctcgcactcgccactagaggtgaggcgtttaccgcttcagggctggaagatgggccctcggggactggctactgctggcccggggcggaaacctgggcgggggttggatgcgacgcctcaggcggcccccctggttactgacacccgactttggcatgactttatttgtttttccccccatcagatttcctgtctttgtgggctgatggactagaggaaagatgcctgttgacggtcaaaggcagagcctcttcggcagcttcttaaagcgccttctttaacagagaaacaatctgcatggggtctagaacggttct

SEQ ID NO: 86225 - DNA, 1162 bp, Homo sapiens
agaaagcagttttctcctgtaaagctccattgccctcttcccccttttgctgttattagaataaacattatatatgaaatcacgccactgcactctagcctgggcagcagagtgagactcctgtctcaaaaaaaaaaaaaaaaaaaaaacccaggctgggtgcagtggctcatgcctgtaatctcagcactttgggaggccgaggtgggaggatcacggggacaggagatcgaggccatcttggctaacatggtgaaaccctgtctctactaaaaatacaaaaaaaaaaaaaaaaaaaatagccgggcatggtggtggcgcctgtagtcccagctactcgggaggctgaggcaggagaatggtgtgaacccgggaggcagagcttgcagtaagctgagatggtgccattgcactccagcctgagggacaaagcaaaactccgtctcaaaaaaaaaaaaaaaaaggaagcaagctgggtatgtgcgtttagaggtgctgtacattttcagcattataaatgaatagagatgagtggcagtagtttttttggtccatagatttttggtatcttaactagttttggatctcttccactaaagggattgcctgttcaacgttgttaggaatgtacgtactgaaggcaaattgcctgggtttgaattttgttctgtcccttgcaccctgcctggtttcaaatcctagctctgcttattaagttcttttaaggtgatgatctttgagcaaatgtcttaggttctgctttcccagtaaatggatacaatagttgctaccttgtgaaagattcatgtaattgaccagcgtttaccaagtagcatcagtgtttagtttcagtcattggtgattctgcagttggactgtgagggggtattggggtggggggtggtgtgtgtgtagcacttaattgcaggcaggaaggaaaagatacttttgataaccgacaggcagcttttctctgcttttgtgtcaaaagggaggaagggagtttggagagggaaatgaattctctgtaacactaagctctcttcctcaaaaccagaggtagatagaatgtgtaataaatttacagaatttctagactgaaacagtctgattttttaaaatttatctttattttttcaggttgagactgagctaaagttaa

SEQ ID NO: 86226 - DNA, 1569 bp, Homo sapiens
ttccattgtttatgtcaaggaaaattctggacatattttattgtcagggtctgttttgtgaatactttaattctcttgacttagcctatccctacttcagtttatatatataaattttgtatctaaagaactagagttataatcctacttcaacatatttaattaggctcccatataattgtaattcattacaattagtgcaagaaatctaatgttcttcacctccatgtcttcctcatcactcctctgcaactaccccaaaaataaacagaaccatagtggcttctttcccagcagaacaaagccaggactggaacccaagctctaagggatgacaggaatcatgttctattcaactttattattattagttactacatttttttgaggaccatcgttatacattatgagtgagttaaaggcagaaaaatgtaagttagaagggttttcctagaaagcgttttatgtaattcagtattacgggctatctgcttcctgtcataaccctgaatcacattgtctgccaggtcagtgtgggccatccatctgaggttgatgagatatttgatgctatatcatatagcaaaggtgcatctgtcatccgaatgctgcatgactacattggggataaggtaaaaaaaaaaactttaagtatttcattctttcatggtgaaatcataagagttttgcatgaaaaaaagtctcactttatttggattaagttcccaaatagtttctggcttgtcattttttttaatgaccaaaaagaatgagaattcaattatttgaagttgactactgtggtctctcagatgagtgatgtgcaggtgtgtttgggagtggaaatgggaggctgttataaaacttaagagcaagaatagaaggcatagagtacgcattattaaataaaaggcagtaggcatcagaaggatatatgtgtttcagtgtatctgatacttgagtatttgagtaaatttgtttttgattactaatatacaaatatactataaattctgagatctgacttccctggattttaaaaattgtgttttctcaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttgaagctgtgttcaggttgaatatctctaatctgaaatttgaaatgctccagaatctgaaactttttcttttctttctttctttttttttaattaaagttctagggtgcatgtgcacaatgtgcaggtttgttacatcagtatacatgtgccatgttggtttgctgcacccattaactcgtcatttacattaggtatttctcctaatgctatccctcccccagccccctaccccatgacaggccctggtgtctgatgttccccgccctgtgttcaagtgttctcattgttcaattcccacccaaaatctgaaactttttg

SEQ ID NO: 86227 - DNA, 1010 bp, Homo sapiens
atttacaatgttttgaaaatatcctttggcccaggcatggtggctcacacctgtaatcccagcactttgggaggccgaggcaggtggatcacttgaggtcagaagtttgagaccagcctggccaacatggcaaaaccccatctctactaaaaatacaaaaattagccaggcatagtgatacatgcctgtaatcccagctactggtgaacactccagcctggtgacaaaacaagactttgtctcaaaaaaaaaaaaaaaaaaaaaaaaaagaaaggaaaagaaaatgaccctcagatataattctaatatcaccagttggcctttcttgacatctcttttagtcttctctctttttcagaaatgtgagttctttgccaaatgttttgaactgaattttaggtcattaaattgtgagttttggaatatagtggaagggacatgtgagtgttttagattagtagaatgacaatcatttcaatttctttaagtattttcatcttctgtttttaggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtgagccatactttctaaccattagcctatgactgctctcgtttacaatgaaatacgtaatttgttacatagatactttggactttgaaaagaagagaaaatagcatgggtgattttactggttcatatttctagtcttgaaaagctagtaagtctaagttctaattaaacatttcttttaaaggtaggcagtaaaaaaaaattggtctggccaggcgcagtggcttacgcctgtaatcctagcattttgggaggctgaggcgggtggatcacctgaggtcgggagtttgagaccagcctgaccaacatggagaaaccccgtctttactaaaaat

SEQ ID NO: 86228 - DNA, 3421 bp, Homo sapiens
atggattaaagtttggccattgtattcaaagtttggagctaaggcagtcttcggaggtagggctccctgggattcatttctagtaatttaagatacattggcttgcaacaggattcctttgtgggtttcaatatgaattataataacatatttattagatggttattttgtttatacttttataggttgctgctaaaaccttgcctttttataaggactacttcaatgttccttatcctctacctaaaattgatctcattgctattgcagactttgcagctggtaaagtaaatttcattttattgctgaattgtaataactttttaaaattttgtgacttttgatgcaagagtatatatatatatatatatatatatatatatatatatatctcaataaatgtttatatttattttgtgaaggtgccatggagaactgggaccttgttacttataggtatgttaatgatgtattaccctgccttatcttttcaaatcactgatttcaaaagggcttccctcctaatcacagttgagtagcttctgctttacgatatggtgtaaatttttctaccttcccccacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggtatttaatatttttaagtgctcaaatatatttatcttcatcctactccacattattttggctacatagtatttcaagtttggctgcaacactgtgccaaaaaataattgagtgatagaaaagtattattttaaaaggtccactttgaaagggcttatcagaatctctgcattgaacaagggcatatggacagtctttattcaacagacacttcctaaactgttctaaaatttgtctgcaaatgggaaaagtcaagatactaatttgggtgagaggaaaagattcctcttaggtgtagatgaatgaatcatgcagtgagattccaggctaactgtagtttcttgaatcttatttgttaatctgactcacagctgaaaagtaacctgatgaataacagactgatctttaattagagagaaatgtttttaggagtcagttttttcattgcctaaaatgttaagttgaaatttaatgaaataaaagtaaacaaactgcagagtgactgcagaataaagctgtattaaaattccagctgttctgttgaaatccttataatgtttgcagtaatgatctctgtccttcagtcctgatttttcactcttactctaagtaaatactatttatgaatgccaactgtgttagagcttgggagcacaggatttaataagtgaactagatgtacctctgcaattaaataactggatattctggagccagctagattccctgacattttaggctgccaaagagcagaacctgatttgaatgtagattgagtccatacgttatataaataagaatgtaagacatttatcaactgttacgtgtctcagagagtttctacagaaagtcaacccttgaaaataaatcttttccttttattttggatgtttaaaattttacaggtgaaaaaaattctttgaaatataatttcaggccgggcacggtagctcacgccagtaatcccagcactttgggaggccgaggcgggtggatcacttgaggtcacgtgtttgagaccaccctgaccaatgttgcgaaactccatctccactaaaaaaaaaatagaaaattagctgggcgtggtggtatgcacctgtaatcctagctactctggaggttgaggcagaagaatcgcttgaacctgggaggcagaggttgcagtgagccgagatcacgccactgcactccagcctgggcaacaagagcgaaactccatctcaaaaaaaaaaaaaaaaagaaatataatttcatgtggaactatgtgttggtgcctgtattcaaatatgtgaagaaatggccttttcttctaatgcagcgagtttgctactttgtaccaaataatttttttgcttggctttgagataactttatgattttattttgaaactacaagcaataaattttagtaggggaaatgtgtacattcttattaaacaactttttactggttttatgtaactattctagttattagaactgaaattccaagggcttagggataggttggaaaataagtttcattttatgctagtttattttaggaagctactaggcaaatagccacttatcacttaatatcaaaataattttttttttaagacagagtctcactctgtcagttaaactggagtgcaatggcacaatcatggttcattacagtcttgacctctgggctcaagcaatcctcctgtctctgcctcctgagtagctgcaattacaggtgtgtggcaccatgcccagcttatttttgcactttttgtagagacaaggtttcactgtattgccttttgtagagacagggtttcactttgttgcctaaactggtctcaaactcctgggctcaagcaatcctcccacctcagcctcccaaagtgctgggattacaggcatgagctaccacacctggccttttctggggggactggttggggatggagaataggatctcactttgttacccaagccggagtgcagtggcacaatcatgggtcagtg

SEQ ID NO: 86229 - DNA, 2027 bp, Homo sapiens
cggcacttcgggaggccaaggtgggtggatcacttgaggccaggagtttaagaccagctggccaacatggcaaacccctgtctctactaaaaatgcaaaaattagccaggcgtggtggtgcccgcctgtagtcccagctactcaggaggctgaggcacaattgcttgaacccaggaggcggaggctgcagtgagccgagatcacaccactgtactccagcctgggcaacagagtgagcctctgtctcaaaaaaaaaaaagagagaaagagaaagtcacaacattttgaacaatgtcaaatgtcattgctctttagcgttccaaaatgacaatttgaaacattaggatataaaagtttggtatgattggttaattactttatagtcatgccctatctttgatttgttagacttcccatgctttaaatcttgatatacgtagggcctttaaaatggtcaactaaaaagtcaccattcctctacgttttttcgtgacttgatttgtaaaacacagaatgggattactgttttgccatgcatctgtatttagcagatgattactagataataattataattttttatgttataaaaaagaaagtatataaactcaaaaaagctcacttttttgtctaaattgtttttgctcttatacaatagaatacatatttaagttgtatttttatttgcatttaataatttattaattaaatgtatttctttgtcagatttcaaatgattgaggtgacttgtaagaatttgttttatgccctgttgctgatcaaatcattggtcttccctatagctccttacaaaattatgcaatcagtgttccatttggagtaaacatttagtgtcttatcttgatagagtaattggctacatttctctttctatgcatgaagttgtgtaaaaggaccaattcacatgtataattggcagagagcatgaattctggacttaacattttatcccattctcactacttactaattttatgacactggacaagttatttagcttctcagcctcagtttcctcatctgaaaaaatgaggacaatatctacttccaggtttataaatagttatatatattttaaaagcactgtgcacaatagcacatatcaggcatttaagaataaatgtttgtttcctttcctgttcttatttccacatattggtagtttgagactaagttaataactttttaggcagtcaccctaaacatgactttcaagagttattttaggattagtctgccttttactttagtaagtactgtattctctccattgccaggaggaatatttgaaaaaggaaggaatgatttgaacattgtaaatagctaactgaatatagtgtcttgaggacatatttttggtaactgtgtttaacatctccataaaagtgttttttatttatcttcaatcacaggtacgggaaccttaaagatagattttgttggagagctgaatgacaaaatgaaaggtttctatagaagtaagtatactaccccttctggagaggtgcgctatgctgctgtaacacagtttgaggtatgggttattcttctctaaaatattattattcttaaattaggcattctgacaaaggtgtgtttattatgtggggtgattatttgaggctaggtgcccttggccatgattgtattcacaattttagaatttttattttatatttagccattatctctatagaaaggagggaattaagggtatgggttggggaatgattatatacagttatacacacagacattcaaacacacgacacattttgatacctgaattgcctatatactgtgtacctttcttaaaatcattctcttagtatttgacacctatggcttttcctacagtattattagctgttttctagaattcctttccttctttgacatcttttgtttatcttactgtagtatctgtgctgtctttgattttttttctctctctctgtgtgtgtgtgtgtgtgtgtgtgtgtgtgtatacatatatatatatacac

SEQ ID NO: 86230 - DNA, 1035 bp, Homo sapiens
cagtggtgcaatctcggctcaccacagcctccacctcgtgggttccagtgattctcctgcctcagcctcctgggtagctgagattacaggcacacaccaccacgcccagctgatttttgtatttttagtagagttggggtttcaccatgttggccaggctggtctcgaactccggaccttaggtgatgtgcccacttcggcctctcaaagtgctagggattacaggcgtgtgccactgtgcccggccagaagagaaactcaaaaagacaggaacatttccttgaactgatagagcaggagccttcagtttgcaaaggtacaccattgagagagactagcttaaaaaatgtaaaaattgccacactgactgaaattttagaacttctgcgataaagtaaaactcccagaaagttcctgtctgggatagggggcaataggagggaaggcaggtagcatactacctttaaaatttaggaatcagaatagtcctagacttaccattaggaacagtggaaacttagactctaatgaagctgttcattcaaaatacaaagtgaatctgattttcaacctaagattgcatgcttagcccaactttgaatttcggagtaaaaatattttcagatttgcaaggtcatagaaaatttgattctttgtaaaagatattggagtgggggatggattagctaaagcatgactttctacagtgaagagaaaatgtctaaagttgaaaaatgaagaaataggccgtggtcgtggctcatgcctgtaatcccaacactttgggaggctgaggtgggaggattgcttgcccaggaattgaaggctgcagtgagccgtgattgtaccactgccctcgagcctgggcgacagagcaagactgtctcaaagaaaggaaaagaaaaaatagctgtgtaagcaagacatttagaagtcacagagtttgaaattgattgcttctaggggcagggtgtggggagtagggcctagtgttgagcagggcctggagcttacgtattttaaactgtgaactat

SEQ ID NO: 86231 - DNA, 1071 bp, Homo sapiens
tgcagtgaaccgagatcatgccactgcactccagcctgggtgatagagtgggactctgtctaaaacaaacgaacaaaatacttttacctagctccatcttctattaattcaatccaaatccctgaagtgaatggtcacagatgattttgatatacaaccagagatcaaataggtattgtgttattgagggcacagaaagaaagatacgttgatatgttactattgttaggtataaaagcacaaagaaatagactttctgagcttagtatatgtggaagaaattatataccaatcaattggtgaagtactaagactttgatgaatgaacaaatgaaaaggaacagataattcaaaaggaagaaaatgtaaatgactaataaacatgtgaaaagatattgagcctcctagtaatgagaaatttttgcttctcatgtgagctgaaatttaaaaaattcccaatgatatggctgccttgatatcgctggggggagtataaatccatgtaatttttttgtaaagcattctggcagtatatcaagagcctaaatatgttcatgtcctttgacccagcaattctgctaataggaatatatcccaaggaaaagtcataaatacagaaaatactttatgcccagaagtgtctgagatattacttacggtagtaaaaaattataattaatatatttgttcaacactaaggaaatgatcaagccaggaatgatatatctatatagtgaaatatacttagcaattaaaagtgaggtttgcgaattcttaaccctgtaaagtgcttattataatgtaaaattgaaaagaagaatataaaattacatatttaaggtggtgaatcatgtctctaaatggcacaaataaaatgataattatgtctgggtgttgacataattggtgatttttattcttatttatatcttttgtctgattttcacaattttcctactgagaatctattgaattaatataaaattatttttagaaaaaatttaaattggagatgtttagtcttttatttcagtgctcttggaggccctttatgtgtaattattataaaaa

SEQ ID NO: 86232 - DNA, 1033 bp, Homo sapiens
gatgactacatatgaggcactaagtgctaaaacagagactttacatagattatcccattattggtcaactttttaaataagtgcatctctaatataagacaagatgctgaccaatttttaaaatgtgaatggatttctatttttaagataagtacctttgttcctttggttcctccctcccacccttccagaaatggtagtatcctggaaaaaaaaaattagtagcaattcaagaaacagcttaattcattagtataaatagatgagtttcccctaaacacaggaggagttggaaggtacttgaaattggatgttgtgcatggtgcctttccaaaatgcacaaatactttctctcaaatggttgcagtagtaatgtgctgtgtgatttggcatgtataatgttgtacaggtatcttgacattggtggattaactgcttggctactgtgaaattcactgtagatgttgatggatgaaagtgtggttgcctaggtaatgattaagaccagtaactaaaccacagttattattttgctggcataaacttcaaactcagaaaggtttttattcattttacccattggagcataccccagtaagtgcttcatttctttgtgtttctgattttttttttttttaagatggagtcttgcttttgtcgcccaggttggagtgcaatggcgcgatttcggctcactgcaacctccacctcctgggttcaagcgattctcctgcctcagcctcccgagtagctgggattacaggtgcctgccaccacgcccagctaatctttgtatttttagtagagatggggtttcaccatgttagccaggctggtctcgaacccctgacctcgtgatccacccaccttggcctcccaaagttctgggattacaggcatgagctgccgtgcccagccatgtttctgaatttttaagtcaacttctgaataggcaaagaattctttttgtttttttgttcaactttagtgctataaatcgccagttggacacaaaggttttagtgctatttag

SEQ ID NO: 86233 - DNA, 1022 bp, Homo sapiens
gatttaaaaattagttgtcttggccgggcacggtggctcacacctgtaatcccagcactctgggaggccgaggcgggcggatcacgaggtcaggagatcgagaccatcctggctaacatggtgaaaccccatctctactaaaatacaaaaaattagctgggcgtggtggcgggagcctgtagtcccagctactcaggagcctgaggcaggagaatggcgtgaatctgggaggcggagcttgcagtgagctgagattgcgccactgcactccagcctgggcgacacagcaagactctgtctcaaaaaaaaaaaaaaaaaaaaattagttgtctttcacattagtgtggtctagctggttttgaaaatttgttattatacagaagtttctctaggcccaaaatttatttcattccctgtcccctccctttacactggatacttgagagcagtggacttttgtagatatttcatattttgatcctctccgtttgtggataattaattaaaatgaattataagtttatgtgtgtgactactatttatgattatgagtgtgtagtggttggtacaataattgggtattcttttttttttttttttttttgagatggagtcttgctctgtcacccaggctggagtgcagtggtgcgatcttggctcactgcagcctctgcctcccgggttcaagcaattctcctgcctcagcctcctgagtagctgggactacaggcacgcgccgccatgcctggctgatttttttgtatttttagtggagatggggtttcaccatattagccaggatggtcttgatctcctgacctcattccatcttcctcggcctcccacagtgttgggattacaggcgtgagccaccgtgcccagctgggctttctcttatggaaatactttacctgtgccagagaaactaagtttatcattcaaggccagaaatcaggatatcctagccaacccctggcctctactaacaaaatattcatgttggagataactaaattggcact

SEQ ID NO: 86234 - DNA, 1046 bp, Homo sapiens
aagaagctggctgggcgcagtggctcatgcctgtaatcccagcacttagggaggctgaggcgggcgcacttgaggtcaggagttcgagaccagcctgaccaacatggtgaaacccccgtctctactaaaaatacaaaaattatcggggcgtggtggcgggcccctgtaatctcagctactcgggaggctaaggcaggagaatcacttgaacccggggggcagaggttgcagagtcgagatcgcgccactgcattcctgcattccagcctgggcgacagagtgagactccgtctcaaaaaaaaaaaaaaaaaaaaaggaaagaaagaagctattagttataacataccaccggtgaaaatattccattactcttcactgcagtttttggtgaatcatactcccctccctcctcccgcagcattatctgaagtattgtttgattttggagaccatcagtatagatgcccgacaaacatcctgcacaataggcatttatgatactatgtaacaggaagcctgtaataaaaatgggaactgtttgatagttatctgtaaacagaatgttagtaaatatattttgtttcatttcttttcctactgcagtctggggtcgggggaaatcagtaggctcccaccttaaagaacatggtgtatatagtaatgaaatgaagtgaagactggtgctcgaatgaattgaatgttggtagttgtctttgaaaaccaagagggtacggtactcagattaaaaatatgtctaaaagtacagaatttaaaagtatagttatctatactttatacttatctgtgatagataactatagctgtcacatttggggcattggtgtgaaagcaagagggctctaggatttggcagcatcaaaaggcagaacttagtgaaaatcaggtgatttaaaatttttccattaagaatatgaatcagaacgaatgcatcttgggtctaaattagaatttgagaaggttatttgggaaactgtggcttaagccaagtgactagagtgtttgatatatattggcaaggggcagat

SEQ ID NO: 86235 - DNA, 1072 bp, Homo sapiens
tctcaaaaaaaaaaaaaaaaaaaaaacctttaataatctaggttacttcaaccaatgagatctggacttttgagggagtgatttcaaaaactatatttttgtttccatgatttaatgtttaaaatgggatgtttcgggcggtcgcggtggctcacgcctgtaatcccagcactttgggaggccgaggcgggcggatcacaaggttaggagttcaacaccagcctggccaatatggtgaaaccccgtctctactaaaaatacaaaaaaaaaaaatagccgggcttggtggcgggcgcctgttgtcccagctattcgggaggctgaggtaggagaatcgcttgaacccgggaggtggaggttgcagtgagccgagattgcgccactgcactccagcctgggcgacagagtgagactctgtctcaaaaaaaaaaaaataaataaataataaaataaaatgggatgtttcaccttttccccattttcatctttgtttctttttaaactaaaagatccttcagcaatcatggcctctttaatggtgaactatctgtggctctctcagttctgtagataccttgcaaattgaggaggtatatatataaatgcatatatatatatatatatatatatatatatatatagtaactgaaattatctttaaaaaggggggccagggccaggtacggtggctcacacctgtaatcccagcactttgggaggctgaggcaggtggatcacgaggtcaggagttcgagaccagcctggccaatatggtgaaaccctatctctactaaaaatacaaaaattagcctggcatagtgtcatgtgcctgtagtcccagctactagggaggctgaggcaggagaatcgcttgaacccgggaggcggaggttgcagcgagccaagatcacgccactacactccagcctgggctacaacgagactctgtctcaaaaaaaaaaaaaacagtgggcccaggtgtggtgacgtgtgcctatgatcccagctactcgggaggctgagacgggaggatcacttgagcccaggaggtggatggaggctgcagtgagct

SEQ ID NO: 86236 - DNA, 1056 bp, Homo sapiens
ctgcaagctccgcctcccaggttcaagccattctccttcctcagcctcgcgagtagctgggactacaggcacccgccaccaagcccagctaatttttcgtatttttagtagagacagggtttcaccgtgttagccaggatggtctcgatctcctgacatcgtgatccgcccgcctcggcctcccagagtgctgggattacaggcgtgagccaccgcgcctggccctaactctccagttgtattttattatagttcgtctgtttctcagcttctcaaaatgttattttcattatgtctgttaaagcaaatttaattcataaccatttaaggctctccatgaactgtccttatcattttcccagacttgttttttcttatcctttaacatatattctccagtcttaacaagctaaccagtttaatgcttggcccttacagcttgctcattcttctcttctctaccattgctcaggcattattgctggtatgacctcctcatctttttcggcaaaccggggcccctcccttccttcaacactcaccttttccagaaagtcctcattgactaactccacccaactctcttttcccatcagttcacaagtactggcttttgctgatttatttgtacttgttctgactgttactctgtaattatgttgttgtttttgttttattctggtttttttctgagatggagttttgcttttgttgcccaggctggagtgcaatggcacaatctcggctcactgcaacctccgcctcctgggttcaagcgattgtcctgcctcagcctcctgagtagctggaattacaggcatgcgccaccatgtctggctaattttttgtatttttagtagagatggggtttctccatgttggtcaggctgatctcaaactcccgacctcaggtgatctgcccgcttcggcctcccaaagtgctaggattacaggcgtgagccaccgtgcccggcctataattgtgtttaaatttattttatatgtgtatcttcgcaagatgtactactagtaagagcttgtttcctaattccttta

SEQ ID NO: 86237 - DNA, 1029 bp, Homo sapiens
ctgcatttcagtgcaaacccatctgtggaatggagataatttcgcagatgggtacactgaaatgcagagaacttacctcatagaggggttgtgaacgtaagtaaaatcatatatggaaacaggtaactcggtagattgtaggtgcctaaaaccgtttttgcactggcctattataaactgggaattgagatgttgaggagagaaagatggatttgcaggcactgagtacctccaaacaagagacgtgaccttttgtcattttgctcttaaggcttgcaggtttccaggctagcgctgcagggcatgccccagccttatccttcagctgtgttctatcatctgcaacagcccagccatgtcgttctgcccttttcccatcctgatttctctggaggtgagtttagtttctacttcctactcgcctcctggatgaaaagtctcatgtacggtgttttgccctgtgctttctgaagtgtcacatctccacctagctctgctctgcccttttcctctcatctctccaacagtcacttctggggtggaatgtgccatctgtttctgaaactgagcagaagtttgggaaagggggagggacagccgtgtccagggcttgcgtgtcagcagacacgttacagctgctgcagggcaaaccagggtgaaaccacaagccagaggacccagggcaggcagccgtgaggcccgcccctcggcttctctctcatctgtctcacccagaggtttcctggcaggagtgggagaggttggtatcgagtccttgagccctgactcattccctgacctagttgggtggtacccagttatctcctaaatctctctccagggccctctgttagcaacacaacagtatcatcctagacagaagacgcgggaggaaagcagactacctatttatctcattcccttctgagggtcccaacaacaaccaggaggtttacaggttacattgcttataaaatgaccaaaatcatcccatagagctacactaagagattggctactttccagatt

SEQ ID NO: 86238 - DNA, 1342 bp, Homo sapiens
tgggattacagacagcaccaccatgcccagctttttttttttttgagatggagtctcgctctgtgacccaggctggaatgcggtggtgcgatctctgctcactgcaacctctgcctcctgggttcaagcgattcttgtgcctcagcctccggagtagctgggattactggtgtgcaccaccatgcccagcttatttttggatttttagtatagatggggtttcaccctgttggctaggctggtctcaaactcctgacctcaagtgatctacctgcctcggcctcccaaagtgctgggattacagacgtgagccaccgcgcctggcctattttgactcttgagcatttgtaagaaacccgttttttctgtttttagtgcatatcagatgttatctttgattctagaattctgaaatttcactatgagaagtcttagtctttctttagagtgcttaatttaagagggagaaggttgaatttccaggacttgacacattaaaaaatcaattattggccgggcgtggtagctcacgcctgtaatcccaggactttgggaggccgaggcgggcggatcctgaggtcaggagatcgagaccatcctggctaacacggtgaaaccccgtctctactaaaaatacaaaaatttagccgcgtgtggtcgcgggcgcctgtagtgccagctactcaggaggctgaggcaggagaatggcgtgaacctgggaggcagagcttgcagtgagccgagatcatgccactgcactccagcctgggtgacagagcgagactcaaaaaaagaaaaaaaaaaaaaaagctaaacagttattgagtaagtggatggacatgaatggaggtcagtgtaggctgtgaattatggaattgtaagacctttagaagtaatactcaggcttaattttacagaatccggaggataaaagactatgatgccaactttaaaataaaggacttccctgaaaaagctaaggatatctttattgaagctcacctttgtctaaataagtaagtgaactccctatctttacccattctgttctcagcagttagctattattttaggcacagtttttttgtttgtttgtttttgttttgcacaaatttgttttctgccttcaggtaagagatctagagtgagagaacttcctatattggaagtaattagtgactgacgctgtctttcactcccctctctgcttctgggaatttctaccatttggtctgtctcagttccacctgcaagtgttgggaccttgtgccagaatagctgcctttttcaccctatctgatccctgaattcattctgatcttttttgtgtgtttgtcttacg

SEQ ID NO: 86239 - DNA, 1303 bp, Homo sapiens
ccctcactcctcagccataagagcagcaggctgctgtttgtccataacgaccagaccctgtggtggaggcagagttaacccacagagtgggcctaagagtctggagcacaggtctgtgctatacacagccaaagaaagtgagctggagtattctgggagggcgtcttggaggttgggattaacaggattgaagtgggacctaaatcctggagagggcaggagagggcagaatgccccctcgtcctaagcgtatcagggttggggctgaggtgaaacgccagtgagaaggcaaagcagaagaggcaactcctgcctgcagtaatgacctgcgcccctatcccgccccaggtttgtgctggttccctctctgcacccggactggaccctcctcctcttcttcttccacacccacagcacagtcaccaccacgctggctctgatcttcatccctaaggtgaggccctcccctcctgcctgtgaggtggaccccagcccctctgtcagggccactgtggagcggttgtcccgcagcgccctctgcaggccagggtgaggacgacagaaggtgctgggtgagtgagcacagtgccaggggccctaagctaggagctgacttgagtggggacactctctgcttccagttcctgggcaagggaaagaaaacccagggctggaggggctccctcctgcagctggaaggttggcacactctgaaaatctactcagaagcaggtatacagggagaggtgggagagctgaaggacccggctaggaattgcagggtcaggggcttagaaccaccctgctgtctgagctagagaaggtcagggaggatgaggggagtaaaactctaaagatccccagaattccaagtcagagaagggggtgaagcgtcacaaagtaaggacgcattccacagggcaggtgagtgcaggagtggacaaggagccagggcgagtctttttcccactcttatgcgcccctgccagttctggaagctgggggctcctccccgggaggagatggtggatgaggtgtgtgaggacgagctggacctgcagcactcaggctcctaccttggcagcagcatcgcctcagcctggagtgagcacagcctggaccctggagacattcgggtatgtgccaccctccctgcctcctttcaatgctagcttttaggaactgggcagagggaggactgggccctgccacctgggctatgtgccactgcaagtcctcttccctccaagacctgccctctcccttctccactggcctaaactgattcccctgactctattca

SEQ ID NO: 86240 - DNA, 1034 bp, Homo sapiens
aaaaacttaatgtgttgtctgtagccgttacattatgaatagcacaaaaattgagtaaatattcttccagtatttgaaaccgttttctgactcagcaaagaagttgctcccatcattgacaatccaattaagttttgtctttttcagttttatcaaccaacattcacctttacaattacactcctaggtcaactgcaatcacagtttggctacccatataagagtttggcaaaaatcaatgaaagcattctgtgagaaagagttatatggaatttgccaatttactattaattgtaaattgtgaactacacatcctttatgtcagtaaaacttaacgacaaatttttgtacctatatatgtgcatacattcccgttctccccccagagagctggttgttacacatttatcagtacagcactgggtctagaacacgattcatgtactgattccacaaacattcactgggtgccaggcggacggagatacagattaatgatgaaatgactcagccaaggtcacacatcgcaagcggcgtagatggcagaaccatatgtgctcccaaggccagcggcgcgctcccaggaccagaccatggtttccaaggcctctccactctaccgaatgggatggcctgggcctgggcgcccaggaagtgaaaagcaaggaccgggaaaagagaccaacgccagccaacagacagctcaccgccaataggggccgggggcgcgcgcggcgtcactcgccgtggaggccagcgcgagcacgccctggggaaagtggcgtggctaagcccttccggaagtgacgtcggcttgggggcggtgctcggcggtggcggagcgcggcctgggctcgcgctgggctccgcgcgccccccgcccccctctatgaggcagaggccgcggcggccgttagcgctgtcgctccgggggccgcggcgggcggggctccggcggggcccggcctagtccccaccccagcccggctcccagccgcccgccctccctccctctccccgatgcaggaggccga

SEQ ID NO: 86241 - DNA, 1046 bp, Homo sapiens
aaatacaaaaaattaggcgggagtggtcccagctactcgggaggctgaggcaggaggatcacttgagcccaggaggcggaggttgcagtgaatagtgatcgtgccactgcactccagcttgcgtgacagagtgagagcctgtctcgagaaaatagctttgcgctctctcaaagccttttgagaattctaagtaccagtaagatatagacaaggtagagacaggtacatgagttctaggccgattgatgaaaattccaaacatagacgttgagtttttttcctgcatttctgaggggtggactgatcttcggcatccagtgttacatctgtagcgttggtttacaaagctgtcaactttggtgtcagtgaaattagttaccttgtagtaactgccattgtggtttgtacttctttgggttctcagaaagattggaatgggttttgttgtggtttacgtgatggattcttgagacatactggcagccataaaccaaagctaaagaacaggtataaattgataaccttactgtgaactaagatcacttggggagctttttgaaaagcctaagagtttgaactttttaaaagctccccagttgatcctgaactgggaaccactcatccatagacttctgttttcaagggaacttgggtactccaacaagaaaatgttgggtggatttggctttcttgccctttctgaacagctgtgccatgggcttatcttggggatgaggccaaatccaaactttctaaagaaatcagtgtgttgtccctttaggtaggccagtgtttctgctttgcctcccagtgaattcatgctgggagttcagatcttgaaaagtgggtggctgctgaaacagctttttttgtggtaggctctgtattcgatgctccacttaccagcacagatgaaattttcatcagatgcaggggagggcgggattaaagctatgggtaatgacataggatagattgctaattttcttgtggtttgtcttgcctttgttccatattgaccaggagttcgtctgagattccagaga

SEQ ID NO: 86242 - DNA, 1105 bp, Homo sapiens
gtgttgcccaggctggtctcgaactcctgagctcaggcagtccgcccaccgcagtctcccaaagtgctgggattacaggcgtgagccaccacgcccagctgactccatctctttaaaaagaaagaaagaaagaaagaaagaaatgggcccagcaactaatcaggtttctgttctggggaactgggctagggcttataacacacatatgttggaattcaaagagctgggcttgatgcctgtggtcctcagtgtaatctagcattgctatttcaggaaaaccagtggagttcccatgtctgtttctcatatgttgagttgattgccttcctttggatttggtgagagatctaatttgatctgaccattttgaatcatcacgtaatacacacttggttggaaataggtaccttgttcacttttcaagatttgttttttaccaagttaacagatgaggctattactggctgtcttcatggtagtgaggtggagaaatggaggacggttctgtagtggtttcctatctatttatttgggggggaaaaaaacaaaatatagaattctggaaagagaggcaggctgctttggcatccatttggggccctgctgtcgtggacaggcctggcagacgtgagaaacttttttcactgtatccttgggtcttcaggtctaaagggatctttttgagtaatagcatgacatgctgagagcaaaatgattttatggtgtggcgaggaagttctgattttatgtttgggttttgggtccacacactgttgatctttttaactattttttccatgaagtggttgtggttggcagctctcctttagaacgaactcctgggcttaaaaaaaaatctctgtccatttgagtcctgtgcagtgcttctcactccttaacattctctctgccaacatcatttctaaggttttagaccttggaccatgcctcttggcttttccctggaagttccctctataggttctttagttggtttatgatggagttttggatctgaccttgctgcacagatgtctgtgtattggaactaaaaatgaacacatggtttttgtgcctgtagcacatgaacagacactggcttatg

SEQ ID NO: 86243 - DNA, 1048 bp, Homo sapiens
gaagtgaagttatctttggtatattaaccaaaagatctgggttttcagactggttccctgaaacagcatcaagaagtcatggggagggctgtgtgagtggcagctcagagagacgaatgggccctcttggatgctaggcagagcccctaatctgaggaggcccacttagtagctgatggctttgacccatgccttggggcaattgtgcagaaatcagaggtcttcaaggttgaagactgcacatgcatcctgcagtgctattctcaggtcagaatctgttccttggttcactttgggatgacctatcctataggcaagcccagagggaaactttgctctgagctggtgcctgtccaggttaagagcccttttcttggctcccagatggaaattagctctgcatcagacttccttcctcttgaaatggacttgctaattaccactcaaggtgttttactcttttaatgtactgggtatggtgagctccaaagggatttctcattgctttgtaggttggtgaattctgtagccaaatctatttaaggaattgccttaattatttcattctccccctttattttatgctgtattacaagagtgttgctgacaacgactagggtttgctttatttctcagtgcatctggaactgagtgttgtggtgacttaaatgcatatgtgttcatttctcccctctattctctctctgctttctcactccctaggaaacccaagttgacaagaactcaaagtgccttttctccggtctccttcagccccctgttcacaggtaagggtaatatctttctctcttctgacatctgaaaacaggggcgttctgagacctgttgggaaacacttacagatgcatcacagggagctgtaggcgtgtctgcagttatttccttcattccatgcttagtgggtttggggtgaggctatttttatggtatggaatgtgttcttgactttggatgctttatagttggaggtaaaggctgcttgttggtaattaggtggcctgggtggccctagcagttatgcagtgct

SEQ ID NO: 86244 - DNA, 1041 bp, Homo sapiens
ttgccagcttacagtacccaaggaataaaatgaatgaaatcagcattcttttctacttgcctggcaaaatcattactcttcctgggcaagtaagcgagtcactatttccaaggctgccttatcggcacttcacttcgaggtgggagaagttggaatcgctctaggctggtgaagcccctgaagtagtcaccttagtaaggttagtgagcagctcccctccccctttcttggggtcaagtgcccccacccatccttcacagcttacacaagcccacacagctttttgttccagcccatccagctctttgccactgctttggcttctaccctttccagcttagcttctaatgccttgccctcttcagttagcatcctctgtttttgggggagggtctatttgtggttgggagcagtgagggtaaacaagtgaccaccactgtcttgccctgcagatgcatttccccggattgctcccatccgagcagctgaatccctgcacagccaacccccacagcacctccagtgtcccctctaccggcctgactcgagcagctttgcagccagccttcgagagttggagaaggtaggtggtacctaaggactggcaggtcacttctcctcccattagctaaattctgtattcggacacacctttatttatgtgtttatttatttttagagacagggtctggctctgttgcccaggctagggtgtggtggcataatcatagctcactgtaggctcaaactcctgggccaaaggatccttctgcctcagcctcctgagtagctaggactgcaggcatgcacgaccaagcccagctaaaatttatttatattttttgtagagactggtcttgcagtttcccaggctggtcttgaactcctgggctcaacgtgatcctcttgcctctgcctcccaaagctctaggattataggcgtaagccaccacacccagcccctgtttattgttttcagaggaagaatagtttacttgcttccatatttacagtgacaaaacagtgtgctcctgctattag

SEQ ID NO: 86245 - DNA, 1039 bp, Homo sapiens
aggagttgactctgcttagcagtttttaaagtttatggctttttggggggtttttatttaacaaacatttattttgtaacttaattatcaaaaataagctacctttctgccttcagagaagtcatagtctaaaagaagggacaggaaggaagacaaaggtcagagcacatgttcaagtcagtataaagcatgtggtggtaaccagcaagagtagggtagtcagctctgcctgtggacaagcccgggaaatctcaaagaagattctggactctggaacatcactctatttgtagaatattgagaaaacttcgtggaatattggactcctcagatacagcttatttcattgtacaaatgtaccctgtctgcagatattttaaccaagattcttagcattgtattaagggctagagtgtgtagtgtttgcaactgttaatattgagtgcctgttaaatgccaggtacttggccaggctctttatttaaatatattgacatttttacaacaacctcaaagttaggtaatatagatcaatctattaaaataatatggctgggctcggtggctcacgcctgtaatcccatcactttgggagtccgaggtgggtggatcacctgaggtcaggagtttgagaccagcctgaccaacgtggtgaaacctcgcctctactaaaaatacaaaattagccaggtgtggtggtgcacgcctgtaatcctagctactctggaggctgaggcaggagaatcgcttaaaacccaggaggctgaggttgcagtgagctgagattgtgccactacactctagcctgggcccccaagcaagactctgtctcaaaaaaaaaaaaataataataataatgataatgatgtgtccaacatggtgaaaccacacctctactaaaaatacaaaaattagccaggcatggtggcgggcacctgtagtcccagctacctgggaggctgaggcaggagaatcacttgaacctgggaggtggaggttgcagtcagccaagattaagccactgcacttcagtctgggt

SEQ ID NO: 86246 - DNA, 1486 bp, Homo sapiens
ggccactgcactccagcctgggtgacagaacgagaccctgtctcaaaaaacaaaacaaaagacacacaaaaaagtgatgctagggaggcctttggcagagaatggatttccttaattgtgaatgtggtggtggtgcttctggaaatggaaatcaacagcactttgtggaggggcttttgcacagaatacatatatgaaccataaagaagtcccatttcccctccctaggttctcttcatacaagaaatggtagttagctccattgtttcctctgaatactttcctttgttttctttcttgaaggactgccaccaactcctgtccagctgctctatccagtgtcccgattcagcaatgtcaaatccctccagcacctttgcagattccggatacgacagctcgtcaggatagatcacatcccagatctcccactgcctaagtacaatggggttgtcaggtttgggacaggaatgagtaagggggttgtggggaggtaacaatgtcagtgaggcctgcaagctaccttcacaggcagagtctggcataaaatatttgcagatgtcattcttacacatttcctgtgtcttagcacctaactctagaactgtcatattgcagccagagggaggaaggtgtgtgtgtcagccttccttctgcagtctctaggaagaatagagtagaagtggtaagagtaaggaagacagaactataataactgagaaaatggggattgtgttaggtctcaaccatgtagggagtgaagaagagttgaacaaaggagttacttcttttatattttgtataaaaaccttttgtgtatatccgtcatttgtttttcacagacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggtatgagctctctgcctcactgcccagccacatttcttcctgggcagtcatcatcatgcattgagccttgggccccctccccacaactcccaacatggatagccccgatccaggcatttgcccatagaatgacaagatctgaccgtggagtcctcaaggggcacacaccccatttgggagaaaagcagacagacgagaaagacatgaaagtagattgccaggaaacgtgcaagctaatcactgaatgtgagcaaggagggggacacccaagtgtagctaagagtgcggcctctggcaaggagagggtaattgaaaaaaataagaagaagagtgcagcctcctctcatacagacttgggctgatctccctgatactgcacaaatggcatataaagcaggaagctaaagggaaaggaaacttcatcaaagagaatgcaaacatgcctttaattgcaacaggcatgcacttcagtgagactccaccatgtcccaca

SEQ ID NO: 86247 - DNA, 1056 bp, Homo sapiens
ggaaacttgcaccattacctgactgtggaagggtggcccacaagatgagctgtgcaccataaacacagcccacctctgatttgtcatgtggtacctcttctttccttggcttccatggtagtattaccaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccgaggggttatgatggtgaggtggagcccaaagcccaaaggagtcagcaaggctcctgcccattgccagggcctcactatggtcagctcaggccatgtgagggaggcagagcctccgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagagga

SEQ ID NO: 86248 - DNA, 1045 bp, Homo sapiens
gaggaacaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcac

SEQ ID NO: 86249 - DNA, 1110 bp, Homo sapiens
gttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaaga

SEQ ID NO: 86250 - DNA, 1027 bp, Homo sapiens
gggacgtcctccactaaggcgtccggacaccccctccccgcgccacactcgccccctgccgggtcggactgcgggacgggttgccaggcgcggttccgccgccctcctggatcctggggaagttctagacacaggcccaggaccccgggctctgccggcgaggctgccctcccctctgccctctccgaccggctgtgggtgggtcagagcgcggggtgccaggggcattactcagcgctgggctgctctgcctgggttctttcatctgccagctgctgaggctggggaggggccagcaggggcctcccagccccatccccccatcagggccattcccttacctctgagcctggctgcccgccctgcaggagccccccagcaggcctccctgctcctaagttgaagggttgaacactgtcaggccaacagtttccctgagctcggaaaagaaattccccggggtccaggttgaggtcaaggccagggctgaggcctgttcctctttagacagggctgaaagacttggggaccctcctccccagctttcccggcagtgttgaaggtgggatctggtgcttgcaactcttttggagactggtgtgttccttggttgctggatgtgtgttcagttctccctcaatctgcatctctccccgactcccttcagccaaagtgtgtttcctaattatgaacttgaaattcaggatggacggggggtgggggtggaggtcatgaatccaagcatgagtcccttggattcaatcccccaccagcaacacatacttcatctctatcccctgcacccctctctgtctccaccccaaccctgcggcctagctgggggtgagtggcttttgatcccatgtggttctcccctctgccagggcaacagaccccattccccaaagtgacagctctcactgccatgtgctccttggcatgcgatttgaatctcgattatataaccagtcatttcgcctccaaaggcagcccaaaggcccccggccccagcggcttcttccacttg

SEQ ID NO: 86251 - DNA, 1120 bp, Homo sapiens
acttcattgttttagcctcggctttcttttattcttttgaggcagggtcttgttctgttgctcaggctgaagtgcagtggtgtgagcttggtacactgcagccttgaactcctgggatcaagtgagcctccctcctcagcctcctgagtagttgagactacaggtgcatgccaccatgcccagctaatttttccattttgtattttttatagagacagggttttgccatgttgcccaggctggtctcaaaattcctggactcaagtgatcctcccactttggcctcccaaagtgcggggattacaggtgtgagccaccacacctggctggttttcttatccctgaaataatccctcaaaattacagagagggctaaatgaggtagtattggtaaagtggctgagatttagtaatctcaattattggtagcaactattattaaaaaaaatcaatggatagaaatgagaacaatgcacttttgcctcagtaaaaagtactgacctttatggtcagagcaatctaaagagaaagtgacctgcctctggaggtaatgaggcccccatcactggaggtgcagtgaggtctgggcaagcacaggctggagaatgatgtgcactagagagaattcagcaaaggcttggcacaggaaactttaagggccctgccttgggatcagcactatatgataggaaattagaggagcaggtgaatcctacttcctactgtggggcattgaggagagcaggcagagatgtccccagcctctgggaacatcaggggttggctgctatggtttggactgtgaggctccccagaggataggtagtcctgagaggctgcctggaggaggcctgcaagggtgggtatggttctgataggtgggaaaatgtgggattgtattctaggcccaggaagggcttggtggccgagggacagagaggagcctgggccactggtcctgaggttggccccggggttgcgtcatcatcctcgtgcctcagtctcctgggctgctgggattacaggtgtgccactacacctggctaattttttttatttttttagagacaaggtttcggcatgttggctggcatgttggccaggctggtctcgaactcct

SEQ ID NO: 86252 - DNA, 1848 bp, Homo sapiens
tggctcttgctccccagaggcccctggtggacacccaggcccccaggttattcaaggcagagtgccttctctggcagccttcctgctctgccactggggctttcgctgggcagccataggacactcctgcatccccatccagaggccgtgatgagggaggagcccgctgacctagagcggcccatttctctgttagcttagagttagcagcacttaggagcagagaaactttgttggggtgcaatgcgatttgtgcccaccctaggggcctcggacctctgcttggagtccctgagcctggggaagggaggaggtgggggatgtgagtattaggtgtcttgctgggtctgcgggagtgggcatccctgtgaggagggcgtctgactctgccacatgtcttcagaactgttatggcctcttgtatggcgccctttcctctgtctcgtgacttgtgtgtgctgcacatgtgtgtgtgagaatctgcctcccccactggacagggagctctggaaggacaagggctgtgcttgttcatcctttttttttcttttgagatggagtcttgctctgtcacccaggctggagtgcagtggtgctatccgggctcactgcaacctccacctcccgggttcaagcaattcttctgcctcagcctcctgagtagctgggattacaggtgcccgccaccgcgcccggctaatttttttattttttagtagagacagggtttcaccatgttggccaggctggtcttgaactcctgacctcatgatctgtctcggcctcccaaagtgctgggattacaggcgtgaaccaccgcacccggccttttttttttttttttttttttgagacagtgtcttactttgtcacccaggctggagtgcagtggcacaatcccggcttaccacaacctctgcctcccaggttcaagtgtttctcctgcctcagcctcctgagtagctgggattacaggcatgcgtgccaccacacacagctaatttttgtatttttagtagagacagagattcaccatattggccaggctggtctcgaactcctgacctcaagtgatccacccgccttggcctcccaaagtactgggattacaggcgtgagctaccgtgcctggcctgttcatcctttttagtgtagtttttagcacatgaagaggacacaggaggtgtttacggagtgactctttgtatgtccccataggttttctttctcccaggtctgtgtcctcctgttgggttctgtgcctccatggacctgtccagtgtcctcgtggatgtttgagcctgtgcatgtttgtgaccggacgagtgcaatcattctctgagtgtgtgtcccctgtgtgtgtagctgtgcatgggtgtgaccttccccagccacccccagctaacctggctgatgcccactaggaccctccccccggtaccgcctggagcccatggacaccatctttgtcaagaatgtgaaggaagacggccctgcccatagggcggggcttcgcacaggtgagctggcccagttacctgggctctactttctaccttctggctaggattttattctcagatccaggtgttggggaggctcctgtccccacagtgttagccatgcctggtacaggggttctcagatggggcctttgatgccctttggtcaccactcatgcgctccttgtccccaggagaccggctggtaaaggtgaatggggaaagcgtcattgggaagacctactctcaggtcatagctctgatccagaataggtgagtgtccctgacccctcgtcccatattatctcccctcccctttgccctggggatgccctggagaccagga

SEQ ID NO: 86253 - DNA, 1049 bp, Homo sapiens
ggggcaaggagtgggaagggcagtagcctcaagttctgctgcccaggctggggtgggctggcagcgccagatgacagcatctgggggcctccactggcccccgcatctctgccagccggagggtggggcccaggcattcctgtggttggaagccaaggctggaggccaatcgggcctcggcagctgctgacgccaccaccgacgcggcgaggcccctccacacccatcctctcctccctcctcctcccgccagccagccgagagagagtcgggtgggggtgagggggagccgcagggagggcagacggagggggaccggaggccctggccagggcaacacagtggtcagtgggggggttagccggagctgggggtgggcggaggcgggctgggatgctgccgccgccgtgatgatgccgggagcctggggagacggcgggatggcaggagggagaggtatgtgtgtgccggccctgtgccagctggagggggctgagtgtgcgggggtgtggtttagcttgtcctcatcacatgatgtttgtgcctgggactggaggtgtagttatttgtgtgtgtttcattgtgttttactgtgtgtgtgtgtgtctctgggtgtgtatcttccagtgtctcctcgtagtgtggtgtgtgtgtgtgtttggtttcaccctcccaccctttggttctttgccttgagttaggctcctgggcagctcagcaggggccaggctgggcccaggccacaaggccgctgtccctgggagctgactccttttttggctgggcctgggcgctggccctgtcactccttagcaatgcagcgtcagcctcagctcccagtgccaaattccaggcccaggggtggcagaaggtggctcaagtcccctccttcaagcctggcaggaggtgggcaaactccttctcacccctgtggctcaggagccagctccccattcccggggatggagggacagctgggctctgccagcctctgccccacccagacacacccctagccggctttcttctctcatctgccaccttgactg

SEQ ID NO: 86254 - DNA, 1031 bp, Homo sapiens
gggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattggtgagtgatggtacatgtggctgtcctggaggacttagctgtcggctgtctgtgtcctgctgtaccccatctgcctgtctgccatgggcagaattcggctgggtgctggtgggatcatcttgtttctctgtcaattcattcatctgttcatccatccatccatctgttcttccatctttctttctgttctctgtcatcctttcttccatcctacctctcattcatttatcctttcagcatctttccatgcactctttcttttttccctctccccatccatccatccatccatcatctgttcttccttccttctttccttcctctctccctcctttgttcattcatttgttccatccattcatccatctatccatccatctattcttccttctttccttcctctctccctccttcttttgttcattcatttgttccatcctttcttccacccattcatccatctttctttcctttgactcttccttccattctcccattcttccttccatcttccctttgtatctttccctctttgtcctttccatccaccctccatccctccatcgactcaacagatatttgtgtcaggccctgtgcatggctccatgc

SEQ ID NO: 86255 - DNA, 1053 bp, Homo sapiens
caagggtctcattagtcactggggttggcttttgagagcagagggaaccctctaaggcttgccttgccttcgactggatgcaggagagggagaggcaagagagtagagtggctgggtgatgcccaggtttctggccgggcttgggggtggtgcctcacccccgtgttgggagtgagagggggacaaagttcaggactgttgaatatgaggtgtccaagagggagcaggatagacggggctggggagaaagagcaagatgcagggtaatggagagggatggtggtagatgggagatgagctcaccctaccagacagtgagagggaggaggcctggggcagggggaagacacagccctggctcccccagccagccttcggtggagcagagacacagccccttctgctagtaaggaaggctctaggctgtggccgggagaggcagtctcttcttccacagcgcagtctgtttgagggggagatgtcatctctgcccttgaggagccccagctgatgggggagcttttgcccttaggaagctctcagtctgatggggaagacactgcccctgccctcaggaggctcttggtctgagaggggagacataattcattctctctgagtgccctcagtctgatgagggagacaccgtccctgccctcagcaggctcccagtctgatgggggaatattggctctgtcctctggagcccggtctaaggagggtggctcagccccactcctgagggtaaggattccatggccacagtctggacagtgggccagtcatgcttgacagtgggcatgttgccagcaggaccctttgggatgtgtctgagcctggaggcgagtggcacgggggctggcaaggctagggtggaggcaggcaggctccgctgtctgctgccttcacacctttctccttccacatgcatagatgagcccaccagccccagcattgacctccaagccaagcacgtccctgcctctgctgtggtctccagtgccatgaactcagcccctgtcctgggcaccagcccatcttccccgaccttca

SEQ ID NO: 86256 - DNA, 1060 bp, Homo sapiens
ctggcttctcctttatgtacgtctcatgacctcaacacaagtggtccagagaggacaagcaatgcccatgaggtcgcacagcacatcggggtgtagcacagacatatatcaggcctgtgcggccacaagtggtccatggggttcctgagatgctggcattgtgggagccaccctaaattgtcctctgttgtctccctgcagtccttggatagctggggcacctctgaagatgctgacgctccttctaagcgacactcaacctctgacctctcagatgcgaccttcagcgatatcaggagagaaggctggttgtattataagcagattctcaccaagaaggggaaggtaagatgggtggaggaatgaggtggaagctggctccagcagaaccctccagcctctcctaggcctaccctgacagcctctggagccagagagaaccagtgtaggttgttgcatgaaggatggaggttagatgctaggaagaacttcctggcagggggatttaaagaacttatgtaaaagaagttaacaagagaggtggattttgctgtgggatggatctgatcgagtcatgcttggaatattctggcaaaaccatcccacacgggccctggcttgacaggccatcctgaagatggccgctggggctcatggaaaacaaggagcaaggccggggtgatttccgtaggagagctaaggcccaagaagacgcaggcaagccagcaaagggcttagtgttcatcctaagggcaaccaaaagctctcgggggctcttgccaagggagttacagctttaaaatattcatttggctccctgggagtgagttagggaggggccatgctggaggcaagaagaccaattaggagccaccgtggagatccagatgagaggcgaagggggcttcggggagtagttggggagggcctgggagggaaccagcaggactctgagaggagaagggcagggcccctggatccatggggtgcaaatcctggccccaggctgcgctgtgggctggagaagtgggaggagagaccactgccttccctcctggcg

SEQ ID NO: 86257 - DNA, 1085 bp, Homo sapiens
atttgggcctcctcctctgggggcctctcttggctgtccccaacaaggcttagtcaggggatcccaagtcaccatcactatggcagtagcagtccctcctggggcacctcctccatgcctgctcagtgtctgccaggacggtggcgagtgctgcatgattctgcacccggccctgagccttccctgttagccccccatgtttattaccgaggagactgaggctcagagaggctaagaggcttccccaaggcctcagctggtgagagggtgctggggagtccaggcctggtctttctcactccagggtctgggctgtccacctggcaggtggacaagaggggaagcagggctagggatgagccctggggtgggctggctgtgggcactgacatgatccgctctctcctctcctgcttcaggaccccggctgtgccaaccaagctctgatcagcaagaagcttaacgattatcgcaaagtgaggtgaggcccagccctcgtggagcagtctcctctgtgggggtggtagggggctgaaggcaaaggatgtcttcctggcccacctccagggctgccctctgctgggggaaggggtatccagggtctccaggctgcagttaggcatggaggcattgcctcagggtggaggggaggtcccgaggggcgggaggccagggtgggtggcctgcttggccaccccaaatgaagacctctcctctccccctttttcctacacagccatagctctgggcccaaagctgattcctcccccaaaggctctcgcggcctggggggcctcaagtctgagttcctcaagcagagtgcggcacgtggcctcaggactcaggacctgcccgcagggagcaagggtaggaaggtggccactgagacagggtggtgtgtgggggcagggggcatggggaggggagggcacgcgtgtgtgtgttgggctgtgtctgctcatgtgtgcctgactgtgtgccagggctaccggtatgtctgtctgcgtgtgcatgcctgtgagggtctaggggctctcagggtctcggggtggaagggcctggagcctgattcccgtccctgacat

SEQ ID NO: 86258 - DNA, 1037 bp, Homo sapiens
cactgtgcttggcaaaaaaaattttttttaattagccaggtgtggtggtatgagcttatagtcccagccactcgggaggctggggagggaagattgcttgagcccaggaatttgaggctgcattgagctatgatcataccactgcactacagcctgagcgacagagactctatctctaaagaaacaaagttctatggcttccgccttgtagttttggcccacgagccacacggaagtccttgcattgctctgggcctctcctttggggtaagcatcctccccttcaggccttctctcttgccatacaatgtcccatcagccctgggcatctggtttcttctctgatggaatccccatacgtccaaatgtgtgaatgtggcagtgaatgtgtgtgaccctcctggataccccagctcactctggctctgtctcccccacttcagatgacagtgctgcagcccccaaaaccccctggggcatcaacatcatcaagaaaaataagaaggccgctccgagggcgtttggggtcaggctggaggagtgccagccagccacggagaaccaggtgagtctctgccacacgccagagcaggcccagcagggggagaccgaggcacagagggtcagagcagcaagggacatggaaccagctctccacctcattgtacaaacacagctgggaaaacagcccagagaggggaaggcccccgcctgccccgggcctcccagggagggagcagcagggctgaggctgagcccggctccttctcagaccatggcgaggctttggtgtcatttttagctcccagactggaggcagcaagggccttttgttccccccaagggttcctggcagcagctctgggccttgcattgtccccttcttggcctccccagctcctctggcccctgtcccccctaacacccctcccatgtgtccccagcgcgtccccttaatcgtggctgcatgctgtcgcattgtggaggcacgagggctggagtccacaggcatttaccgagtgcccggcaacaatgca

SEQ ID NO: 86259 - DNA, 1051 bp, Homo sapiens
ctcaggaaacctccaacgcctttctcctgtcatttccttttctgggctgagtacgtgacacccctgttgtcagtgtggcacccatgggtggcaggtggcgtggggcacactcggctgtcacagccatggacctggccaacactaatggcactggtgcctccctgccccccggctcgctgtggggagtataccacaggggtgtgcccaggacagtgtttagagaaaagcaagtaaaagcgaagctctccctaagcctatctcctgtctgaggtgaatgctcccactccctgccgtgtctcctcccacactggggtcccaccttttctctcccccagggtttttcatagtctgtggagtcaggttttagggtccgtcaagctccctctgagccctcttttgcagccccgccagcctggggtttgttgagagagaggcgccccttgccacctgagcgggtcctctggaatgagcaggtggaagagactcttctttcccatgctgatttcatcccttccttttgtcttctctgcagtcagactggttcttcagtgacgaagaggacaagggagagagagtaagtgatgccgcgggctgggctggcatgggggctggtctggggtgagccccagtccttgggggtggggcaggcagcgggacttaagccggggaaggtgtctgtccttgaggcttccctcaagtctggtggaggaaacacagaccctctcctcaggagcccctagtctgatagagaagcacaaagcttgccttcaggaatccccagtcgaaatgggggagatataggccttgctcagagggaacccagttcaggagtaaaggcagctcctgccctccaggctactgagaaggacttaggttggaggagttccagtctggtgcgggagacacagctcctgcccctagctgaaggggccgctctggccttcgcggttcccaggtgttgaggaaggcacaaaactgtctaataggggacatgtaggaatcatcctcaagagcgcccggctgatgagggagacggtccctgccccagtga

SEQ ID NO: 86260 - DNA, 1003 bp, Homo sapiens
ctggttttctcagaactaattaatgtgagagcaaggacagtggctgcagtggccacaagaggcatctgggtctccattcattattacaccatggctgaaacaagaggtggtctgtgaggaggggttgaaagggcagcgtgaccttgtcaggtcattccagcccaagacaggaaccagtcccagcgtctgcttctacaaggcttcctgtgttaaggggacttcattcaccaattgtttgttcatttcatgtttattgagcacctgttatgtgccatgcagaaacaaccaagtcacagcctttgctcttaaggagctcagagtttgatgaggctgatgtgagaagagctaggagcatagtgagatgacaggaacatagagaagtgatctcccatctcaggcaaagggagggctgggaagtggctgtacagaggaagccatgttcgagctgggccttgtagggtgagtaggagctcatccagcaaatagggcagggggacattaagggctggcagcaatgtaacagtgtaggtcacatcaaaggaagggttggtagggctgtatttccacagtgagggctgtgttggggttggggtcagggcagagcagggcagtaggctgggaaagttggggctgggttatgaagagccccatgtgctgaactggggaacttgtgctttatcctggtgggtgctggggcatgcaagcttctgagcaaagctgggtgaggatcagattcctgcttcagaatggtggctctggaggagagacccgggctggggcaagggtggaggcaggaaaccctattaggaggggcaggagggcccagagagggcagaatgagggcctgccggaggaggaggaggagttggctttgggagccatttcaaaagaatccaggacttggctgtgggtggaggagagagggaggagtcacaagaccgccctaaggtgagcagtgtgaatggaggcagtttggggcaggggtaggtaggatgctgtggtt

SEQ ID NO: 86261 - DNA, 1050 bp, Homo sapiens
ccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgtttt

SEQ ID NO: 86262 - DNA, 1014 bp, Homo sapiens
cacctctaactgatttcccaagacctgggggtggggagggaactttgtaaaatgcagatttgattgtctctgtgtgtgtcacacacacacacacacacacacacacacacacccctgccagcttaaaatccctgccccggcccctggcagatgatcaacccaaatccttcatgtgcggcccagggcccttcacagcagcctcagctcaccctgcccctgcacccacaccctcggtgtgctccagccatgcgggtcactggtgggacacgatccacactagctcagcctgtggccttggtcaaagccctctgtcttctcaggccctttcttcgtctgtacaatggggacagaagtatccagcctggtcctgagctcacataatgccaggtacaggagagagcttggaacaccacagtgagctctacggtggccggcgggggtggggattgggggggcggtgcccaaggcctctccttcatccagtgagtccaagctgtctttgataatgttgagatggaggggactagaagtgctgggatcagggacacagaaattgggagtaagaaagttctaagatggaggtgccttgcagcagtgcctgaccccacagagtagtcagaggaagtgactgaggagaagcccgtgaatgttgtgcttaagatcccagggagggacgggagccaggttcccaggcgtgcaaggatcaaggctttgtgtagacctgaagctatggacaccccctcttctattagggctaagaaatttgctgaacaactgcttatcttctcagatggctgaaatgaagatactttttttttttttttttttttttgagatggagtctcgctctgttgctcaggttggagtccagtggcgtgatctcggctcacggcaacctctgcctcccgggttcaagcgattctcctgcttcagcctcctgagtagctgggattacaggtgtgtgtcaacacgcccggctaatttttgtattttcagtagaggtggggtttcacc

SEQ ID NO: 86263 - DNA, 1017 bp, Homo sapiens
gggccgatgccatcccaggccaccctccccaagggtgccggggccacaggccagcacccccatcctccctagtgccccctcctccaaacctgcccccaccttctgctccccaggtgtttgagagaagctcagtgtcttccctcccccccacgccccgccgccagctgatccccaccttgctgtccccccaggacctggggccccccgggggctcagccccaggccctacacggaaggtaacggggctgctgccacttctcacagctctctctctgcctgtgcccccacagcttcctctcctcacctcccacgctaacccgctaaaacgccagtcaccatcccaagtcccaccatggccacagccactgccacagcattacatgtggactcacccctcccccactccaaggacaggcgcataacccttcctccccgctgcttgctggggggctccctgagactccagcagcctgggtgtctggtggccccttgtgtctgcattttctcacgggcttgctgatggaggcctgagtattttgttctggttcgcagtttgagcttaggtctggcccgaaggctgagtgtggccaagattggagtttggatcttgctcacaagatgactttggatccagctcaaaatctgaccttgtcctgagcccttgcctagcccccacctccatcttcgctgctctgctgcctgtgccggggaggggctctgtttttcccctagaatctatgccttgcgctgggggccaggacaccacaggggtaggctcgtctacagcctcactagcccaagggcctacgatgccctcttggacagagagcctggaatggaagaaagctatgccattccttggctgctggttcttttggcattgggaaattcttccttctctctaatgtcagtccttgctgctgtcctgctgcacttatttcctctttattctttcctgggaatttgggggtgaacctgctgtctgcaccctacccctggggactgtgcttggggagg

SEQ ID NO: 86264 - DNA, 1050 bp, Homo sapiens
ccgcatggctatggcttccatcatcccggaatggggacgggactggaatgaaggactcaagcgctggcatttgatagagcttctatggctgggacaggaagactaagttgatgatcgatccaaccctgttccaagcctgaatggcgggggtgggcaagatcttacccgttgcccagatggcaattctctgccccctccccagcctgtctctgctaattatcctcacctgacggcccctgggcctgcttgaggagcggactcggcgatgccaagctcctgacaggtgggaccatctgccaagcagggccggggagactgttggggctcaggagggaggagctgagaggacttgggggaagggctctcgctgactcagggaaagggatgcagggcaggaaggaactggaactgccccgagggatactgacgacggaggggctcagtgggtgactggggctccaggagggcgatggggactcagggaaggagaaggagggctcaatgagggggtcacgggcgagggataaggccttggtgaggaagtggaggttcagcgagggagcggaagctcaagaaaggggaaggggagaaagggttcggagagaggccagtgagcggcgaaggactcgggcgtggaagctctgggaaaaggatgaggtagtaggggatggggcgggacttgcggcaagggacttctaccagtaggtgggcgttggtggggcggggcccaggacggggcggtacctggagcttgcgcaactgctggagctggccgcgcaagtcactggcgctgttctgcaggcctcgcaggtgaagctgcatctgcagccggctaacggcggtaggctgacctgcgggggtgctgctggccgagggcgggggcgggccggacaccggggtggccccgctgctccggccgcctgacccacaggctgcagaggaccacgaggatgggagaaagtgaacaaactgtgagcctgggaaggactgggctgggacaaagtcctccctactctccgaccccacacagtagccagagaagcccgtggc

SEQ ID NO: 86265 - DNA, 1036 bp, Homo sapiens
gagggcccttgtcctagggctgagtgctgagttccaagggtctctaacctgcccctgcccctcttttcccctcctgggccccctcataaccatctcttctcttatttccatcagcagccaaactactggagtttcaaggtcagtgtgtgatgcctctgctcccatgacaactgcatgtgctctccctcccctgcccctgcctctcccttgcacaggctttgcaccggggtgcgcatctgcacggacaccttctggtatgggcggtgggcctcggggctgcaggctgtggctgctgctttgggagagtctgggttcgcctgtcaggggcttgtggatggagtaggagtttgggccacccctgctggggatctgggctagagatgctcagtccccaggcatccccagcccctgaggggcattttgaaatgacatacattttccccagcctggagagactgctgcctctgagttagggacttagacccttgttgtgggccctcttctttgaattcatatctcacctcccagggaggccctgtgactgtgatgggtcccccttccttttcttactgtccaccatgggggctggtccgtgctaggcaggagactcatggtcctacaccctcaagcctgttgtctaagtggagggctaagctgagggataggtgccttcttgcctcctcctgagctctggcctttccagagctaagacagctgtctgcccctcccagggtatcctgttgacccctgggagagcaccctcaggcacctgcttgcctcctggagtctctggcctcccaagtcccaggcatcatgacagcgggtgggaggcatcccacccagactccccaggtgtcttatttgcatgcattcttcctagcactgcaagaagtccttgaatcagagaatcatggagtcaaagtcacactgtcaagcatagcctctttggaggaggcagttgagggtagtggttaagcgcatggacccaagagccaggctgcgtagtggtgaattccatacagtctgctgctaacta

SEQ ID NO: 86266 - DNA, 1035 bp, Homo sapiens
tctctctctctttctctctctctccccctctcccccctcccttccctgtctctctccctcttccctctctctcgccagggacccaccctggaaaaagggtttaattagaaccattgattccttctttggctgtgggcatcgacagtgtggtcagagctagagggtgggggtggcatggctgccatctgcctatgccaaccttggaattctctgccaaaaccccagccctggaagtgcttaggagggaggcggctgggctctttgaagtacccagtttgttgagcccccacccccaccccaggttaggttttggggaaagaagggagacagtgttgaggatttgaactgagggagctgagtttggggctcaaggaagaacagttcatggcgtctgtcatcctgggtagcaggcctggggcacatgaagaggcagctgtggtggggggtgctcttgcaaaggggcctgtgggtgctgggcaggcagggagttcaggggaaggatccagggcttgccataaaagctgctctttcgaggaatctcaagcatttatctcctccaagccctggcaaggaaatctgttttctttcttcatttatgtccttgaggcccagagagggacacagactgcctcagaggcccagcagacttaggtctagctttaagcctggtttcctgacctagggacccctgcttgggcacaagctgctgagggtgagtctcctggtagctgaggctctggactctaggatttgtggggggtgggggacaggttgtgccccccaagtcctggctgcctgctgtgggtgggctggtgcaggtgcaggcttcaatgaggcactcagatgctctttgaagaatccctcactggcttcctagggcccattcgagcaaagataataaaaatctggccgtcagcgggtttgagggctgtactcgcttccccttctttcattccaagctctgagtagcggagatgaaggcttcggatttggctgggaagcagtgcctgccccgagggaggaagggagggaggc

SEQ ID NO: 86267 - DNA, 1033 bp, Homo sapiens
ggcaggggagggcgcccccagctggggagggcatctagggtgagtgagaagatagggaaggcaggcggctgaggggtggagggtggggctgggaaggggacgcaccgtggccccccctcccctcccacgcacccccctgctacgtcagaagctcccgggccagctccgagtcctgtcggtgggggcagcaggatgctggtggaagcagaggggacaggccgggtgcctccgcagctcagctgtcagggcccggcggggcgtgtgcggctgctggtgctcgtcccccagccccacgcgtccccatgcagccctggcagtgcctccggcgctttgccctggcctggtgggagaggacggcggagggcagagcccgctctcccagggaggaggctggaccgagggaccctgggggccgaggggagccaggtgagcaggcgcggggaagtatgcaaggagggggatcttcccagcccccctcctcaaatgttgtgggacaaggaggtcctgcagcaccccaactttaaggaaagtgggctccccgagctgggggtgggggtttctggcagcagcctttcaaaaggagatggaggagctgctgtctgttttggggaagggagaaacaggtgaggcttgggagtgagggaagctgaccagacttccaggtttgtgggcctgaatgttcctttgggtggggtttgagcacttttggggggtcgtcaggataccttcttcccgactcttggtatcttggtctgggtgaccttgagccaactgctttgctgtctaattccttgcctcagtttctcttattcccatccctttccctcttgttgatctttaaaaattgatgatgcatttgatggagattgtgaggctgtcgccactggtggcagctgtgatggtggtggtttctggtgtggttgtatgtggggagcagctatggtgcatttgaggggttttgctggttctggttggtgatgggccactccatacaggtgtcagggacatgggaaggaacattcacacaggaagg

SEQ ID NO: 86268 - DNA, 1004 bp, Homo sapiens
gtgagccgagatcccgccactgcactccagcctgggtgacagagcgagactccatctcaaaaaaaaaaaaaaattgtttacagagtctccctatgtttcccaggctggtctcgaactcctggcctcaagcaatcctcccacctctgcctcccaaagtgctagaattacaggagtgagccactgcacctggccaatttgaatggggagctggatgacgctccccatccagcctggtactgctgaagaatccaaccctaactccactcctgcccacacatctccaggctgacctagtttctgtttcaaggcaggggggacacatgttacacactcctagacacagagctgtgcagagccaagagatgcacacgcatgcacgtgggatagacgaatgcaggagatcgcacactcgaggccggtgcacacacatgcatatccagagactccttcctgactcacgaacaaacccaaggaccccctccagcagacacacagacagagctccctgttcacagggccacacagacacacatggacctcataagccataggcgtgattccccacaggggttccctactctctatccagctcctgctcccaggtccccactctctggggcacaaaaacagcaaaggcagtcctgctgccacactaccagggccatgggatcaaggatcaccgcaaccctgggaatggatccccagtctcccctcttctctccataagctcctgtcttttggaactgcagtgcttatttccccaggacaagtctctctgtgggagggaccaagggtggaggacacttcacttccctacttcccttctggtttttttgtttgttttgagactgtcgcccaggctggattgcagtggagtgatctcagctcactgcaacctccgcctcctgggttaagcgattctcctgcctcagccttccgagtagctgggactataggagtgcatcaccacgcctggctactttttgtatttttaatagaggcgg

SEQ ID NO: 86269 - DNA, 1584 bp, Homo sapiens
ggtcatttagagcacaaactcaaaggacacaattccgtagctgtatgggcttaacctctgtgaaccccagttttctcatctgcaaaatggagctaatagtaccacggttgggcgcggtggctcacacccgtaatcccagcacattgggaggccaaggtgggcagatcatttgaggtcaggagttcgagaccagcctggccaacatagtgaaaccccgtctctactaaaaaatacaaaaattagccaggcatggtggcccacgcctgtagtcccagctactagggaggttgaggcatgagaatcacttgaacccagaaggtggaggttgcagtgagccaagattgcgccacggcattccagcttgggcaacagagtgagactctgtctcaaaaataaataaataaataaataaataaataaataaataaataaataaataatagtacctacctcatgttgtgtcctgaggattacatgagcaactaagcataatataacaaggcctggttccaaggaaatgccattacagtgcttgctatgataaccactcaggaggaaacctagtcagacagaccagagctactttgctcctccactggctgtgtgacctcaggcaagttaattaacctctctgagtcccatttcctcatctgctaaacaaatagtacttatctattgctatgaaagcaaaataatgcctgtaaaacacctgacacctgcttaagttccttgtgtgcagagaccacgtcttgcacatcgatccccctcagggctctcactccatggcctgggagaatgaatcccttccccagccacccttctctggctcgccatcctctttctggtgctagcagacagcagcatctagtggacaagctctggaactgcattctggccaagggtcactcgccaagctgctgtgcagtcatttaaatgaggctttttaaaaatgctttagacaagggtggaggggtcaggaggaacggaggtggggtgaaatgcattgggcaagtattcattaggtgcctgctgtgtgcaaggcactgatccaggaccttaaaaaatgaagcaagagatacaagatcactgtagaaggacacaagaaaaatcacaaataattataactttgtcatcaataccctaactttttatcttagagaaaatgtgaacacagcatagggggacttggcacactggacagtgtcttctcaggaagtgttttttgtttttgtttttgagacagggtctcgttttgtcacccaggctggagtgcagtggagtgatcacagctcactgcagccttgatctccctgaagtggctgagcaatcgtcccacttcagcctccagagtagttgggactacaggtgcacgccaccacacccagcttgttttttgtttttgtttgtttgtttgtttttggtagcatcaagttctccctatgttgtccaggctggctcaaactcctgggctcaagtgattctccccgccttggcctcccaaagtgctgggattacagacacaagctaccttgccagccttctcaggaagtttttacaattgcaggggcgatttttttttgaaat

SEQ ID NO: 86270 - DNA, 2217 bp, Homo sapiens
ggcctgaagcacctctgggcaccgaccgggcggcccggcgttcctaacaccgccgccggcgaggatgcggacgtcgcagcgtgcccccgccgcggagaggaggaagagggcggaggcggtttcccgcacttcggcgttcgctcctgtgcacctccgggccgctgccctgcgcccccgcaccctcgggaatctacgaccagcttcgcctcggccccgcctcgcccggccccgggtctcgagcctcagcgtggcccagccgccagcccgcctcaggaacccagttcccggcctccgtcgccacctgcgggcctctccaccgagcccgcgggtcccgggacggcgccgcggccgttcctgcccggccagcctgccgaagtcgatggaaaccccccgccggccgcccccgaggctccagcggccagcccctcgacggccagcccggctccggccgcacccggagatctccgccaggaacatttcgatcgtctgatccgccggtcgaaactttggtgttacgcgaagggcttcgccttggacactccgagtttgcgccgggggccagagcggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacagtgatcttcattcaagcacctaagttttcggggtgacagtccctccccctcatcctttgcagaggaacccagggctggagtcgggagaaggctgatgacatagattccaatccctgcctccttccatctcggaccgttggaggcagggcctgcaccccagtgggagcaaaggaggccaccgctcaaagacacccccccacccaaaaaaaaggggagaagagagagacctcggtgatggacaaaccggttgttactgtgtctgtgggcgagcctggggtgcggggctgtggtgggggtggggagatgattggcagctccctgggggcatcccccacccccactgtccaggcctttaaccctttgctcccctcaggccttccctaacgctccaagcaccgctggagcctttaatgggtgagggaacttgggtaagaggaagatcacccccttcctgtcccctttctaggccccctcaagtgcaggtgacccttaattggtgagatcttcagcctcagccgccgacctttcccttttgtccagttttggagttcccgttttttccttgtttgctttccgagtgtaaggtctggccggtgagaaagatttcccccaaccttgattaatcagccccctcccccaacttacttcccttaggacgggtagggctgagggacctcctctcctggaaagtgcttactttgcctggggaaggggctagacactgtcccagggaaagtaatagaaggtggaagaaatcaataaaatcagaccaaacaagtcgcctttcgagggcctccaccgatttatggatgagagggggtggaggtggaaggcaggcccaagtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccaggggaggggtgagataggcctggatcatgccctctgccatgccctccagctaggaggatcttgagtcagagagg

SEQ ID NO: 86271 - DNA, 1037 bp, Homo sapiens
ggtgtccaaagaatggacttgggcctgccttccacctccaccccctctcatccataaatcggtggaggccctcgaaaggcgacttgtttggtctgattttattgatttcttccaccttctattactttccctgggacagtgtctagccccttccccaggcaaagtaagcactttccaggagaggaggtccctcagccctacccgtcctaagggaagtaagttgggggagggggctgattaatcaaggttgggggaaatctttctcaccggccagaccttacactcggaaagcaaacaaggaaaaaacgggaactccaaaactggacaaaagggaaaggtcggcggctgaggctgaagatctcaccaattaagggtcacctgcacttgagggggcctagaaaggggacaggaagggggtgatcttcctcttacccaagttccctcacccattaaaggctccagcggtgcttggagcgttagggaaggcctgaggggagcaaagggttaaaggcctggacagtgggggtgggggatgcccccagggagctgccaatcatctccccacccccaccacagccccgcaccccaggctcgcccacagacacagtaacaaccggtttgtccatcaccgaggtctctctcttctccccttttttttgggtgggggggtgtctttgagcggtggcctcctttgctcccactggggtgcaggccctgcctccaacggtccgagatggaaggaggcagggattggaatctatgtcatcagccttctcccgactccagccctgggttcctctgcaaaggatgagggggagggactgtcaccccgaaaacttaggtgcttgaatgaagatcactgttatttaggtccctctgcccacagctcctaaaatgtaaaggaaggggacaaatgtgagaaacggggctccctcctcaagcccgcggtttggccatggtcccaacttttcccctttggcagaagtcccacggtcagctttcatccatgttgatcccccagaatttgaggccagggg

SEQ ID NO: 86272 - DNA, 1029 bp, Homo sapiens
gagaattgcttgaacccaggaggcggaggttgcagtgagctgagatcacaccactgcactctagcctgggtgacagagcgagactccatctcaaaaaaaaaaaaaggtgggatgttaagaaggatgttcagatgaaccccatccaccaaatccatcccctaggctgtacctctgggagtcctcccctgtcttgcctggtgcagcctagggtatttggtggacggggctatctgtacactgaacagtagaacccaggagcggggcagggtgatggagctggtaacaaactgctttggatgtgctgacgttgggtgcctatggcagtaggcagttgactatttgtgtctggattagcagagagggtgagagggagagccggatgtcctgagcagcaggagagtttatgttatagaagtcaaggacatttaaggaggaagcagtgctagggtcacatgccattgagaggtcgagggaaggaagggttctacaaggaggaggtccctggtgacctcagcctggaaggttccaggcactggtggtggtggacgctgactgcagtgggccaaacatgaattgggaggggagaagggaggaaatcatggattgggaggaaagggaggaaatagtggagaatagcactgggggatgggaggatcaggaggcaaggaacttggaggcaaggatggacacctgtgatgatgatgatgatgataatagcaacgataacagcaacagctcctattcgatgagagtttattatgtgccaagcaatgtgctaagcatgtaacatactccctgcaacaagattgagataggttctattcttgttcccattttccagagctactctagtcccagccctgccccagccagcagtgtgaccttgggcaaagcggttaccctctctggtatttggtcaggtgaccagatcttgaaagtccccttggtgttaacattctgtaggttgatgactgtgctcctgtggaaatttctagggcgaggaaagagcagtaggtgcaaaagtaggat

SEQ ID NO: 86273 - DNA, 1002 bp, Homo sapiens
agaagagggaggcttggagtttcccccagcagcacatggttcgggagttaactccttgaggaatcttgccgagggcgcaggctggcatctcccgcctgcctggcacaggcagccgggcccccccttcctgggacatccctgaatgctgtggcccggggctcttcccgccacgctcctctcggttcccagcaccgcacctgccctcagccttgacttttaacctgattctggaatacttagaggtagaagatgaggtccctagaccccctacttctccgcctcgtccctcactggccctttaagaaatccccccgcccacaacaacaaaacgtgtttgacggtcgtgactgttgtcccctctggttttctctatttctgatgctgatggctggtccgaggaagaagctgggaaacaagtccagaaagggcgtggggggaggatcttctagaagtttaaggtcaaagactcagacttcccgccctgtttgaagtgcttaattgtgtggttgaaggctggtgttgggcggttgggcagtcctgctgtagagtgagtgacccgtagactggggagcagcccccactgctggaactggctctagtcctttggagtcaccgccttcccccagttaccctgggaaaaagccactggctgacagctttgctcagcgactgtcctccccaccctcagcttgctatggcatcgttcaggtgccaacgggaccctggttctgccggaaatgtgaatctcaggagcgagcagccagggtggtgagttccagactgcccctctccactcccctgcccctcccacacacctgagcgtctcaggttgagctaggggactctgaggccgaggctagggtgggatttagctctgtcacacagacttcctgtttcctgcacacctacctccaacctcatctctgcctcacgctcatccctccctctgccccacctcaggcatggggctttggtttttgtctgtttgaacttttttattat

SEQ ID NO: 86274 - DNA, 1212 bp, Homo sapiens
cgccgtgtcccctaccagttccctcccatctatgggttcctccaacgctctcttcatccggtgtaatttgattctgtccaacgagcactgaaagggaacttgggaggtgggtaggtacctaccagtgaaccacccttctgttgacagacacactcatgctctggcactcaggtgaaatagtaggctcccctgcagtagttctgccagagggtagaccttcgcagttacttcattcattcattcgctggacacattttattaagtgcctactatgtgccagacctggtgcaaggtagctggcacacgctgttcggtgctgatcaagacaggtgtgctgcccgctcaatggaacgcaagttcttgcatgcgaagactataaatatcagtaaaaaggcaaagtaaatgcaatttgtgataaatgctgtgaagaaaataagacactaaaataaagacctggtgggggcttactttagaccagatggtaaaggaaggagacatttaggctgagacctggggcgtgagaaggagccagcttccaggagggtaagggcccccaggttccaggcagaagaaagcctgggcagaggcacagaggtgggcataagctccctagtgagcaagacagacaaaggccttggcctttcagagctaaccatccaaggactgtgctacccagcatagtagccatcggccacacgtggctacataaattaatcaaaattaaaagcaggctgggtgtggtggctcacacctgtaatcccagactttgggaggctgaggggggtggatcacctaaggtcaggagtttgagaccggcctggtcaacatgatgagaccccatctctagaaaaatacaaaaattagctgggcatggtggtgggcacctgcagtcccagctactcgggaggttgaggcaggagaatccctggaacccaggaggcggaggaggttgcagtgagccgagatcgtgccactgcactccaacctgggcgacagagggagactccgtctcaaataaataaataaaaataaacaacaattaaatacagtttagaatctagttcctcagtcacgctagccatagttcaagtgcttatagcccatgtgactggtggcatttgtcttggacggcgcagaccatagagcgttttcatcactgcagacagttctgtgggatagcactgatctaagactgtagagagcaaatggaat

SEQ ID NO: 86275 - DNA, 2079 bp, Homo sapiens
gtcctggcgaccagcgcatgagcgggtcagtcagctgtggtaagatggttagagggcatgggctctgggccaggccagtgcctggtgctaggaggacagagagggaaaaaacccagtccctgcccaagaggagctcttcattcgatgaggaataaagtacagcttcaggtgtgtggatcagagctagaccaagcagtctgtcccaaaagacaaagctcagaccctgcctgtcagagtctaggaggcttcaaggaagaggtagcatttaagctgagtggaggtggaaatcaaagtaagagccaacatttgtgtgggaggcagcatttactacgcctccgccttaggacaaagttcctgccatgtgttattttgtgtggtccccccaccaaccctaagaactaggtgtgctatattttccccattttacagatgagtaaactaaggctcactgaggtcatataacttatcttgcagctggtagatgggatttagaacgggcagcctaatttgaaaactcctcaggagcctgccaaacagagaaacgagtcccaggcagagggactagcgtggacaaagtcctgagaggaggaagggcatgggtgagcagcgggagaatggggtgtttggtggggaagaggcaggagatgaagtgagaaagcagagcccgagctgggcttgcctctgccccaggcttcaggggtccagggggaggctggaaagggtgctactctgtgtctgtgtttgtggagagacgtgtgtcccagaagctgtgaggtattctggagcagttggctgcagcttggatctacccccgagccacaggcttgtcaggcctgtaagcgggagagtaacatgatcagatttgttttttaggaagattaccctggcagccgctgtgaggctagatcagaagggctgaggctggtggccgggagacagctgcaagaagggggatggaggggtgaggctggatgctagaaccatttctagggagacttgcctaatcgtgggagtggctgagaagtaggagttgggggtgacatttaggatctaggctctagacactgggtaaatggagcttgaatacctggggggtgccatgaacaaggggtacagctggcttctgtagggggaacacatgtcctgatttgccccagacagtcccagtttatacctgttgccctggtgtaattattattagttcccctgtttcatttttgaaagtgtccaggtttggatcataagttacgtggtcaccgtggtttcagggtttgatgatagcttaggacaaggtagcgagcttggcttggtttgcaggagacaccatgtggagacatttagatttggtggatgtcagactcctgggcagggtgtagtggcagctccaggcttataaggctggggccgtaatcccaggttgtccacaaggatggatcaggcgggccacgaaagagggggccttgcagggtatggggctctgcaggtaggagctgtgtccaacactggggagctgcccactggtcagataaggcctgaaattagcccttgggtttggcagttgggaggtagctggtgaccttagagggagcagctataaccccggggagggtggagccatcaggctgggtctgtagtgaaggggatgggggaggcaggccctggctgggaggagacgcagcatgtgggttgtttgggttgtgttgatgtttaacttcccccctttcttcaagttaagggcagcatatcctttgggacaggagcaaccactgtgtttggtggaggggaggggccaggataaaggagaagagggtgatagctgagccaagtgtctggagggaggattggatatggagtgcaggggagcactggctccccacgagggtcccctgcacgccctctgctccagggaaggaggtagaaacgggccgtggctcagtcagccaagagggcaccatggagagaatgaaagacccgggccccagtctcacctccacctgggccttgctggggcccagacgcatccttgcctcttctgggcctcagtggttgactctgcacattgggcgagccagctggaac

SEQ ID NO: 86276 - DNA, 1308 bp, Homo sapiens
tcccacacggggacttggagactcacaaacatggctcaaaaagccatcatgaggtgcccttaaggtcttggccctgccttcttccttcctctgaggccactgagggcaggagggggctgaaatgaaacggtgggggggtgaggcgggagcttggcttccctgtggctgtgttagtggttcctctgggtcctccccatgacatcacagtgtcccccaggccccagacacatggctctgcacgttgcacacgtctccgcagtccagccatgtgccgcctagtaagtgctcatgcctgcattccctcgcgccacatagcacagcgtgcccagctcctgtccctctgtgcagctgtgtcccaggtggacacccttgcaggtgttatgttcacgcgcgtggtgctctatagcactggcgtgataatgggacaggctatttttagcaggcggggccgggggaagggctgttggctctcataggaacttgcctgaatcgctcctgcccagcccattatccagccctcctcagggagagatggtgcccacaaaaccccatccctaagggggtgtcagctccccatacccacatgtcatgtttgtcctcgcccagacagccccccagcacaatatctagtcacctctccctctccagagtcgaaaggacaaagaacgccttaagcagaagcacaagaagcggcctgagtcgccccccagcatcctcaccccgcccgtggtccccactgctgacaaggtactgctgcccaccttcaggagggatggtgtgtgggtctggggtggcagagggagggaggcgggggcgagaggttggtgagtcagggacctgggcaccctccccacagcttcaagttaatgccactcccctcctaccccataccctctactccttcttccagcctagaaggggccaccaatcaccgaccaaccatgggattgggagtttggggtgctgtctgccagatactcccatctgcctctgtccagagggcctcagccctgggctcttgtctgcagagagtgggggacggcactcaggcctgctctccaagttctagggcccctgtccccagagatcggtagaggacatcccctacgccccatcaggaggacacccaaagcttgtcacccaacccaaatcccactctgtgcaggttggaggggctgaaagttctgaccaaggtggcatggggggcaggcccctggacagtatcccgaaactcccactcatcccaccattcccagcagggcatggtatgtcaggcctgtctccagaaatgggcaacatctggctgag

SEQ ID NO: 86277 - DNA, 2001 bp, Homo sapiens
gaggttcaggtatcaggtttccagggtgatgttgctgtggcaactgccccagtaaacctctcccctgcttcccagggctcacctggagaccttgtcattcatgccctctgacctttccaggggcctgcaggcaggtggcaagaaatggccaggggtctgggagtttttccagtaactggatgtcccttggacatgccagagaactctgcccatcctcctccactcgccccagcacttcggctacccttccccccagcccctctcttcccttgctctcagaaccacatctggctcccttcagaactccagctgttgaaaagaacaaagaggaagacagagaccaggactccgcccgggaggggcagtgcagggtggctctcgtttctggtccagcctgcattcagcatttatctgttcagcacgattaactgaatacctggtcgctactaggaggaaaagggccttccctggcagcagcctgaagcacgaacgaactcacggcatgccaggctgtgttctagaaccaggagatggaggggcatatggagattagtccatttaatactcaaaataatccaattaggttggaaatttataaaccccatttaatatatgaagatgatggggcacagggaggttaagtaatttgcctaaaagcacacagctagtaaagtggtagacctgagattccaatgcagtctggcttgaaggcttgtgctcttcacctgcccacagcactgtctctgcagctgctgccactggacgtctcatcatttattgaccctataccatgtatctggcatcatgctgcttccaactcaccacatatgcatagtgctccctgtaaagacactgacacttatcgacgttgagactttgcacagtataacatggcagtgaggccaggcgtggtggctcacgcctgtagtcccagcactttgggagtccgaggcaggtggatcacctgaggtcaggggttcgagatcagcctggccaacatggtgaaaccctgcctctattaaaaatacacaaaattagccgggtgtggtggctggtgcctgtaatcccagctacttgggaggctgaggcaggagaatcacttgaacctgggaggtgattgaaggttgcagtgagccgagatcgcaccattgcactccagcctgtgcaacaagagtgaaactccatctcaaaaataaattaagaaaaaacaaaaacatggcggtgaagggcagaacccatcaggctcataccttgctctgcccgacttagagcccacgctccttcaaccaccaccctgccgctctctttggtttctggtgcctcagataggacagaacatttcagtgcagagtggcagctgttgacatgtggtcatgtgtgcacagttctctggaaataaggggacagaatgtcttgttccacctgaggtatttagggaggcttcagggaagagggacttccaagctggattttaaaggatgagagatttcccaggaagagtaaggataggctgtcctggcaaacgcttagtgtgtgcaatcaggttgtctaggaagagcatggggtggtcagagaatgggtggaaagccagggggccgaagtttggggtagtagctggagggctccaggatggcaccagagaagcccattctcctgtgggtcctcttctctgcctcgccacttccagcataggtcccgccttcttagacgccctaagtattcagtgaatgaatggaccaatgagtaaatctcttcagactctgggactgttttcatctccctcttggcttccatcttccctgcctaaggtgaaagacagacaccttcttgggttcagtgaattcccctctgccttacacccaggagtgccacagctgcctccccatatccctggtctaggagctcctggccactccctgcccggaagtccttcatgaaactagctgtgggctctcccagttgagctaggtcctgtgccctcctgcttcactcccacatcag

SEQ ID NO: 86278 - DNA, 1712 bp, Homo sapiens
ggccagtagggtgcgagttactctcccccattttattacaggtgggaaagctggaggggtcgggggtactcatcccaggacacagacagtggcagagctgagacaggaaaccaggcatccccattcgtggaccagagctctctcccgccagtacacgcgggagtgggagggagtgcggggatctggggtccagctgtaactgtttcccctctgtgcacagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggttagtgacccctggggacagagggcatttcagggcccagccagtctagtgaggaacagagcttacacatgcacttagaaggaaatgggatggataccactccaaaagatagagcacggaggagacagtcaccttcaggacatccccctctgcatgcgtggagtagaaaggattggggacagattgtcagaaggttttaccaagttttgggagggagattagaaaagctaggaattctgtagccctcggcagggcagtttaacaagcaggcgcagcaagcagatgtcacccaggcaggaagtgacatctttgcagcaagagggttagactggggcatgtagccagatcccggggagcactcgagctggggaggggctgtcagccacctggctgagcaggagtctggggtggagagtaaccacgtgcttccctctgtccttgtgcctgcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgagacctgactcctgggctcctccttccctgggcaggttggggacagactgacagaggaccccagccttccatgggaattggagcaactgggctgagttgccatcagaccaccctccgggctctggacccctctgctccccagcacacccggccccctgcaccccggtacacacagttgtgctctagatccaagaataaccgccaggggattctacctccctcccttaggtgttttctctggc

SEQ ID NO: 86279 - DNA, 2319 bp, Homo sapiens
gccccagccttgactctcggccaccccgggcctcacctcccatccctgccaggccacacgaccggccctggtccctcagcgccccacctttggccttcgtggcctccgggccccgaccttaccaaaccgcaacttccgcccttctctcctgacccgtgtggcctcgaccccagcctcaggctccgccccaggtcttcacacctgtggctccccaagtcccgcctctcttctcagagctcacctgtgtccctccttaggatggcgccgccttttcaagggctgagcactggctcccctccaggccccgcccccggtcccctggccccgcctccgccccctcgcccctccctcaggttcctcgctctctccgcagtcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaaggtgaggggatcctgcccagcccgggagagaggcccgtgccctgaagtccggactggccctgactgcagcctgtgacatccctcccacagccggcagcagcgactccttgagcaccagcaagagccctccgggaaagagcagcctcggcctggacaactcgctgtccacttcttctgaggtgggcgctacgaggagtggggcaggaaggagggggagactcaaggctctcctggtcccatctcttccccgcagctattggaggctgggcaatgaagtgactgactgagcaattgattgatccattcagtcctcccttaatcaagtaatatttatgaggtgcccacttagtgccagccattggctaagcaatcagtgagcaaaaccggcacagcgctgcttcttaagataggctaccccaagcaaagaaggagtaatcacaaactgggagatatgttagtgtggagagaaattgagggctgtgagagagagaacgggggagggctgcttctgtggatagaaagtggttagggaaggcctctttgagaagtatttgtgaagggtttattatagcgcctcacacaaaataattcctgtgtaactggtggcggttcgaatagcagttgctattgtgttgtggttattactggaatccaacaaactgggttcttgttctctctctgccatttattaactgtgtgacttgggcagtaataatcataataataaccagcattaattgcacacttgccctttgtcatgccctatgcaaaaattttttaaagcattcatttagtcttcatagtaagcctatggaataggtactactgttaccccccagcttacgagtgagtaaactaagacaggttgaacccaaggtcacccaagccattggattgtggacataggatttgaacctgagcctttcactttagctgtagtgcttttgcctgcagagttacttaacctgtgcaagaatcaatggcttcacccataaaatgagaatagcaagatagcacaggtcaagccctcagcccaggatctggttcaccagatggtcaccaccatcatcattgtccattattaaatgaggatgatgaggggcgctggactcccaggaaggggtcaggaaacatgattcgtgaagacaatttggattcttagccctcatccccggaccttgcttcttccagggtgcctgggggtgaagtgggggttgctgtgctctgtgagaatgctggtgggtgctgggccaggggccagaaaagtcatgctggccctctgacccctcccttccccctccctccccaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacaggtgagggagagctcagccctgggaaggggaacagggtggggggctggctctgggaagggagggattttccccaaaacacccacaatccct

SEQ ID NO: 86280 - DNA, 1033 bp, Homo sapiens
agcagcagagacatctccttcagcagcaagagcagcagctccagcaactccagcagctcctggcctccccgcagctgaccccggtaatgcccctcccttccctgcctcaggtgccccttggtctgcctggaagggcacatctcagaggatcagggccagccaggagagggcaggagcaggcagagtgaggggaagctctaggctgggcctgtgggactggggctgggccctgtggagcatccatggcaggtaagggggataagatcatgcccaggatcccctgggcattgagaaagggctgctgtaatagccccaggtcgcatcctggtgaaagactctggagggcagcaagtcctcagttattcagcatttcagtcccagccccaaaggcattcaggggaaactccagggtctgagtggctgtgcaggtgacaccaccctcaaccacagcagcttctttgggtctgtctcctgttgggtcggctgaaactacctttggagaaaaggagttttactttttaaaaatgagggaagcagccgggtgtggtggctcatgtctgtaatccaagcacggaagactgaggcaggcagatcgcttgagctcaggagtttgagatcagcctgggcaacttggtgaaactgagtctctacaaaaaattagctgggcgtggtggtgcacgcctgtagtcccagctacttgggagcctgaggcaggagaatcgcttgaactggggaggtggaggctgcagtgagctgagatggcgccaatacactccagcctgggtgacagaatgagaccctgtctcaaaaacaaaacagggagttgaaaaaataagaaaaatcaacattttcatataaagaaatattagacaggaaaccaattcagctggctgcctgtagggaccagatgggagcaagaggagtaagttcttaaggtaaactttgatatattattttggtttctgggacattaagaatgctttgcctattcaaagcaaaataaatgaatcttaaatgatagaagcaaacaaaa

SEQ ID NO: 86281 - DNA, 1030 bp, Homo sapiens
catgatatcggctcactgcaacctccgcctcccgggttcaagggattctcttgcctcagcctcccaagtagctgggattacaggtgcatgccaccatgcccagctaatttttgtatctttagtagagatggggtttcaccatgttggccaggctggtctcaaactcctgacctcaagtgatccaccggcctcagcctcccaaagtgctgggattataggcgtgagccaccgtgtccggcgaattgaaaactattgacctagtcagtagttttggcgaaaccccgtctctactaaaaatacaaaaattagccggatgtggtggcaggcccctgtaatccagctacctgggaggctgaggcaggagaatcgcttgaacccaggaggtggaggttgcagtcagccaatatcgcaccactgtactccagcctgggtgacagagcaagactccgtctcacaaaaagaaaagaaaagaaaagaaaactattgacctagtttagtgtttttcaacttgggggcgtctgtggttgtcttaggagctgaggggtgattctgtgggcagggccagagatattaaataccctgctgttggccggcagtgctgcagctggcaaataccaatggcgtgcaaccattttcttgtctagatggggagacccaggctaagtgggaaatgcgagacagtaccttgactgtctcacaggcctcttgcctcctgattccagtgtgatggggtggggcctggccaggcagggcaggcaggcagcagggaagagacccccgggactgttggccaacaagcggtctggcccccttgcaggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgctt

SEQ ID NO: 86282 - DNA, 1439 bp, Homo sapiens
atgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaa

SEQ ID NO: 86283 - DNA, 1099 bp, Homo sapiens
tgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgacca

SEQ ID NO: 86284 - DNA, 1069 bp, Homo sapiens
tggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttctggagcctgtagttctttggggtggagggaagaagggaagggtgcctctcatctctgggtttagcctggcttggggaccccatacagaatgaatctgaactgccctctcctgtggctggtcaggtgcccccagcccacagagaggttaaaatctggagcaggaggcagcacgtgggcctcatagcagtgactgcaggactaccagtctggttgggcaggcttgtttttgccatcttccccatcagcaaacattgaaccagggcccactcccgcctgccccagactggagacttttaggttataaggaataattcttccttcatgagccagcagtgggtaccagagtctcttgggctcagcacctgtttcctttcccacagaagggggtgcctgtcagaggcctggagccaaggccacctgtggctggacagcagcagccccctcagagtggggagcccacttctgccttctg

SEQ ID NO: 86285 - DNA, 2079 bp, Homo sapiens
ctaggcattggtgtttgttttttgttttgttttgttttttttgagacggagtctcgctctgtcgcccaggctggagttcaggggcactatctccgctcactgcaagctccgcctcccgggttcacgccattctcctgcctcagcctcccgagtagctgggactacagacacccgccaccacgcccagctaattttttgtatttttagtagagacggggtttcaccacgttagccaggatggtctcgatctcctgaccttgtgatccgcccgccttggcctcccaaagtgctgggattacaggcatgagccaccgcacccggccacattggtgttttttaaagctccctgggtgattccattttgcagctgggggtgagagccagagttccaggagatccccctgagccttttcagctcctctgggcgacctgccagagataggagacccagacagctgtgtgcatggtgggaccagaggctgctaacaataggggaaacttctctggaacccttcctgcctggtggtcaggagttatgttggaacaactctgacagggaagtcaaatccacagtgaaatcccagagaaataagggaccatctgtaaatccacccttcccattgccccgcctcccagtcccccacattcccagcctggagccccgagctggccagggtcatggtgtcctccgcttccctcccccaggtggaggttctgtacgaggacgagccactgaaggaatactacaccctcatggacatcgcctacatctacccctggcggcgggtgagccagcgagtggggcgggcagggagcagactcccacagggtctggcataggtctgtggccacatgggccacccttctgtaatcagagacagtctgtcccttatcccatgagctgcatgtccagggtggcttgctacagcaggtcagcctctgggccatctcttgcggatgactttccgctcaggagacaaggctccctgggcagacggtgtccccagatttgggggcagaaataggtgctggcagctgccgtgtgtttgcctccctctctcccgtctcctctctgacggagtctctgctcttagaccttttccctctctgggtcttcatgcaccctgtatccttgtctctctcctctccaaggccccatcccatcccttttttcgagtttggacactgtggggtggagatggtggccctttagttggactctgtctcctgataccttccccttccctgtgtctctcctccccactctccccgcagaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattcc

SEQ ID NO: 86286 - DNA, 1265 bp, Homo sapiens
gggtaccctggctgggagagcagggcgaggtcggagcgctctggagaaggcattgctgataagccctgtccatttttccccaggtctgacaaaacacttcaagacattgtctacaaattggtccctgggctttttaaaggtatctgcactccattcctcctccactgaccccatttcccaacccatggccctgtcctcatcctgctgccttcttccagatgagatgaaacggcggcgggatttctatgcagcgtaccccctgacggagggtgagtgtgctcgcgtctgtttgtgtgtgcacagtcttgcctgggaccatgtaggtgtgtagcgctacccctcaccctctgacctcctccgcgcacacctctccagaaggtggctgggctcacctggctgagttcatgatctctgggtccttggcgggctcccttcctacatcctccgccaacccgagagctctttccttctgcagtccccaacggctccaatgaggaccgcggcgaggtcttggagcaggagaagggggctctgagtgatgatgagattgtcagcctctccatcgaattctacgaaggtgccaggcaagtctggcccaggctggccccttctgggttcctagtctgggtaaccccttctcccacccaggaccctctctggatgtgtccattgagggatcatcctcctgggtctcctggttcttcctgggtcttcctagcttcattctttctccgtccccagggaccgggacgagaagaagggccccctggagaatggggatggggacaaagagaaagtgagtgctggggcctgcccaggactggaatgtgggctgggagggagtggcctggggtggatcccctaccatgggtgcctgtgccccagcagacaggggtgcgcttcctgcgatgcccagcagccatgaccgtcatgcatcttgccaagtttctccgcaacaagatggatgtgcccagcaagtacaaggtgggtccctgggcctttcaaaaaatgagtgtctgtgtatgggtgtgtcagacagtctgtgcagcccagccattggtcagagctggctaggtgtcacccagggcttgcgcggttaactgagcccatgcgttaacagaagggtggttgaaaccaagattgggggcagtctaggggtgttgaagtcagtgtgcagtggtgcatgggaccaagacggtgtgtatgtgtgcatgttgcacactcggaactgtggcagaggtgagtgcaaaaaacgcagggcctcc

SEQ ID NO: 86287 - DNA, 1370 bp, Homo sapiens
ttcctcaaagtaatgacagctggatttccagtcacccatcacccctttttccctcaccttctcacagcacaccagccagtgcagcgggggaggaactgggtatcaggaattcgcggcctggggcctcctggggtggggagatggggagagggtgctctagggagtcagagctcctgtttacattgctcttggcacctgctggcagggccctgcaggtaaccatggcaatcaggtgaggagccaatcagtgcttctccccacccccagccccagaggtaacagtcagaacctgtggggatggaatgaggggagcagggagtgtggcaaggggcttattttcttaaactggagaaggagcagcgtttcattcagtcagcaccaccttgggcctcgtgtctagaaagggtccagaggaacaggctggggctgaattctcagaaatgctcggggaagtgactgggtgaggggtacagccattcgcagtgtggggctctcggctgtggggttcttcttaaaagcaagtgtcagccgggtgtggtggctcacacctgtaatcccaacactttgggaggtggaggcgggcagatcacttgaggccaggagttcaaggctggctgacatggtgaaaccccatctctgtttaaaaaaaaaaaaaaaaaattagccagtgtggtggcatgcacctgtgattccagctactcagaaggctgaggcacaagaatcacttgaacccggtaggcggaggctgcagtgagccgagatcgcaccactgtacttcagcctgggcaacagagcaagactatctcaaaaaaaaaaaaaaaagagcaagtgtctgctttgaaaacacagcgagtgtgtgaatgaggtggctcgggcacgatgtgaagtgtgcggagcctacatgtgtatgtgtgtgtacgcgtgcatgtgtatatgagggtgaacgggagatagatgagggcatgcgatttaccccagcaacagagaccccaggcattatcagagctcagcatcagcatgtttgttggtggctctgcacacacacatagatgcatctggacacacatatgactgacaggcagtcacaggaagtacctttggaggcccagatggcacgtacacaggatggatattacacacgctcagagagacagccacttggattgttctctcctctggatggttgtaataatatttgggcatcttgccagggacagggttactatggaaacgaccaaacagtggagtatccagcagctttctgcgtaattgcaaaggggggacccatgcagggagggctggccgaggccaccctgcgtggggtgggaacccctctcccttctcagatccccggggccgccacctctccg

SEQ ID NO: 86288 - DNA, 2046 bp, Homo sapiens
cggccacccggtaactggggtccctgatccttggacatgggctcctggggaagcccgggcgctgggggtagaatggggatggagggaaatttatcgcaatatttcccatcgccagcggaagcagggggatctgctaaactggccccccttcccctgggacgcccagccaccccaccctgcgcacgccctcctactgctagctctgagggcgtgggacccccgggcaagcagacaccccctgcctgtctccacggtgggcccgggctgcccctcgccctcccccactgcccctgtctgcccataatcgctccggttggcttgaggtgggaggaggcggcatggaggcgggtggatttgccagtgaatattgtggaagtgttacccagcgcttcccgagatctttgtccctcagtgtcccccatgctgcctcagtctccccagaggtctgtctcgaggggagggctgtctcctggttgtcccctccccgctctgttctgatgcctcctcctctgggacctctggcagtttctgttcctgaaactctttaatttctctcctccctccccccttcactctggtccaaggtgttattactgggagcataaagccagctctgttgcagctttttggtgggaaggttttcccacgggctcccctggttgggggttgggggattgaggctttagaactgactttggaatgaagcaggaaaccaaccccaggatccagaccatgtgtagctaggtagggttcaagttgaagtcttgggggttgggcaggaagggggactctgctgcccctggccttgcctgagagatcttggttgatggagctgttgtcatgggaatggagagagcccgaacaggaagagggtacagctttgtgcaggtcacatgcccactgcagccctccagcctctggtccccagagcggactttggaagctgaactgcttttgttgctggaagacttatgttataatttaccctgggtggaccagggtcgtacaaaaggttagtgtgtgtttgcagggtctgtttccaggcagggatgtcaggctgtgtgcttctaggtggggggtggatgtggatggcttctgcatgtagcgagggtgggcctggctctggtctggctgtgattgtgtgtgtgtgtggcgcagggtgggggagggttgtggcgtgtctatctggccttgtgtgtagtgagtgtgagaggtggaggggggtgtgtcttgctgtatgtgtgtgtatctggcaatgtgtatattttggggttttgcctttgtttgatcttagggagttgagaggtgggagagggaggaagggagggttgagtaagcccagcttcaggaggcccttttcaatgcatggtggggacaggggagcagatctttgtgccattgtcaaggattggggaaagttgggaggttcacagtgtccctaggcagaccctcacggccccaaacacaaatacaaggggcttgcgcagttggacccacgaagctgggagaggaacagagtcataaaacccctggtctgagtcttgatgctgtactctggctggctgtgcttccctgcagcctctgtttccctatgtgtaggaagtggggtaaggcaattaacatgtgcctcctcttcctgcctcaaggcaggagtccatgctgatggtcatgtttgggccagactgactccctcccagacggcggcccactgagtggttttcccgccactccagggagctgctcttttcccctcccacctgctgggatgaagccgggcattactgctttagatgagtgaggagcctggccaggtgccaggatgttaaaagcactggggtgggagtcaggcactttcttgtcacaggactgccactgctttgctttgtgaccttagacaagtcacatctgagtgtgctcatctgtaaaatgaaaggattgaacaggtgcttctttttctttttctctttttttgagatggagtttctttcactctgtggcccagcttggagtgcagtggcacgatctccactcactgcaacctctgcc

SEQ ID NO: 86289 - DNA, 1006 bp, Homo sapiens
aagagtccgcctatcagccaatgaagagacagcagtgagagcggttgcgcagtgaaggctagacccggtttactggaattgctctggcgatcgagggatcctagtacaccgcaatcatggtgagatggggagttaaagcaaaggggcatggggaaggattgagaagcggagggggtcaggagaggcttggggacgaaaagggcctagggtcgatggaaggaagcggtttcagttcgaggggagcgggccccggtgaggaccaagagggtgagtgcggctcattgccgccacacagtgctcatcccagctggagaaccaggggttcagacgcctccggaatggagaacgggcgtacaggagcctccgcatcaggagctgggccgggggctgtggcagcgtttgaccccccgcgctgacccctccgctctgtctgtcctagtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagtgtaagtttcaagggtccccgcccacacccaggcctcttcttggaccatccaaccccggcgtcttgaccggccaaggtgtcagtcatctaccacacaccaccagtgagtttgagactttgccgcctccaaaaaacatgtccttccctttcttttttttttttttagacagggacttgctctgtcacccaggctggagctcagtggcatgatctcagctcactgcaacctccacctcccaggctcaagcgattctcgtgcctcagcctcctaagtagctgggactacaggcgcgcaccaccatgcctggctaatttttgtatttttagtagagacagggtttcaccatgttggccaggctagtttcgaactcctgacctcaagt

SEQ ID NO: 86290 - DNA, 1180 bp, Homo sapiens
ggtgatccacccacctcggcctcccaaagtgctgagattacaggtgtgagccaccgcgcctggcccaagactgatttttcttaaagatcagtgtctagaacaagtttctgatgagctgccatttccttttgacaatgagagtaacccagccactgagtatccctctttgccttgcctgctagggggctcaaaacaaaactttgtgttcagtctgagttatcttgtattatgttttaatggtttagttttatttttcagtgtttttcatataaactgcctccaatcttttctctaaaggagtagaggtataaacatacacatagaggactgagtgatggtaggaccttgggtgaggagagggaggattagaagaaaacaattctgaaagaaagaaggagcacaagagggtcagaggtgagaaggatagaaaggtaagtgttgaagaaaagaaagtggaaaagtcttagaatatttctagctggcaggagaagggagagggagctggcctcagggaaaggtgatcttcctaaacaggtcctccatttccctttgggtctgggtctaggccggggccttgtctgaataggcttaaacatgaaagcgagcgttcttgagttctggtttctctctctgatgctggcccccacaggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggtacgttggtggcatggagaggggctgggctctgagttacccacccttggtcattaggaaaaaagtgtgtttatgtggcaggtaatggggagaatggtgcaggtgggagagaaagccacagctgctgctccttggaagggtatccagaaattccatctgccaggctggctggctggctccagaggagagcatcttctgttaggagaccacagttagatatttgccacagcagtaagaattccttacattgggtttacagggttctcgcatccattcactgagcaaacatttaactcagtgtagggttagaggcagctcaacaggttgtctgggttggcaacctggatccaccc

SEQ ID NO: 86291 - DNA, 1186 bp, Homo sapiens
aggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttc

SEQ ID NO: 86292 - DNA, 1032 bp, Homo sapiens
gcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctc

SEQ ID NO: 86293 - DNA, 1042 bp, Homo sapiens
ctacccccaagagactgggagaatcagctcagtctgcatctttgtgttcctgatgaggaaatgcaggggtagagaagttaaatggctcacccaaggtcatagtgcgtgtgagagtccagattagactcagccccctccatcagaggcagaattttagttggtaggatagctatctgggatcaggatggaaactttcacagtcagtcctcttcccatcctagactgggatgaagagcaggtggtaaggaacaattcttgtcactttggaggaagacttagggagggatgtgaacaccctgtgagaaaaggggagggtaaactcccatctgggagtccctctatctcagtgttgttggctttcaagcagtccagcccctgagggaagactcagcgaaagtcagaattctgttcccctgccaagcccagccttcttttgtctcgattatcagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccaggtatggtgagtcccaagcctgggctgcagaggatgggttggaagagggagaagagagccctgggggagcttcttagggaggggttggtcctctctggtaatggcagctgcttctgatcaccaagcagtgggactctcctgcaaccgtatttctgtgagctgaaatgcctactttaaaaaagaaaaaaggagccatgaaggctcatcgctgactgactcccagttggaaagtgttcacgcactggcatccgccccgtttcttctgaaagaggccccctcagctcggcaggcttgtttcttttcccgtcccatctctccactcatctggaacctgtccatgaggaaggcagggagccccgtggcaccatctgtgtgtctgtcctcagcctacttgggtcttcatttctggggcacctgagaagggccgaagggagcttctgg

SEQ ID NO: 86294 - DNA, 1781 bp, Homo sapiens
ccctagttgagatatggattgttcaccaatgttagctgagttaaaaatttcctaggctgggccaggtgcagtagctcacatctgtaatcccagcattttgggaggctgaggcaggcagatcacgaggtcaggaattcgagaccagcctgaccaacatggtgaaaccccatctttactaaaaatacaaaaattagcagggcatggtgacatgcgcctgtaatcccagctactcaggagactgaggcaggagaatcgcttgaacccaggaggcagaggttgcagtgagcggagattctgccactgcactccagcctgggcaacagagcaagactcgatcttctgacctcgtgatccgtccccttaggcctcccaaagtgttgggattataggcgtgagccactgcgcccagccgagccctgaactctttgtctctgttttccctttaagtctcggagccaggcttgatatgccaggaaaaaggaaatgggacagccaccacgaattgtttctgttggcagaaaaacaaagaagtggaatggtttcctctgtaggcacagatttgacagtcacattctcttgtgagcaccccctggaataggaactggcatgactcttctggggttttttttggctattgggagggtttagccaatgaagggtatcacagagcttgatgctgggaatttaaaaatcaactttattgaggaataatttatgtatattaagtgtgcgtattttaagtatacaatttgatgaatttcagcaaatgtatttgctcatgtaaccatcaccccaagcaacatataaaacatttctgtcaccgtagaatcacacttctcatgtccctttacactcagcaccccccgccccctggccaggcaactcatctcatttctctcattatagatgcctgctgtagaatttcatataaatggaattatacaggatacactcttgtgtctatgccagtttttgccagcagtttacctagtgtctgctccactgccaacttataaactaccctgcccccagcatccctctcaaagcacgtgcattcctatggcttccttcatttctccatgagtaaattgggttttttcccaactctaggaagatatggttccccagcccagttactgcattaacttgaacttcctccattctctgacatttctaaataaaaaaggtttgtaacataaaaggagcagcaaattaaatgccatttcccccatttatgctcctggaggagttctaatgactctaggttatcccctcactgccacctggggcctcattgagataacaggatttgcaaggaaagtgggagacacaaggctgtgccccctccccccagtccattaagtcaggactaaggtttcctctgtaaatcctgaatgcattagtggcaactgggttgagggtcaaatgtcaaatactctgctgtgatgggagaggacatctgtggttaattagaccactaactggctaaactcgaggtggggaagggcaggatctgccctcatctctgcaccaatggaaagctagctctctgtctaggatccagctccctgaagggatgaaagtcagaaggtttgtttgcagtagaggcaaggcatcctgccccatctcccttagtttagtgtatggcaggacttgacatcaggaactggccctgctttattttattttcttttttgagacaagatctcactcttgcccaggctagagtgcagtgcagtggtgcagtcagctcactgtaacctcaaactcctggcctcaag

SEQ ID NO: 86295 - DNA, 1347 bp, Homo sapiens
tgccagctctgtcaagtagcagtggtctgcccaaatagtcctctctttctgatcgtttggttgttgtggctgctcaaattcttccatcctccaggcctccttacctttgaatgtagaactccaccctgggtttccttttttttccctcttgaacaagatgtatcaactggagaagcacaggcttccttgaaccagacacttcacctgggtctctctgggttagggagaagaaagaatggctattaaccatttgagagaagaggatgcctggttataaggagggactattcatagtagaaataatatgtcttcccatagtttttgaaggtgatcattttaaagatgttgacttatctgttgtgtggctgcaatgttgtgatgatgcatagtgattatggtcctagataggagagataggtcccctgggtccttagggtgctttgagattgttcaacagcccctgccaggaagttggatcctgacagtttaagctggaagactgtttatgtggtgtttgttcagggtctttattctccctcttccaaccacttgctctttgccttctgaccatttctttatgaatccccacactaggaatgagcagaggaagtaaaaggacccgaaacaccaacttcactaactagaattttggaataaggaggatcaagcttgggtttcctgtggatttcagttctttaggttcacttgtgagtgcttgaaattgctcacaagaccaagcgatgacaaagagggccagcaagactttgcattgctttggcagaggagctgaaggtgcctttgggtggagatcgatgaaccgtaatctgagctagggttttagatcttgacctgtcatttaggaaagtgcatgtgtaaattgaggtctctgtggtttcttggtcttgggcaggttactgttttcactgtcatcactggtgttagtgagggtcctgccaggatagcgagtaccagtggtataatgcccagacctctaggagctgcttcgggccaacaatccagcccagtttgttactcggtcttcctgctgtcccaggggtcatctgacaacatttctagggaaactgggtgatcagaatatgaaccccatgtccctttctggaagtcaatccttgattttgttctgcatcctgcttctcactctaccaggcctctctctgctggttctgtttctcacagaaagcaacctgtctgtagagaactggtagaggcctgagagtcaggagtattacagctagctgcaatgaaccttgggtcccttattttacacatgaagaaaaggaggcctcaggtggaggattagcttgcctgtggttacagcaagagatg

SEQ ID NO: 86296 - DNA, 1117 bp, Homo sapiens
cccaggaagcctttttccaatgaggctttgacttattttccaaaacagatacattttcccttatggacactggtttaaaaacatttggttccaggtggagtcactcgaaagttatctatgggagcttaaaagaggttgtgtttttacagctgctctatggctaacaacccatttcttctgaagctgccagaatagttgactgattgaaaatgtttttgacttgcatttgcctgtcttctcttcctagccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgac

SEQ ID NO: 86297 - DNA, 1106 bp, Homo sapiens
ttacaggcgtccgccaccacgcctggctaatgttttgtatttttagtagagatggggtttcatcatgttggccaggctggtctcgaactcctgacctcaagtgatccacccgcttcggactcccaaaatggtgggattacaggcatgagccactgcacgcaacccgcactatttctttatgccggccacatggggtgccgtgtttattgcatggtaggtgccagtagaatgaactctgattagctgtggttctctctcccttgtgtccaggttttaggtgtaggtttgcagaagtctgctttttaaagaaattgtatttctttttcttcccttgaaccaggaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggtactaatggggggctaggaagggggtttgttacagatgctttgagaccctgctaaggccattgattctcttgctttacagttttctcttcgcttttttttttttttttttttttgagacggagtctcgctctgtcgcccaggctgaagtgcagtggcgcgatctctgctcactacaagctctgtctgccgggttcacgccatcctcctgcctcagcctcccgagtagctgggattacaggcacccaccaccacgcctggctaatttttgttgtattttttagcagagacagggtttcactatgttagccaggatggtctcgatctcctgaccaccttgtgatccgcccgcctcggcctcccaaagtgctgggattacaggcgtgagccaccacgcccagcctattttcttgataatattaatgagaccctgggtgcctgtagtcccagctatttgggaggctgaggcaggagaatggcgtgaactgaggtggtgcttgcagtgagccgagatcacgccactgcattcc

SEQ ID NO: 86298 - DNA, 1049 bp, Homo sapiens
tctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagtaagtgaggagctgggggtgcgcttgtgtgtagggaattgcagagctgtcctgagatgcatcatccagtgttgtataatggctgagtgcttaagggcatgggttgtaatgccagactcacctggattctaaggttggctttgcatgtactagctgtggaactgtgatcaaatttgagagacttggttacttcagtaggaccagggagtaataatacccaacgccttcttaaggtttgttgagaatcaaatgagataacacgtaaggacttgctgtaagccgagctcacagtagatggctgataaccgtgatggaggatggttgctctaccctgcttctcagcatatgttgaggatgcagtcctgcctttgttaatgtatttcaggcttgcttgggtcggcggggacagggggcagggagtgaggtcccatgagagaaggtggatggtatgcttgtcaataaaagctgagtgattacggccaatgccactagattttaccctgcttcaatttcctgttgtataatataggatacgagtagcagataataactaccccatccatctcataaaaggagatgggagtaaatatgtttgagaaaataaaaagcatacaatatgcagtgtattcttaagtcagaataaaataaaataacagatagactaaaactggggactaggtgcggtggttcatgcctgtaattgctgtattttgggaggctgagaaatcacttgagcccaggagtttgagaccagtctgggtaatgtagtgaggctccatctctgtttaaaaatatataggctgagtgtggcggcttatgcctataatcccagcactttgggagactgaggcaggcagatcacttgaggccaggagttc

SEQ ID NO: 86299 - DNA, 1255 bp, Homo sapiens
tgccaggactgggaggagttgggggtcccaggtcccatttctacatcccaattcagtgatactgggatcttaataacctacctgtaaggtgaagttggaaaaggcataggcaaggatagttgtcctgagagttttacacttgtgagaaaatactggcagctttgattttaagatgtgaatagatgatcgtggttcatgcctttactccctatactcccagcactttgggaggccaggcttgccaacatggcaaaaccctgtctctatgaaaaaaaaaaaaaaatctgggcatggtagtgtgcacctgtagtccaagatactagagaggctgaggtgggaggatcaccttgaagattgatatttacactgtcactgtctcaaacgctgagtgtacattctgtctagttggaaactgcttttgtggtggcactgcgacttgacaggttaatgactgctgtccttttttcttctctcagtacatccagcagtggtcattcgacaacgaaagtcataccgtagaaaagatggcgtgtttctttattttgaagataatgcaggagtcatagtgaacaataaaggcgagatgaaaggtaggaaatcagtccagcttgttccttaggtctctgaggttgggtggattgtctagaagtacaggccaaggatcttctgtgtttgacgatgtcttaatctgtcccccacatgtttttattttattttattttatttttttaatgcaggttctgccattacaggaccagtagcaaaggagtgtgcagacttgtggccccggattgcatccaatgctggcagcattgcatgattctccagtatatttgtaaaaaataaaaaaaaaaactaaacccattaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctacagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtag

SEQ ID NO: 86300 - DNA, 1290 bp, Homo sapiens
gcgaggtgaggttttgtttctggaggatcctccaccatctgtcgtgcagtggctggcggattcgtcaggagcggtggccctaggcagctggggcgctttgctctccttcaggccggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagttagagcaagggttgagtcgtctaggtttcttaatttcgatgtcagagtgttaatagtaagaaataggctactttccgtgagaatcgggtggcacatggggacggcataagtaaaatccgagcgagctaatctatagcgtacagtctatcaaagcatgtgcggtgaattacagcttgagtatgagggggaactccgaaccatgtctagattgtgatctctttatcctgtttcccttccctttatatccacaggacgtggtgggtcctctggtgcgaaattccggatttccttgggtcttccggtaggagctgtaatcaattgtgctgacaacacaggtgaggtctttgcacgttgctatactcccccttttaaaagcactcaatgggcctgtggctaatgacctattgagccgtcaagaaaggggagagtgaaaacatcgcttttgggtgaagtggcaacatgtgttgtttgcttcaatcggtggtgtgacaaggcgttcttgcggactaactgcttgggcagtgagtggagggaggggctttggaagtgtttgggaaatgttatactgatggaacggcctgatggccctcaacattttttatttttatttacattcttttgtaggagccaaaaacctgtatatcatctccgtgaaggggatcaagggacggctgaacagacttcccgctgctggtgtgggtgacatggtgatggccacagtcaagaaaggcaaaccagagctcagaaaaaagggtgagtaaacactgagcccaccttaatactgatgagtagtggggggacgctttcctttattggaaaatggatcagttttcaaggcctcaagtttgttttccattgagaggcagtgtgagataagtatcttaagtttttgctcatattgtgttggaggggggaccatcatcttgtcacttccataccttagt

SEQ ID NO: 86301 - DNA, 1043 bp, Homo sapiens
tgcggtgaatcagttccagcgttcaggaggatccaaccccaccctcgacgggcttgaggggttagcccgcctcccgcagcccgggcgccccagatgtgcagcctgctcgcctctgcgccgcctccggctggggaagggccctgggcaccgggcgcagtcagcctgagagcgctgaggcgccagcaccgcgggccccgccgtccccccaggaacccgcccccgcgcagccccacgtcgcccggagagcgcgcctcgctgcgcgtgcccttgcccgcgcccgaggcgcgtgcccgccccagtgcagcccctcctccccgctgtgtttattaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataaggtgagcccgggaccgggagacgcgtctttgcaatcccccgcagtgctccgaatccagggaggagagaagggccgggtctttgccgccttatccccgcgatcccaggagaatggagggagggcgagcgggcggtgtcatggggtgtggggacacatcccagtctgaaaaccaggagatctggggcgaggcgggaagtccacgcgtagcgggcagccgctgctggagaggggtgggctctgtgtcccggggttgggaggacgggagaggagcagggaagtcaggcgccggggtgtgttgggggaaggttaggggtgcagtcccgccccctacggcctggagagtgagaagagacggccgctccctctccgctctgcgccgagcgccaagtaggcggaagcgcggggcgctggtggagggggcgggggggcggggcagaggctggggggccctgcaaaaccgtccgctccggcgggggtggcctggcttcctg

SEQ ID NO: 86302 - DNA, 1035 bp, Homo sapiens
tcccaggtggaagtgcagaggtgtgatctcggctcactacaacctccgcttcccgggttcaagggattttcctgcctcagcctcctgggtagctgggactacaggcgtgtgtcaccacgcccggctaatttttgtatttttagtagagacagggttttgccacgttggccagactggtcttgaactcctgacctcagatgatccgcccgcttcggcctcccaaagtgctggcatttcgtgcccgacctgtatcatatacctttgaaaagttcagagggataggcagctcctaagcaggtgtggctgagaggccccagaatatctctcataatggccgagcttggaaacgagttgggtttgaaggatgaagtgctttgttttgcacccaacctgccaagcacatctttccccagaactgagtgctggaggtggctggggtccatctggcctccccttcgctgtctgggcagctgtggtgtagaggagaatgccttgggcaaggtctctgtccttgacactggacctcagtttcttcatctgtaaaacggcacaatgagaatgccagcctaaagctgtgtggtgggttttgagagagaatgtgcacaggactcagtgtgccaagatgttgctttgtgtctctgtaaattgtcctgaagcccgaggctgctgccaatagctgcctgtttgccctgccctatccctgtccagtccctgttcctgccccgcttcttcctgtcctacatgcctctccctgcaaactccccagagcagctgatagcagggaggaagggtgggtggggcacctgcagagagcccaccacccacttggaatgattaacaaggggccagtacaggctggcctatgggacaaaggacagctgtgctctggactctgccctgcacccagctgatcacctgtccctcattcctcgccatggcccagtctgtcatggggttgggttccagcggagtcaccagctgggacgggtggcccctggtctgtcttagcacccatgttggcatgcacacatttcc

SEQ ID NO: 86303 - DNA, 1072 bp, Homo sapiens
ggccgggccagggcgtgcccaagcataggacgaagttcccaggagggcatgctctgtgagaagcccagaggctcctgcccctcccccagagtcacccccactctgttttttctgtcctgcagacactaccccaagcagtccttcaccatggtggcggacaccccggaaaaccttcgcctcaagcaacagagtgagctccagagtcaggtgaggggctgggcggtgctggggcctggcagggagggatgctggggagggaagttgtaaggtcggcatttggcaagagtaccttcccctgcggttactctgcaaggccaaggtgctgaaatcctagcattgcctttaatcttgaccccacccctgactttatcaaaggagcagggtagagcgttctcccacttcctacctagagggggttggagaggtgtgggtgtctatttgagcccgctctggggctccctaaagcctacctcctccaggaagccactctcccctccctcttccccattcacactcacccacaaaggaggggtttggggaggaccagggaatttgcccctccaggtcatgccagtctgaggctgggcaaccaaccctctatagccgcgtcccaaacctccacccactgaagggcaaggtgtgaagggggccctgccatgggggcacaggatagggggctgttccgcctctgtctcctttggcttgactttccagaacactgctgagtgggaggtatgtgcccctgtaggaggggaggacgggttccaggcctagggagaacttggtctttaggggacacggaggaataagcaaagggtctggagtcctgagaacagaacagctgacccaccctgcctgggggtgcgagggctcctgggacaaacctggccagtgatgaggtggggtggggtggggcggggcttcagccgatgaaggattaggcgcgagaatacatgtaggggaatttaccacgtgggcagcgcgcccaggacccactcaggatcgggagaagactgcagaggttccacccgggccacagaggggatctctcccagttcctccagaggggact

SEQ ID NO: 86304 - DNA, 1026 bp, Homo sapiens
gtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagt

SEQ ID NO: 86305 - DNA, 2271 bp, Homo sapiens
gtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcggacttggtttcctctctggctctgagctgctgttgtgtgtgtctgtgtgtgggtgtgtgtctctagctgtaaggtgctgctgtgtgtgtgtgtgtctagctgtaaggtgccactgtgtgtgtgtgtgtgtgtgtgtcctgtctgcttgggggcactggcctgtggccctcctgggacctctgctgcccctcggggagagaatgacttgtctggatgccaagggggagtttgctgctgtctgtcaggcccttggcccctacttcctccttgctgagaactccccaccaacctacttctggctttccacccgctcattcctctctgcccaacttggtgatgctcccggaagcttccctgagctccgtctcgtattactgtgtcacttcctcagtgacatatctgtctccccactagccagagcccttggggcaggtgatgagtctaattcatctctaaatcccgggtacctgcccaggagcggtgcggagctgttgaattaatgaatgagcttggctggggagcagttctagcactctgccgctgccaggcagagagcaggagctccacgcatttgagga

SEQ ID NO: 86306 - DNA, 2174 bp, Homo sapiens
tttagcggcctcattgtgtttttattactttgtggttttgctcacaaaacatggtttagcgagccaaaacaaagagaggaaaaatgtgaacacctcacagccaaaatcagtgatgccacatttcaggctccaaacaagccaatttataaataaacatgctgtgttcgccaaatcaagaggaatgtgttaagagaagacaacgtgaactgatggagaaggtgctgagctggacggggagtgggaaggtgggagcttggcctcagccctgcccctgagtagctgggtgatgtggacaagtcactggacttctctgggctggcttccacccctgtgaaataggaggtactagactaactggtctaaagtgggacctgagcaatcagctgcctggtcctttttcaggtcacacagcaacttagaccaaagcatgcctttctctttcattatcccgatagggtgaccaaattgttctatccaggactctcctggttctaacacacaaagtcctgcatcccaggaatctcctcaatcctgggcacattggaatgttatagaaccaaaccaggtcttctcacctggcgcaataacaccagatgtccacactgagactttgcagcaatagagaaaggaaggcatttgtttgcaggactccaagcaaggagaattgggtggcttatgcttaagatatgaactcttgatggcttgcaggtaaggtttttttgttgttttttttttttttgagagagtctcactcactctgttgcccaggctggagtgcagtggtgcgatctcagctcactgcaacctctgcctcctgggttcaagtgattctcctgcctcagcttcctgagtagctgggactacaggcatgcaccatcacgtgcagctaatttttgtatttttagtagagacggggtttcactatgttgaccaggctggtctcaaactcctggcctcaagtgatctgcccacctcggcctcccgaagtgctaggattataggcatgagccgctgtgcccagccacaggtaaggattttaaaaggcaggggtaaatttcaggaaagcagatgttacaggtaaaatcataaatcaatatatggaagctatacgttggtttgacctaaaaaggcaggacgtctcaaagcaggacccacaagtcataaggtgggttcaaagattttctgatttgcgattggttcaggaggcgaagctttgtctagacatgtgggatcagcagaaaagaatgttagctctggctcatgggcaatggcctcctccaggtccctcaggaagaaatttagaacaacgaactatagtcagagtcagtcctcagcacccgtttatctgaggtctacatgccagcggatcccttttggaggggtctgggcttctgaaaaacaactcagggacatacgttaagatgttatctttagtttgtagagaggggaaccaaacatctcctggctctaacttcctcagctattgttttagactactattaccttcctgcttaccaagttgctgatttacttctcagggctagctaggatttccctgaaggaactcaagattttcctttatccccatgtgtgggtgtccccagctccctcgccatgtttggtcccctctacccttggcacagccctcccaccccattggctgaagaaataatgatttcaagcacctggaaagcactttagaatatagaaccttgctagttaaagtctggtccagggccaggcacagtggctcatgcctgtaatcccaccactttgggaagctgaggtgggaggactatttgagcccaggagtttgagaccagcctgggaaacacagggagacattttctctcaaaacaaaacaaaaacaaaaacaaaaacaaaacaaaaaaaattagctgggcacagtggtacatgccctgtggtccgaactactcgggaggcttgggcccaggagttccaagcttcattgagccatgatcacgctactgccctctagcctgggggacagagcaagaccctgctttaaaaaaatgtaaatctgtataataaagtgtggtccaggccaggtacagtggctcatacctgtaatcctgctctctgggaggccaagatgggaggatggcttgaggccaggagttcaaaaccagcatgagcaacacagcgagaccttg

SEQ ID NO: 86307 - DNA, 1036 bp, Homo sapiens
ttccacactctagctttcggcaggtttcccagtggttgggggatcacagcacggaacattttagggagagggtccctgaaggtcagttgtgtggctcctggtaggcccaagtgccccagggcccttataagagacagtcttggttggctctgtcgctcaggagtgtggggtccccatgggggcgggggcatgcccactgactttgcctctgtgccttctgcagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagt

SEQ ID NO: 86308 - DNA, 1390 bp, Homo sapiens
gcattagctcttggcaatatcctcccttccatctaagatttgttttccagactgccttgagccaatcagacccactttggaaggtttcagagggctctgtgggtctctgagacgagcattctgatgccttgaccttaagtgggcagctctcaaggaattcttttggtgcatgcagaggggatgttgggcatggcctcagccactgctggctcctctgggagactgtgcacctgctgaccttaatgatgcacctgctaagcctctggtcctctggcttttgaggaaggcagtcattctgggagtgagaagggtggttccaggcatctcctctttagaatcccatccaggttccttctcactgcaagaattttccagtacactcaacactgattctaggtggaaagcatcctattctcacaccatagactaacatagatgggtctattcatctgtgccctcttttttgccccctccctttatatcttcttgcaaagcaagcatgctgcatgtgccaagcatgtcactgtgagttgccctaccctcgctcttatttaacctgaaccaaaagctgggggccattgcccccattgatcgatcacaggggaaaactggggctcagagaagtttaatgaattggcctgcatctcgctgctagaaggtgacgggcccagcatttaaatatcaactctccagaccctgtggccatacacttaccacagtctatttattagtctgagtctgggctttaaaaaaaccctgtccagccgcctacttttgaagttagctgttggtgaccgttcagatttgctctatttatttaagattggcatctcagccccttccttgaggaaggatttgaagcagctgacagataaattgccctgtaagagaagatgctttcaggatgaagggaaaggtgtaaatgcattcaagacacagcactggctctctcctgcaggcagagggcaggatgtgcgaggacttccaggatgaggaccacgactcagcctcccctgacacttccttcagcccctatgatggagacctcaccactacctcctcctccctcttcatcgacagcctcaccacagaaggtaagttctgagcccaggaggggagcagagaggaggccaggaaggagagctacccacccctctggggccccctctctgtccctgacagggatgatctcatgggatgggaactgccccatccttttatagctaagggggcctgaagttcagacagtttaggtcacttgctggtgagaagcagagccagatttagaacttgaactctactcctgggctctaaccactgtactggcccacatcagggctacagacaattcactgtgaagaggggaaaaattaatagcccaggccagtgc

SEQ ID NO: 86309 - DNA, 1089 bp, Homo sapiens
tcctggcctcactgcccacagtcagccaacatgagagtatctctggccagtaccactctgactcttgggacaagaacatggcctgggggcttctggaagaccatttagggattccagctactcaggctccctcctcacacccaggaggagagggttcatcctggaacagggcttctcggagtgttccacagctgtgggcattagaccctgggctccagttaaacacactggattcctgggacccatcccagaccctctgtatcaggatctctgggagagaacccaggaagctgcattttaacatcatgcttcatctgcaaacaagtgtgagaactgccagttcagagacaaagtctggtccaaagacccatgaccccaaaacaccacctcaagatctttcttgggctgcaagggatttttctgaagaccaggggtgtggactacaggcatccatggaaagttgggagagctaaaaagctgtgtttgcttgcttttagaagctcagaaaattctgggtgagattcagtttcagtgataatgttcttaaatccatctcctcttccactccttgttctgaaatcatttcctcacagattagactcagcattcaagctctgttccctgtccaagataaataaatgacaggaggagggggaagaaaaagatttccttggggactagagttctcatgagagtgggaagtcctatgaactccaagggcttttaaggcaatcttgaaaattgctaaattatagtctctgagttcctgtgcagctgtcgtgctgctcctttccaatgctcctttccagtgctttttttttttttgagagagttttgctcttgttgcccaggctggagtacaatggtgtgatcttggctcactgcaacctttacctcctgagttcaagcgattctcctgcctcagcctcttgagtagctaggattacaggcacacaccaccacacccagctaatttttttgtatttttctagtagagatggggtttcaccaaaccaagagtttggccaggcttgtctcaaactcttgacctcaggtaatccatctatctcggccttcccaaaggcgtga

SEQ ID NO: 86310 - DNA, 1085 bp, Homo sapiens
ttacaggcgtgtaccaccacacccagctaatttttgtatttttagtagagacagggtttctactaaaaaccctgttggccaggctggtctcgaactcctgacctcaagtgatccacctgcctcggcctcccaaagtgctgggattacaggcatgagccaccatgcctggctgggctgcctgcctttcaaaattgaagaaaaccaaccccaagtcatggttcctgggtgggtatcgtggcctagagagaagtatcagagcacctcagattgtcattttaaaaaagaagcctttcatgtacagttccagctttttcctcccaagggtgttgtggtaggtgtttctgtctttccactccacagacaagaaactgaggtccaaatgacttgcctgaggttatccagcaagtcgtgagcagaactagaacgaacttggatctcctgactctgaggtcctgtgagaagtttctgcagggaccaaagtaggactcgagcctggctgcaagccctgagccttgctgggggatttgtccaggaggggtgaggtggatggtggacagcaacatgcaaaagtcagcctgtccatctgcagacattcacagagcactcagcgaggttcaggaccagatgatcatggtctcacacatccccagcctccaaatagaccctcatgtccacagtgtggtgagtgcagtgggaggggggcacctggcctgagccaggcagaggagggagctggccaaggagggctgctcaggggaagtggcccttgagctagatctgcaaggatgagctagacaggaagaaggggtggaagaacatcttgggtcaggggaatagcagttgtgaaggcgcagaggcaaggagaagcaagcatgggatcccatttgtcctgcccccaagagcagccaggtctctgcgttgagtcacttagcctcacaccacaacactctcctctccaggtccgcacctgtccctgtctccagcagcgccaacatcattgtcccaggctgctgggtgcacttactgccttcagtgcagcaggctgacctgtcagactgtccgggaagaggcctcgatgccctctg

SEQ ID NO: 86311 - DNA, 1470 bp, Homo sapiens
ggtgtctgcaccgacatgctgaaggagtcaacaaatgtgctgcatggtggcgctgtgctcttgtagttttctcgtttaagtagatgttttccgtctacttaatggctaggcttggtaaattgtaaagagatgtggcctgtgtggtggctcatgtctagaacctcagcgctttgggaggctgaggcaggcagattgcttgagcccgggagttggagaccagcctgggtagtacagggagacccatctctactaaaaatacaaaaattagccaggcatgatggggtgtgcctgtaataccagctacttgggaggctgaggcaggattactgagcctgggaggtcaaggctgcagtgaactgtgattgcgccattacactccagcctgggtgacagagcgagaccctgtctctaaataaataaataaatgaaaaagtaaagtgctatacaaagttgtatctgtctatgggttaatctgtctgaacctcagtttccccacttatgaatgaatggcaagacaacttgattttttttttttttttttttttttgagatagagtctcactctgttgcccaggctggagtgcagtggtgcagtctcagctcactgcagcctccacctcccgggttcaagcaattctcccgccttagcctcccaagtagctgggattacaggtgctcaccaccacgcctggctaattttttaaatttttagtagagacggggtttcaccatgttggccagactggttgcaaactcctgacctcaagtgatccacctacctcggcctcccaaaatgctgagattacaggtgtacagccaacttgacttcttaactcccttgctctctcaacctgatatgtctgagtctctgcagctgtagctcatctcctctctcataaagcccacacctgcgcagtgctcgccttggggaccacctggactcctcatcccacccactctgtccagctgctttcctgaggaggagcaagttccctgatctgcctgggatggaaggaagggagggagacgtgggaggaggcctggatctcattctaaaccatccggctccagtgcaggagtcgggcgaaggaaggagctgcagggctggagctgtcatcctcctggtaggaaaggaagaccaaggctaaagtcctctccactgcctctccccatgggagtcagtgggtgtgtgttgcggggagatggattccaagataagtactctctgagcagccctcagagggggcgtgggaaattcacctcagtctccagggtccccagtccattcaccacctgagcactgccgtcccccactgctcccatgacctcattctccagtggtggcaaaagcaagaaacagtaatcaggaagaaacaaggggaagctagggtgggggcagtggcatccacagcaggagaagcaggcagcctggactgtgggggcagcagaagagaggagaggcctgcagga

SEQ ID NO: 86312 - DNA, 1714 bp, Homo sapiens
cacgagtcagtgtggacagccctgtgtcccggagttgctgaataagagggagagggagactccactgagagcttgggctcctggggccaggctccctgttgataggaggcacctgtctttaatccctgcacttcagttccacatcccacttccccagggatggggaaagctgtgagtcctctcctcttcctgccccctcgccctatagtctgtgccctgctgaagggacagggaggaccttctcctatctggggtcctttggctccatacacaccagacccagagcccgccagatggggatgggcgacagaggtctcaggctcacttccagctctgcctgcgctgcccttcttgcccttggggaaaaggcccccaaagcggcccctctgggccatttctggtgactcctctgcacctctcccaccctaggcttcatcttcatgggggacgtgatccatcggatgctcacagctactcagtatgtggcgcccctgatggccaacttcaaccctggctactccgacaactccacagttgtttactttgacaatggtgagactggatctcagaatttaagtcacccagctccagggatcccttgtccagtcctttagaggagcacagggcctagagagggcaagggtcccacagtcccacggcaaagcagccacctacctttctctgctcagtttcctgacctgtcagataggggcaaaaatgcctgctacccagaagaatctgatgagataacaaaacgacagtgcttggctcttagtcgaggtaaaataaatgttaggggcctttattgttacttacattcaccaggatgtcccttgagccccgtctgaatccaggagaacagacattcctccttcttttatctcaaggagtcagaatagacaagaaggaaagggaaagagatgatcaagtacagtatctggggctgaagcaggatcttctggctcctctgctgcttggaagccgcgctgctttagtgagctgcccagctcctgcctccttacctttgcaaacttccccatcatcccgaagggacccaacctgtggccgctgccctccgactggcatttctgtagggccctgctccttgcatgatctcccgtccagccgggtctctgttcttctccccagggacagtctttgtggttcagtgggaccacgtttatctccaaggctgggaagacaagggcagtttcaccttccaggcagctctgcaccatgacggccgcattgtctttgcctataaagaggtgagtgggcccagctgcagagacagctgggtcttggagcctttcttcattcagcaaatatttagagaatttgcaatgtgccaggcatggggcttgctgctggtaatacagcagttaacaagatgtttgcgggtcctacccttttggagcagtaagtctggttgcggaggtggacaataattacagggacaaatgtagaatcaccactgtgacaagcgctcccaagtagaggtgcctggtgctagctgagcctttcacagacctcttaaccttggcagaggccaggggaggctttgctgaggaaaagagttgaaatctgaaggataaatacgagttcaggaagcaaagaggagagtgaagtatgttctaggagagacaacagcacacagcacatgcaaaagtcctgaggcaggacagagcacggctggcacaaagcactgaaagaa

SEQ ID NO: 86313 - DNA, 1674 bp, Homo sapiens
tactccctcctggacccagagacatcaaatggattgtatcaggatgcacagcctgaccacagcattcctgaaactggactctcccatgacttagggaagaaaaagctgacagtggccttatgagtcacatctcagctgccagatggggcccttccccaccccatttctgccccatctacagactggggcgcaagaggattaatggctgcttagcctaagggctgggcactcagcagggggctgagtagagaaagcaattagggtgcagctcctggagacaacctccttggcctggggcagttctggggtgctggcacagggaggagaggcctggagggagtgctcttctctcagggtttccgggaggctcttggaagcctcggtgtgtctgggggtgaatctattaatataattgtgcgtttctgggaatgggtgtgtgtgtcatggacgctgggttcgcacctgtgtcagatgattttgtatattatgtatgtgtacctgtctgtcactgtgggctgtttgtgggtgtctgtgatgagcatgtgtaagtgtgagtgtgcctgtggctgtgtgtgtaggtgcctgcggctgggagtgatgagggtggattcttaggacgcaagaagcaacaagaggaccttcttctcagtatagatttattttatattttaataactattttcttaaattagtatgtgctgacagttaaaaaaaaaaaaggttaaatagtgctaaaatcataaaacaaaacagcagtcctgcccctcctctcccctggggcctgcccccttccctttctcagaaggctctgtctgggctgtttcctctggagtttacttccatatttccaagggatttgcttatactgtactgctacctctctgtgcactggttttaggccgtacctattcatggcctgctgcggctcagggagatttggcttttgtatactcccgctgagcaacctttcaccctgccgcccaatcttcctgttcaatccgtgtgctcggttgtggattgtgacgatcatgtacatagtgttcacttctaatccaggcagggtcataacattgtttcttttcttgtatgattttggctcttcctggatcctggccccctctcctgcccttgcttacttagttttctgtgcctaccgtagctacattttcctacacgtcccctagcctcaaatgtaattccagtgtgggctgggcatggtggcccacacctgtaatcctagcactttgggaggcccagacgggtggatcgcttgagctcaggagttccagaatagcctaagcaacatagtgagacccacgtctctaaaaaattaaaacaaaaattatctggatgtggtggtttgcccctgtagtcccagctacttgggaggctaaggctggaggattgcttgagcctgggcggtcaaggctgtgctgagctgtgacctcaccagcctgggaaaaagaagaagactctgtctccgaaaaaatataaaagaaagaaaataagataattcagggtggtcaaacctgtcagttcctttatccccccgagaaacttctctcctgtcctgcactccaatcccgcccagccactcgcctgctggtaccacgggtgccatcctggggcctccctttctgttcgtcctgggaacccctttgtctccctcctgtg

SEQ ID NO: 86314 - DNA, 1032 bp, Homo sapiens
gcacagtgcccccctgtgagtgcctagatcccagggaagggaatggagggagaacatttgggttgtcctggtttcctctggcctacatgagagacagggtgaccaggaacacctgggtcaggcctgtgggtgcagactggtcttctgggaagagcgcaggtcccgtcagtcaaagactgggttcaagccccagaagcacccttctgcgtggagagtcaagccctgtctcccagccttggttgccttatctctagaatgagggagttggactgagtgccaaaacttcttgcagttctgccaatctgtagatctgagagctctccttcccttctacatccagaggcctctttttaaccttgtccttcaatcccttgactctacccactgcacccaggccacaccctcaacccccttggccatgccccactcatcccagccctgccccctaaccccgccttcacaggaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcagcttctggtgtctgtggtttttgatgggtctggggcttctggtgctgtcttcctgggcctggtgccataggagcgcatctgctgcccgctggatatgaggcctgatgggagcgcttttaagacaagggactaggaaggacatgcgaggaagactgataaactgattcgc

SEQ ID NO: 86315 - DNA, 2120 bp, Homo sapiens
ccatacagcctggactaggcctcaatggttgtccctggccctgagggcacagagctgcctgtggcatcaccagtggggctggagcacctccgggggtgccgcatgtgagaggatgagagccccccacgcccacctctttgctcacaagctcggtttgcctctgcccacacagcaaatcaggcgataactccagttccagtctgggagatgtggtgactggcacccgccgccccacaccccctgccagtggtaagagccatcgccatgcaggggtttgggaagaagctcctgggtggggtggtctccccactccctgaatcctcctttccctgcagtaggaaacaccccaatcctgagtcccccaagcacatgcagtggttccccctccatgaagagtaggctacccctcaagctgggcctgtcatgtctctcctctcccttttctttggtagctccatctctctgcctgattcccctgccctgcccccattcatttctcccagccctgttccattcacctcttcttctttcttttttccccatccccatccctgcgttctgtacttgtgtctccacgttcatctcactccttctccccacctcgcctccctcctccctctctcctgactctccggtccaggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaaggtaattctcgctgtgttcttgcaagaggtgggggagtcagggccagcactttggtggagggaagggggctgtaatggattcagatgtggtaccaacctgttctgtgggcatcagggcttcctgctgaggtggagggaagggtagcatgggcacatccccctccacacacaactccaccctggcccgatctccaggaaggagatcttgcccttggaaggttgcccccacacctggggcagcagggtttggtggtcatgaaccctgacctctcccctcactcccaggggcctgctctggtgttggtgtctaccttggcatgtgaagcaggacatgggatggcattccttctttgcccttttttgactctctgggtgggcacatagtgggggggggctgctggctgcaaagcaagacagttaagggaacccctaaaatgggcatgttggcatgcactgggggcaggagatgggcaacaagataggggctgtcaccctctccagctcttttccaagacccagaagagggtaggatatgtctgaatattcccacatccactggactgactgtcagtcctgctcccagccctgatccagggccacctctggctcccccttggcgtggggtcccgttccccgtctctggctctgtctgtcactaacacgcatgccctgttatctctcctcgtctgcccggctctccctccctctcttgtcctggctcctgccttgccctctgcccctgcctgggtccccttccctctctcctcccccttccctctcttggcaatctctggacccagccaaacagaagcagaagtcggtgagtatcacagctttctgtgtcctcctccccactccctgggatgagctagggggaccttctaacacccattcccacatctgtcccccatttcccccacccttcctggttctccctggccatccctccccacccccaccctgatccctacatctgggctctgggaccagggtgggggaaggctgcatgggggagcctggagtctgggggagaggatctaatgtcatctccactctggggtttcccctccctgcttccccccccagacagagcatgtgcccccctatgacgtggtgccttccatgaggcccatcatcctggtgggaccgtcgctcaagggctacgaggtaggacttcctagaggggagtggatgcagaggggccttagaaagatcttcagaccccagagagatcccctagaagggcccgatcccaaggcatcctcccaggagggctacagactttcagagacaacccccagggggcccaatccacagaaagaccca

SEQ ID NO: 86316 - DNA, 1048 bp, Homo sapiens
ttgtagctactgtgattgtgagagagggagctgagaaaaagtcctgtctgggcaagggatgagagtggggagcaaaatttgcccccatggtgccagggatcaggctggatgtttactctccaaatacagttccatgcccctactccctccccagaaatctggctctgagtctccaagagagctgtcatcccctccctactctgtgaatagcgaagggaagagttgggcacaggggagaagccaggctgggccctgggttggcagttcctcctctctgggggccaccaacacaaacagccctgctctgctcctgcggagggggagtgggggtgactttcccgctctccccacccaacacccagcactgccggctgcctctcccttcctcggaggcctctgcagcctgcccagcatcttaattagctctgctgcctaatgagcctccagcttctccgcgcctccccccttcccagcctctctggcttggtttggtggtttccgtgtgggtcttctggggctctcttgcactggtccccactcctggctgtgctctgggccctctccgtgaggatgggagaccctccctccccttgggtcgtaccacctcaggaggaatgtgcaggggggtggaggtggggctgggagtgctgttcccaagcttggctgtagctctggggctggcaagatgagggttgggaaagggcccttctgattctactcttgttcctttcctggcctcttcagggcaaatacagcaagaggaaagggcgattcaaacggtcagatgggagcacgtcctcggataccacatccaacagctttgtccgccaggtaatggggaggctgggcggagaggagggaggtggctggttggtggagaccagcattggtgagccaggtctgcggtattgtccaggcacccttccctgtgccatttgtcacctgcctggagccaccccatcaccctgacaccccatgacctcttctggatgtgctgtcagcggcacccactcgctcagcccccgcccctgcccggcccctcccccag

SEQ ID NO: 86317 - DNA, 1323 bp, Homo sapiens
cctctctcactccgcctgcgcaatccagctgacttccggttacagataaccacgtgattgggaacccttgctgcgcatgtctagtaggaagtcggactataccactttccctacggaaggggtacttttttatgtttttaagtttaaaaccgatttctgatatttgacttttatcatttcaggcctatatggaggctatgagtgagtttagtgtggcagaagatgaaagaaccggacaggaatacggacgaaattggagcagggtttgggctctccccttcgcagataatgggaggagccgggcccgagcgagctctttcctttcgctgctgcggccgcagccatgaggtgagggcgagctggtctccatcaggcgctgacgcgtgtcgacaagggactgtcggtcttgggaccgcagctggggttgggggagatgaaatggaggccgccctaaagcggccggtcccggggtttggggtaggccggagcactttcgtcccgggcctccggagtgagggggggcggggagcgtcgcagcaactgagaccaggaaaagtctgccccggctggtgccgcaccgcacacgtgtccggtcgacccacgcgagcagagcaaacggagcgaacaagaccaagccgtgggccctttcttgcttggcacacccggagcggagccgatctctgctttcacgtgatgtagggcaagcctagtgtaggccccaggcctccgactgccgagagaggtgatctctaactcttgactccattcactcctttggcctctcataaaggaaatctctgcgaatagccgaacgaggcttgttactgtgataaaacagggaaataagcccagaaaacagagtaacttgcctgcattcctagactagaaatcaggtctactcacctcgaatattctttaaacgctgagtaccagaaatggcataacccccctattcaatccaataagtccttggcttgactttccagaggagaaatgcgaacatgaggctccgagaggtgaaggcatagcgtgggttttgaagtcttaaacccaagggggccagctgcatagcccagagccttaaagatgatttagggaagagtcttatttcgcggctgtggtgtgggtcacaaagggcaggtcttgatggggacgttcattcttgcccaggattggctttcagagtctaatcatgttttctgtgtgtctagtatgctcaggcttcagaagaggctcgcctctagtgtcctccgctgtggcaagaagaaggtctggttagaccccaatgagaccaatgaaatcgccaatgccaactcccgtgag

SEQ ID NO: 86318 - DNA, 1049 bp, Homo sapiens
tagtgaccttgggtggaggaacagctcacaaggcagcctctgatccatcaccaaccagcatctcttcactccgtgtaccctgcaggtatcacagcctgtacctgaaggtgaaggggaatgtgttcaaaaacaagcggattctcatggaacacatccacaagctgaaggcagacaaggcccgcaagaagctcctggcgtaagtttcttttcagagtcttaggggaacattcttagacctttgagagttgttcttagatacttaaaatgtgccaatgcctaagtcttgacttgcacgtagtctgtcttaggaatacagctgttcccttagaggcacccactcctctgtcctgtacacacccactcttcctgtctcgtagggactagaggttagttgaagcaggagcctttggtgggcccagcaactcattccagaagctgactaggctcaaagggagaggtctggggatgtgcttctgtctccctagcatctcatctcttcccaaactgacccgtcttttctcttccctgaccagtgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgccttcctctctgcttcttgcaaggtttacggttactgagtgaggttttttttttttttttgagacgagtcttgccctgtcgcccaggcttgagtccgatggcgcagccttggctcaccgcaaactccacctccaggttcaagcagttctcctgcctcagcctcctgagtagctgggattacaggtgcgtgccaccacgcccggctgatttttgtatttttagtagagactgggtttcactgttggccaggttgatctcgaactcctgaccacaagtgatccacctgcctcggcctcccaaaatgctgggattgc

SEQ ID NO: 86319 - DNA, 2122 bp, Homo sapiens
ggggaatttgggctggtgaccaacagagacaggagactgaatgacattagagggagcttgggttagcgcaggagcactggattcagagtctaaagctcaggtttgaatgctagctctggctttttgtgtaatttgaggcaagtccttttccctccacctcctctgtgatgggggtgaggcagggcagtacagcggctaatctccaaggtcagccctgaagtgctgctgggtgtctgctgacgtgctggtcttgctgctgaggcctctacactcctgggatctggtcccatcactccagcaaagggctccatccacatctgacactggtcccatcatcccccagggtgggtcccctgggggccatgggcaggactcagggccagggctgcaggccatgccaggcctcagctccatgtctctctggctcagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacacccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaacccaactgagaacaaaatcctggcccgtgcttggtcaaagcaaacccatttcactgtcaggacccccggtcacacaggaaccacccgccaggggagcctgtgactgtcagttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctccccc

SEQ ID NO: 86320 - DNA, 1350 bp, Homo sapiens
aggatgagggtccaggacgaccactcctcaccccccaccagcctgttcgagaacacaggtggatactacgttgcccaggctggtctccaactgcttggctcaagcgattccctcccgcctcagcctctcagagtgctgagattataggcaggagccaccataccgtgcctatttttttttttctaaacttgagtaaatggtacacccatacaacaaaatactttgtagccataaaaaagaatgatgaatctatttatgtatgggtatggaatgatttccaagatttactgtttatgaaaaaaagcaaggcacaggaaatatagtatactaccatttcttcaaagaaaaatggaattaaaccacttaaacttgtttctatccgatttcacataaaagtctagatttcttttgaaaaactagaaaacctggcaacagcctcaattggcttgaggagacctgcagctactccctggccatccagtttgccacagtccccacggctcttgattgctgcccacctggccagaactcctttctccatggaggtcaaccacctggcttttgtggcacctgagattgcgaagtgtcgtcgggacctggggagcctctctgttgctgtttcatttcgctctggccctcagcccccacgctgctgctgctgctgctgctgccgcccctaccgccagagacaccctgaagggaagcccgccctggccagccccctctaggctcccactcacagctccctctttttctcccagctccagcgattcaagcgctccctctccctcaagaccatcctccgaagtaagagcttggagaacttcttccttcgctcgggctctgagctcaagtgccccaccgaggtgctgctgacgcccccaaccccactgccccctccctccccaccacccacagcctcggacaggggcctggctaccccatccccctccccatgcccagtcccacgccccctggcagcgctcaaaccagtgaggctgcacagcttccaggaacatgtcttcaagcgagctagcccttgtgagctgtgccaccagctcatcgtaggtaggtgcctgggcactgaggcggccacggggaggggccagcgtgggtactggggagtgggctcatgttgcgcccaatattattgggctcttgctgttcaggagccccaatactaattgtgcctctgtgcctctttttttttttgagacagagtcttgctctgtctcccaggctggagtgcagtgatgcaatcttggttcactgcaacctccacttccctggctcaagggatcctcctgcctcagcctctgtagtagctgggactgcaggcacacactacca

SEQ ID NO: 86321 - DNA, 1033 bp, Homo sapiens
ggagcggcgtagggcagggggcgggaccaggcgacctcctaaatcaaagttgggcggcgaggactgggcggaggggccgccgggtgccgggctggggccggcgggggaggggaggggatggggggcgggcgcagcggacggcggagccggctggacacggacagctccttggctccctccctcggctcatccccgcggccccacttccctcctccccgcgctgcgagcagcatcctctgcagaccctcggtcctcgcgcccggggtcgtcccgctcctgcggctcagcgtggtggcctcccctcgcccgccaccccggcaactttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaaccatgaccgagatgagcgagaaggagaacgaaccggatgacgcggccacccacagccccccagggaccgtctccgccctccaggaaaccaaggtaacttggggggcgcaaggcctgtccgcgccccgggcccgggcgccctcttcccggcggggtcctcctgtgggcccgggcgtcctagggtcgcggtcgcgaggcccgcgtgaccactgaggctccgcgccgctcccgggggtaggagtgggttggcgacgaggggccacaaggagcccccgatcacaccggcaccgcacgcccgcgcgcgccatcgcgaccttctggggaggcggccactggtcttcgttggagagatgggcgcagcgaggccggagggcgcgcgtggagcggtgcgggcggggtacgcgcccggctgtgcgtgcgaggcgcaccctccagcggccgccgggtcccagtcccgggctcagtccgcgcctctatcctcgctcgtgtctctgaatttgtctctacaacctgcgtgtctgtgtcttggtgtctctgtgtgcgtctctc

SEQ ID NO: 86322 - DNA, 1344 bp, Homo sapiens
ctttgctcctcctcataggctctgttcctcaccaccattcgctctggataccttggggtgtagcccagttgaggtgagccttccccttcccactctccactgtcccaaagccttctccgcagcttcatctcaagctccagaatggagtggccctgccccctggtggccagatgtgatatggccatagattgtaacttacctgataagactgggcaggaagagcctcccttctcagacttgggacctcccaagggaggggctgtttccctttcttgttctgtccctgggtcctggtattacctggaccatccattttatacctcaggatctgaaccaaaaagcccccatctcagagacacagcaatggttgcatcagcactggttctccagctactgccggatgctggccaacttcactggtgaggctagtgtctggcaggagccagacctgtaggggactgagagtgggtgggacacacaggcaggaagcctgtctctgtcctggcttgttgtgggcccttcaactaacatttactggggactaagagttgcccagcattgtgctaggctctcgtctcacgaattatcccatataatttatacactattccttgaggacagtgcccagagaggttaaataacttgcccaaggacacacagctaacaagtggcagaactggcatttaaatccaagcctgactcccatatctgagcacactagggctatttgtagactaatagactgtgtcccttacttcccacccttgatcccaggcctctttcctcagtctggccctgtctgactctacaggtctggatctgctgaagcttacatgccaggaccttatccaaatctgcggggctgctgatgggatccgccttttcaatactcttagagccaggtgctggacactgccaaccagggtccccttcccactgtagtggcccttactaacttagctagcaggtatgtttcatacaattttttttttaatatggagtttcactcttgttgcccaggctggaatgcaatggcgcaatcttggctcactgcaacctctgcctcaggttcaagtgattatcctgcctcagcctcctgagtagctgggattacaggcgtctgccaccatgcctggccaattttttttttttttttttttttgagacggagtcttttgcccaggccggactgcagtggcactatctcggctcactgcaagctccgcctcctgggttcacgccattttcctgcctcagcctcccgagtagctgggactacaggcgcctgccaccgcgcccgtctaattttttgtatttttagtagagacggggtttcaccacgtt

SEQ ID NO: 86323 - DNA, 1013 bp, Homo sapiens
attagccaggcgtggtggcgggcacttgtaatcccagctcctcgggaggctgaggcaggagaatcgctggaacccgggaggtggaggttgcagtgaactatcgtgctactgcactccagcctgggtgacgagcgaaacttcacctcaaaaaaagaaataaaacaaaaaaacacttgggtgtgccagacgcattgtaggctgcttggagggtgaggacctgactggtcctgctggtgcctttttactgctttcggtgcagaatccagatggctactacttggttctgacctaggccaggggaactccactgctcaagagactgatagcttgtcttcaccagaaaccttgttaaaacacttggctgactcaacaggctccaggtgagccaaagtatcttgcatctcaccccgagaggaggcaagtagcctccagcttcacttttctttctggtcagcagcaatggctgttggaagtcttccttacccattcgttcttctgagctggccaagtttatgaggcaaaaaaaaaaaaaaaaaaactggcaatgtggaaagagcttttgccatgagcagtgttggctggtgatcactgagagtgttaattcatttaaaaattttaagccctttttaaattaaaagttaatttttaaaaggtatatacacttaatgtgttgtccaatgtgttgaacatttaatgtggtgttcagttttcttggctttattgtccccaaggggaaatgtcttctgcttaaactataaactagggcaaaggatggggtctggaacaagggaataaatcaatccagctggatctttttttcacaattagtttgggcaaaactaattactaaagcctccaaaagaccattcaatattcaaatcactgtacctactaaaaaactcagttctaagagatttaggaaatactatagctattatctagaattgaggctatggggcttttagaaaaaaaaatttagacatattgtttccttagttttaagagatgaggtc

SEQ ID NO: 86324 - DNA, 1059 bp, Homo sapiens
ccagctacttgggaggctgaggcaagagaatcacttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaacccttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcatacc

SEQ ID NO: 86325 - DNA, 1013 bp, Homo sapiens
atatataataacattaatcattaatgtctgaacttgggtgttggggactttcaggctctgttttgtgatttatcattttcactctttcctaataatacatctctctctttccttatgatacagttggtggagtctgacagaaggaagaatatgtagggggaatattggggataccatgcgaattatcacatatcagaagataaaatagaaaccaaaaggtagcatctgttttcatcaaaacagtttcttctcataacttttcttgctttcattagagtttccttgcaggttggcaaagattcaggcagggtcccctaatggtaaaatttagaattaaaaaaatatttattgataatatctttttaaaaaatgtttggtaatcccaactaatcattcaaaatgcaaactgtaaacacgacaacagcaaaagggtaacaattgagtgagtaagcagactgaacaggtgacagactgagcaagagtgtgggggggagcaacagagaatgtaagacaggtgcacaagtgtgctacagacagtgataatttgagtgtgtaagaattacatttggaccacagtgatttcaaggcaaccatttaggaaacctctgggccaaatactaaaacacaggaggaatggacgagccttctttgtgagcatgctcagcatgttggcatggaaacaaggaagcatagaagctctttagtcacaatgaatgtctaccatttctaagatgcaaagaaattttctttctggtccctgggtacatcatatattgtctttccatgcttttcttgaccccggaggacagcagatgctgttctaaaatccccaaagaaacccctagacaaaaatttaaaaaccacagtagcattaacacggggtttgctggaatgcccctccctatcttggcctatgattttcttatgggcacctcaacaggaatggttaaattttaccaatctacttgataaaaaagccatcacaaacttcagtcccatggtcacaaagctag

SEQ ID NO: 86326 - DNA, 1033 bp, Homo sapiens
tctattagaattccattgtagctttcaacaggattctattatagcttcttccctttgcaccaaaggtaagcacagagaactggaaggaagaaacaacgtgtgttcattttcttttaggtctgctatctgatgaatgtgttaagcatgtcttgatttcctttttggtgattattttcacagagctatcatttttttctttttttgttttgctaagatactaatatctatggatttttttgctcttgttttttagcaaatcacagatgaaggtctcattactatatgcagagggtgccataagttacaatccctttgtgcctctggctgctccaacatcacagatgccatcctgaatgctctaggtcagaactgcccacggcttaggtaaacatttcttgtttagctcaaaaaaatcatagaacaaaagtttccttcacccatatttcttccttggaactttggaattttaaggtaggcactgcagacgctttgaaattttaaggtagtcccttttagatgcccacctacttcctttttgtacctcatttgatttcatgtaattggtgtgaaccaaggggtaacaatccccaaattccactacttgctatccatactagaaaaaagaatcaacattttattacttgagatagaaagaaaggtattttctcttattaatgcttttgtataattcttttctcaaagtagtttttaaaggtccaccctaaggtcatttgtcatagtaatgataccaggtacatagcagggggtactatatttaaaagacactcttaaaggaatacctcttttgtactgatgggtttttaaaacagtcttatttctctctggctcctcagtttgaagaatgctgtgttttttactttttgtagagatggggtcaggctgtgttgctcaggctggcctcaaacctcagcttcccaaagtgttgagattacaggtgaaagccactgtgcccagcctgttactgtcttttgaggtagtgttgtgtatgcctgcctcaatctcctgggctcaa

SEQ ID NO: 86327 - DNA, 1620 bp, Homo sapiens
caacctaatgaatataaagtgctttaaaaagggtccctgaggccaggcgtgatggctcacacctgtaatcccagcactttgggaggccatggtaagaggatcgcttgagctcaggagttctagaccagcctgcgcaacatagggaaaccctgtctctactaaaaaaaataagaaaatttgccaggcgtggtggcatacccctgtagtcccagctgctcaggggactgaagcaggaggatcacttgagcccagcaggttgaggctgcagtgagctgtaatcgtgccactgcactccaggctgggcaacagaacgagacctcatctcaagaaaaaaatacaaatttagttaagtagagtataaataatctaaaatgtggctccttttagaccttctttgtgaatattgaacacatgtacctaagacggtttgctgtgtaggctaataaacttgataatataacaacttttatcatttataaaatattttcacataaatgatcttatttatttaaaagctttgtgaagtagagtggatggtcattttacagctaagaaaatctagaaagctgttgactgccaggtactgtgatgcaaccatgagatgtaaccgagtaagatattgctgcccttaagttgctcacagtcaactgttattgtggaataaatgctatggtaggaatgagtacatcagttttgggaaaacagagagctatggggctaatcttggactaagagaggttcagacaggcttcctaaagtcatttgcctgaagttaaactattaatattggagaatgaacttgatatcatggctttatcttctggatcttttctgcaggcaggaatatttcaaacaatttatggagtgtttttctgaagaatattatagaaaacttggaattcatccataatacaaatatgaagctaaactattaagagtagatggaatcaacaatgaaactagtattttgaaggcagagatcggacataagatatcctaaattcagcctacaaaagcggtactctagaaacatctcagataaggaaatacacagggcctttgtaattttttaaaataaaagtttaaaaggcttcattactactttggtactgtgagttgaatatccccgtttcaaaaatccaaaatgcagctgggtgctacttgagggactgaggcgggaggatcagttgagccatggaggtcacagctgtagtgagccctgatggcgccactgcactccagcctgggtgacagaacgagaccctgtctcaaaaaaaaaaagaaagaaaagaaaatctgaaatgcttcaaaatcccaaactttttgagtatcaatgtgacactcaaaggaactgctcactggggcacttcagattttcagatatgggatactcagctatgtaagtataatgcaaatattgcaaaatctgaaatctgaaacactgctggtaccaagcatttaagataagggatactcaaccagtaatagcattgctcgatggagaatctcgttttgaatcagagctctttattaattactctgtaaactagaataaatcacttaatttccattttttgtctagagagctttgagatatgtgataagtacaaaaggaatata

SEQ ID NO: 86328 - DNA, 1105 bp, Homo sapiens
tgtaatttcagctaccttagagactgaggctggaggattgcttgagggtgtactatgatcgctcctgtgaatagccagtctacttcagacatagcgagaccccatctctaaaaaaaaaaaaatttttttaaattccgttgttgtcttttagtatccacctcttagttctttcctgtgttacagatgaagtgaaactaagggaaatggaggaaggaggaggagaggtggacatgaaataatattgtcactttgaattttagtttctttcctttcacttcataacttcaaaagaagttttcagtagggcatggaacatttccaggattaagcagcaccagttcaacatgagattcagtcatattcagttcttcagagttcatggaatcctccaggtcctagactgttgctgaggatggttaatgtcaaataaattaaaaatactgaaaagaaaaaaataaaagtgtgtagatgctctatttttggactgagagcagtgaattggtagtggacataggtttgggttaagtaaatgaaacagaagtcagcataaaagaaagctcagaatattgagtcagatgttagaaggtgtccaaagcagaaagtttgacctattaagtaatgtgtctgttagctaaatgtattccttccgtaatgtttttatctagtgatttctttcttaggagaagtttagtcatgagacggcaatgcactggcagtagttagcttctaaaaagcaattttatttctgctagggacaagatgttgggcggaggaattataaacttactttgttttaggtttatctggccaaacaaaaatgtttttccttttagattcgggcaagaaaactggccaactggaaaaaacatctggtgttggttgaatgaaggaatggcataatcagtaaaaattacttataggaaaaatacacatttaaaaaatcttctgcagcttcaactctggattttttttaatgaaaattgattcttaatctctcattaacattttcctaccaccaaaagatttgacctgtattgggctacctttgtatgttagaaattttgcttaatctatgaaatttctttttttaaatttcttaatctat

SEQ ID NO: 86329 - DNA, 1719 bp, Homo sapiens
gggtccttttaccttttatttatttatttttgagacggagtctcactctgttgcccaggctggagtgcagtggcatgatcttggctcactgaagtctccacctcccaggttcaagcgattctcctgcctcatcctcccgagtagctgggattacaggggcatgccaccatgcctggctaattttgtgtttttagtagagatggggttttgccatgttggccaggcttgtctagaacttctgacctcaggtgatctgcccacctcggcctcccaaagtgctggaattacaggtgtgagccaccacgcccggcctagaagtggtcacacttttaaaatcttcttatgttttaggtcatttgttagtttttaactgttagtgttgatgatgctttttaatcctaattttaaaaaaatccatctcttttcattcccaaagttgtctgttttcaaatcttgatctcacttttcttgcaaatttataagtgctttcttacaggccaaggatctcattcctactctttagattactgtttctcaactagtaacatactagaaactgaattaaaaatttccgtatctggccgggtacagtatctggccaggcacagtggctcgggcttgtaatcccagcactttgggaggccaagacgggcggatcacttgaggtcaggagttcgagaccagcctggccaacatggtgaaaccctgtctctaataaaaatacaaaaattagacgtgtagtagtgtgtgtaatttcaggtactcagaaggctgaggtgggagaatcgcttgaaaccgggaggcgaaggttgcagtgagctgagatcgtgccagcgcacttcagcctgggagacagaatgagactccgtcttaaaaaaaaaaaaaaagaaaagaaaaattctgtaatctcagcactttgggaggctgaggtgggcagaccacaaggtcaggagatcgagaccatcctggctaacacggtgaaaccccatctctactaaaaatacaaaaaaaaaaattagcctggcgtggtggcaggtgcctgtagtcccagctactcgggaggctgaggcaggagaatggcgtgaacctgggaggtggagcttgcagtgagccgagccacagcactccagcctgggcgagagagcgagactctgtctcaaaaaaaaaaaaaaaaaagtttcagtaatctaactagtactgtggtttttagaagggtatttttagatgttcaaaataaaatattccgtgacaccaggaaaatccaaaggagggagggagaagaaagaaagcccttaaagtgaccaaatttagctacttgtgcacagttgtctttacactgttttcctacttgatcttccagacttagtgagactaagcgaattcttagatcagacccctcccacccaaatattggctcagaagagccaaggcatccaactgtggtttacagttttatgtcttaatgtagttggattcattagatatataaaacatttttacttgacagcaactaacaataggtggtggtattgaactgtgcaatagtatttgtgctcaattcatcttgcttagttgtataacttttataaaaaacaaagatacgtatttaatatgataaatccaaaccaaatttgcattagcttttgaagactttctcttaaagtaaatgattttattgggtattcagcaaagtttaaataattatttattaggcatttg

SEQ ID NO: 86330 - DNA, 1610 bp, Homo sapiens
aggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtgactcttgaaagattttctttcttcaggcctagatcagaaaattaagtgcagcaatatcatgaattctcagaagccctttcagggagccagtgagtcatacagtatccacagttgagtcacttaaagatgtcagtatacgaaacattattcacaatccttgggcaatctcatttttttttccttctcccctcctcccctgccccccatacatttctatccttgagttagttttggaggggcaggaagtacttaacatctcagaagctagattgggaaacatgctcagctataagaactgagctttaaattttgagtttaaaaatgtacatcaggagcagctggggagggtctttttttaaaaaaatctttcaaatttggttttctgtgcatatggccgttttgtaaatactttggggtttttcatttttttgaaagtagatgaaatctgttgtgggatttttttcccgaaacattacaaaataacctgtttatttacatgcaaataaacttctttgataaaaagtaatttgcctgtgtgtaataaaattttagcctttgaatacttttttcatttgttcaaaactccagtcaattttaaagagtcagtcaacagtaaatgtcttccctgagtactacttgaaatgggtcaactggtaactgacggagctgtgaaacttgtcttcattctattactctgtaggccagtttttctaccctttgccatttttttttttttcgagatggagtctcgctgtgtcgcccaggctggagtgcagtggcacaatcttggctcactacaacctccgcctcccgggttcaagcaattctgcctcagcctcccgagtagctgggattagaggcgcccaccaccacgcccagctaatttttgtatttttagcagagacggggtttcaccatgttggccaggatggtctcaatctcctg

SEQ ID NO: 86331 - DNA, 1570 bp, Homo sapiens
aagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtattgacttgtaatctcattttcctttcaaaaaaaaaaaaaaaagctaaggtggcttgttgggatgtaaacatgtttt

SEQ ID NO: 86332 - DNA, 1261 bp, Homo sapiens
agcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaa

SEQ ID NO: 86333 - DNA, 1050 bp, Homo sapiens
tactgagttccattattaccaattttcttttagttaagtttgaaattcaattatttggactcttgtttatagtttgcttttgttgtgtgattcataagaggttgacaattttatgttgggttagatttttagaatgtatttacccaaagctctggtatttgatagaactatttttgtcttacagattatttgccctacctgaaaactgcttactgcaaaactctgatgttatatctaaatctcaggtctcattcagcagctattgcaatgttaactttgttttcttctttattttgcagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaaca

SEQ ID NO: 86334 - DNA, 1099 bp, Homo sapiens
cctaacctcatgatccacccaccttggcctcccaaagtgctgggattacaggcgcgaggactgtgcctggcccttcctaatttattttcttcttattatctctgcaatcaaaagttttatttttgttgacatccaaattcagttacatatttggaggaaaggagctgggtgtggtggtgcacacctgttgttgaaggtgagaggttgaagtgagagcattgctgaagtcctggagttagagtctggcctgggcaacatcgggaaaccccgtctctacaaaaaaattaataaaaagggaaaagaaaggaaagttgttaatgattgatttaaatcaggtttcattgcttgggagctaataaaacacctggtaaagagattttgcccaccttccttttaactttcacactgcttattagcaccttctccagaaaaaatggaggagggagacaaaggaaaatattttcttttcttttgctgctttacattgatgctagaaaacttttgaggaaaatggttaaagctgattattaaaatcagttttatatagctgtgatttttggcactttgttgtaagattgagtagtaattttatgttttattttcctctctttcccctcttccctgaactccttatagggaaaaaaattttgatgaattttctaagcaccttaagggccttgttaatctgtataaccttccaggggacaagtaagtatttttaatatttttgcttttgtttgtaaaaatcagtataaatctataagccaccttatgcctagaaatttgccacctcttctgctgtttgtcactcctagtttctacttatactgcaatctgtagctcagcttccaacattgggcctttcaaagatatcttcaataggcagcacctgcattaatcgatcataatgctggaagacagaatataatctttgagatgtccaacattccaatttctaggctgaaaggaattagttgctgtggaactggctttaattctatttttaacctacctgggattctattaacgtatttggctttttaaaacagagataaaaataagctttgaagtgctaaaaataggctttaatagtagtgaa

SEQ ID NO: 86335 - DNA, 1036 bp, Homo sapiens
ttcgacctcccaggctgaggtgatccttctgcctcagcctccagagtagctggggactgactacaggcacatgccaggaggcttggctaatttttttctttctttttttttttgagacagtgtttcgctctgttgcccatgctggagtgcaatagtgtgatctcggctcactgcaacctctgcctcctggattcaagcaattctcctcccttagcctcccaagtagctgggattacaggcatgcaccaccacatctggctaattttgtattttcggtagagacagggtttgacactccagcctggtcatcaagagtgaaacttagtctttaaaaaaaaaaaaaaaaaggtggatagataacagtccagtggtatggtattccttacatcagacccataacttgtgtgtcatcttgccattaaaaatgtcttctttggatgttttgaagtaaaatgattttggaaaatattttaactgaattcttactgtgatgaagtgtgggaatttattttgcaaggaaaactgtggatggtcttgatagaacagttactgataacgttttctgatttaaatcatagagtcagaaaagctgagtaagatgagttctctcctggaacggctccatgcaaaatttaaccaaaatagaccctggagtgaaaccattaagcttgtgcgtcaagtcatggtaaggattgtggtgaagtgggtaaagtgttttgcttagataattattcttaatacgctaagctccccatgtagatgtgttcatactatcttcataaaacatctgaatacatggtggtttcaactttaggagtctattgtatctatactacaggttgaatatcccttatatgaaatgcttgggaccggaagtgttttagattttggattgttttggattttggaatatttgcaaatatataatgagatatcttggggatgggacccaagtctaaacacataatttatttatgtttcataaacaccttatagatatagcctgaaggtaattttatacaacatatttaataat

SEQ ID NO: 86336 - DNA, 3893 bp, Homo sapiens
tttgttaaaaaggatgttgaaattattttgtcacggagcctgggagtgtttgtttaatcagttaccgataaagttttggttaaaaaaaaaaaactcggtttgttccgtttcaataaagctttgctcaaacggggagctccgggagctcatcgcgagactcaggtgaaacgcgtttctagtttgggacctgatctcgcgttgtttgataagcaggggaatgaggtgaaagcgaagcacgaaacatcgcgagaggctactggactctcgcgacgatttctgggattgcccctccccccttccccaagtgccgtttcggtttaatctagtgtgtgactgggtctgtgtgagggagagagtgtgtgtggtgtggaggtgaaacggaggcaagaaagggggctacctcaggagcgagggacaaagggggcgtgaggcacctaggccgcggcaccccggcgacaggaagccgtcctgaaccgggctaccgggtaggggaagggcccgcgtagtcctcgcagggccccagagctggagtcggctccacagccccgggccgtcggcttctcacttcctggacctccccggcgcccgggcctgaggactggctcggcggagggagaagaggaaacagacttgagcagctccccgttgtctcgcaactccactgccgaggaactctcatttcttccctcgctccttcaccccccacctcatgtagaagggtgctgaggcgtcgggagggaggaggagcctgggctaccgtccctgccctccccacccccttcccggggcgctttggtgggcgtggagttggggttgggggggtgggtgggggttgctttttggagtgctggggaacttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccaggtgagctatttgtctaacagtccttcctcatttagggtgggttgcgaggaattggcattcagcgtgttaacattgtctggaagcccgcagtgttcatcattgactagaacactttgctgttggctagtcattccagtgtgtgaatctgtctccccttaacccagaattcgagaagtgaagagtacataggcctcaaaccgccaaaggtaggtacttccagtggtggggtcttcagttgtaagcttctgagtgagaaacgtcaaaggcttctgcttagtgagtggatggagttgatactagttcccagagcatgtctagctatttctgttgcttagttttatatttttaaaaatcacattggtatttgtgctttagactctatgggacctggttgaagacttaagaaattggtatggaagttacttgcctagtttatcctatttgtgttgtccactgaatccccaaacctgtacatttattcatttcctacttggcactgttttaattatttacaaaagattcctgtcttttaactgatgttttagtggaaattcagctgattagtctgttacccttttaatggtataacctagcagaaattggttccaaggacaatttggttttctttacagcatcatcactgacctaccttgtgaccgctgacaattttcaaaatctttctctaaaacacatagtaataatgccttctttatatttttgcgagaaaggcatgctagtttgaaattttgttgttagagtgaattatttggaaaactgtgttcttgttcctaggtaatgagatgtatctcctttgtggcctcacttctgttcacaaaaacagaatgtgggctttagttagacctttgtggaatcctaatgttgctttgtgacctttagcaaatgagttaatttctccttgcctgagttgcttcaggtgtaaaatgggaataataaatacctacttttaagggttgtgatgattaaattagtcaatttgaagtgcatagcacagtgccttgtacataatatcactcagtaaattatgagtgaggatgttgaacactggtagagaaattgtgctaatttgaaaaaaattcatgcatgactttttttttttttgaaagacaagatcttgccctgttgcctaggctggagtgcagtggcatcatcttggctcactgcagccttgacttcccaggctcaagcaatccgtccacctcagcctcctgagtagctgggattacaggttcatgccaccatgcctggctaattttttttttctttttcttttttttttttgtagagactgggttttgccctgttgcccaggatggtcttgaactcctgagctcaagcaatcctcctgcctcccaaagtgctgggattacaggcatgagccaccacgcctggctcatgcatggcttttgtatttcagtgtaatttttgctgacttaaagttacaattcataaatggtgtgagtacatcaagctgcagagtgttcctagctgtcaagggctggagttcttaatgtttcctcctccattttattataaaaaattttccagcacagaaaggttgtagtgaacacccatatatgtaacagcaagattctacaataaatatttgctgtatccaggctgggcaacatagtgaggccccgttctctacaggaaaaaaaaaaaaattagctggtcgcggtggtgcacatctgtagtccccactgcctgggaggctgaggtgggaggattgcttgagcctaggaagtcaaggctgcagtgagctgtgatcacaccactgcactccagcctgagcaacagagtgagaccctgtctcaaaaaaaaaaaaaattgggccaggagtggctcacacctgtaatctcagcactttgggaggccgaggtgggcggatcacgaggtagggagtttgagaccagcgtggccaatgtggtgaaatgctgt

SEQ ID NO: 86337 - DNA, 1742 bp, Homo sapiens
gggtgcctcttgattgggctggtttctcagactgtcctcgtttttgatggcacttaatctattttacaattgataagttacagttcttcatagtttgttttattgatctgttttcctccatatactactgtagtccattcatttaaaactggctttttatttttccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggataggtaagtcctatagtgaactggaaaaaacccccttgatctaaacataaagcattttctgttttaatctttgtcaacactaccctcatggttttatgaacaggaaatgtctttgatattttcagtgggaaagtctgtaattatgacattattacttgggaagagagaattagaatttgaggcctggttaacccattttatcattaagtttattttatttattttgtattttttgtattttgagacatggtcttgctctgtcgcccaggctgtaatgcagtggcgtcatctcagcttactgcaacatctgcctcacaggttcaagcgattctcccacctcaccctccccagcagctgggactacaggcatgcaccaccatgcctggctaatttttgtgtttttagtagagatggggtttcaacatgttggccatactggtctggaactcctgacctcaagtgattttcccacctgggcctgccaaagtgctgggattacaggcatgagccaccatccctagcctaagtttattgataatgctaattttgattaaaattttaaaaaaatcgagttttcccttaaatttttgttgaaaatattaatacctatagaaaaattaaaagaataataggctgtatgcagtgactcatgcctgtaatcccagcactttgggaggctagggcaggcagat

SEQ ID NO: 86338 - DNA, 1050 bp, Homo sapiens
ctcaaactcctggccttaagtgatatgcctacctcggcattccaaagagctgggactacaggccgtagtcaccattcctggtctatattctttttttattaacagtatttttattagaagtgtttccattacacccacagattcagttcagattccaaaatactattcatattctaaaagtttggcagtcctagagcttggtaggtttttaaattacacatgtattatgaaacctaattaccacatgtgaatttgtgtataggtataaatggggaactaggaaatactgatatagttagggtacatcagcgcttcctggtagtgacttttcaagtaatgactgtgatgtatagtatctgctcccctatgatagactcactttgcatgtaccacatgtccgcaaccctttataatactgagtgtcctatgctaaaggtgataatgttaagcattgtagttttgaggctgtcattaaattttcaaggtttttagtacattggaatttactgaaacaggatttgacctctattcaaattgtatatcctgaactggtaggacataacctatcaaatactcattctgtcttgaaataaacatgctaaaaatgtaatattttagaagcagtatacatttttcatacatgttcaatatccctaatccaaaaatctagaaatcctccaaaatcaggaacatttttagcgctgacatgatactcaaaggaaatgctcattggagcatttcagtattcagatttttgcattgaatatgctcatccagtataatgcaaataatccaaaatctaaaaattttaaaaatttgaaacactcaggccgggtgcggtggctcacgcctgtaatcccagaactttgggaggccgaggcgggcggatcacgaggtcaggagatcgagaccatcctggctaacatggtgaaaccccgtctctactaaaaatacaaaaaattagccaggcgtgatggtgggtgcctgtggtcccagctactcgggaggctgaggcaggagaatggcgtgaacccaggaggcggagcttgc

SEQ ID NO: 86339 - DNA, 1063 bp, Homo sapiens
ccaggcatggtggctcacgcctgtaatcccagcattttgggaggccgaggcacgtggatcatttgagaccaggagttcaagaccagcctggcaaacatggtgaaaccccatctctactaaaaatacaaaaattagtctggcatggtggcacacgcctgtaatcccagctacttgggaagctgaggtaggagaatcacttgaacccaggaggcagaggttgtagtgagccaagatcacgccactgcattctagcctgggcgacagagtgatactctgtctcaaaaaaaaaagaaaaaaattaagtatctttagttgtgattaattatttttttttatgttatagtacaggtttttttccttaaaaattagatctttctaaccttttcgtaaccaggcattatgatctttgaaaatttttatttgcgtatctttaattgtaattttgtcatctcttctcatttattgtttagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaagtgagtttttggaggaatctgtctttcatgatagttttctcccttccttttgaactaaatctctcatgtttcttctataacccacaccagtaagatcgtagaagtttggtcccaaagtattttttaattttattttaatggacaaaagcctttcttggagactcaggtcattcatctatgccctcagatacccagctatgtttttagaacaacagaaaattcccaaatccagatatactatgaatgtttatctcattatgtcttttttattcataatatttagagtactaaggaagaataaaagctttttaaattcaggatgtgtcaatcgtgtacacattaaccaaaaattaatagatatgggatttttcttcctgaaagcatataaattgtcatgccataaattgagtataaat

SEQ ID NO: 86340 - DNA, 1019 bp, Homo sapiens
gaggtttcattcaccatgttggacaggttggtctcgaactcctgacctcaagtgacccgccctcctcggcctcccaaagtgctggggttacaggcatcagccactgcgcccagccacagaagattaattcaaatattagctccgttgtttattattaggaaggactaattattcaactactcttcgtttcagtttcttcatctgtaaaattcaagggttttttctagagaacctgtggtcaactccaaaattatattaggacttgaggcattgttatttcagcattcttttttttttcttgcttttaattttttttcgtctttatgtaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacaggtaacatagtaaccaaataagattaagcactttcctcttctcctctgacctttttagtttcaaatggttaattggtattataattagacctaatagtgcagtattcacacactatttagtgatatttcctacgttcagtgtgggagaaacatacctgctcctttagctgttcttgagccttttctcagttaccagctttctgagtaaacattgatgtgcagttggtgattggccttttctgcctagtacttactcctaggttttaatagcgtaaacaaacaggaatctggttatgaacaggtgttaattcatcagaagtttttatcatttgctttcttcttttctgtttatttgcctatactgcattggtaatatcagatgtattatgcacactaggttttttgttttgttttttttttttgaagatggaatttcgctcttcttgcccaggctggagtgcagtggcgtgatctcgtctcactgcaacctccacctcccag

SEQ ID NO: 86341 - DNA, 1041 bp, Homo sapiens
ggtcttgctctattgcccaggctggagtgcagtggcctcccaaaattctgggactacaggtgtgagccaccatgcccagactgttggccctcttaagtctttctcaatctagagcaaatcatttcttttttttcccaacaataagtatttaatctagcacgttctaggtactgttgtttaccatgaaataaatttagctaaggagtcaaattcagaaaatgtaataatagtttttttttgttttttaagtgtaaggcattataattgaagtagtcaaaaaaggtttaattagggggattgagtgttaagagtagaagtaatcatgaactgggtattgtataaaattttttaaaaagaaagagaaaagagtagaacaaagagagcagaagttaaaatttatttttgtaattcctttacccctaacttggcgcatgacttttcaggtgtattttggaggccactgctatggcttatgaaaataattgttttttgttttacagtgggcaaatcaaactagcagattttggacttgctcggctctataactctgaagagaggtaaggcattaattaaaattacatgtgggaaataaggtttgttttgttttgtttttttgaggcaggatcttattctgttgctcaggctggagtgcgtggcttgatctcagctcgctgcagcctcaacctctgtgggctcaggtgattctcccaccttagtctcacaagtagctggaaccacaggtgggtgccatcacacctggctaatttttgtatttttagtagagacggggttttgctatgttgcctaggttagtcttgaactcctgggctcaagctgtctacctgcctcagcctcccaaagtgccgggattacagacatgagccaccgcacctgggcaacaatctctctcttttttttttttttttttttttgaagacggagtctcaatctgtcacctgggctggagtgcagtggcgtgatctcggctcactgcaacctccgcctcttgggttcaagaaattctcctgcctcagcctcccg

SEQ ID NO: 86342 - DNA, 1001 bp, Homo sapiens
aatccagtacaaactagtcagctttttattatggccttattagggcagttctaaatgagcagatttatacacacataccactttacataatacgtaattgtctttttttgggatgttaacagttacttggccattgcccacatctgttaattaatttgtggttattttatgatggtcacattctaattatatcatttcttattggaatacttatataaagatatcctcccatctgtttggctgaactcaggtctaaataatatagaaaaggtaggataaaagttaattctttcattttatataacggttttcaaaataatgaagtagtttcctagtatccttcaaagatgaccaatgaaaaatgtttttgttttttggttttattatgaattcttggatttaaacttatttcatgtattttaatccattgtggttattatccttattcttgttcaaactgtccagtctttggccagtgggagcttattcaggttatattttgagtccttttggcacaccatagtagtgttacagtagaaaacatcttgtttttggttccaagcttgtcctgttcatttcctgccccaaacctggaatcatccatttctctaaggagtcttagttccttttactggaaaatgatatttagaaactacagtttgtgtgttggggcatggatgttttaaattggccatgtttgttaattgtatcttatgttgtatgatttatgcccagtcacacactgtccttgacctttatactttacaattctgacatatatacttcccagtggagcaaatcacttctttccattcttttccttcctctattaatgtcagtctttaagaggagcactacaggggttttattttaaaattcaacagaatgatggagaaagagcataatttctgtggtagcctacccaaataaaataaagctttagttaaattttactgactcaagctgggtgtgtttttgttctggacaatttgctttaacag

SEQ ID NO: 86343 - DNA, 1050 bp, Homo sapiens
tgatcatgatacatggttccatggtttaagtcaccgcctttcctcgaccttctgtatacattaacaagccagccattactgtcctcgtctttattccctactgaaacttgaccaatactgttctccttttttgttgttatgccaaggaaagacagtatttatatgggaatttatatagctggtctgtacctagtattagcaagatcctcctttctcactatgtaactttcgtacttttatttcctcagactaccatctgccatgatttattttacactgctgttacctacttttactaacttttttggttatttttgttttccttattctttacatttcccacagtctttgccttcccattttaatcctttgctcctccattcattcactgctgcattcccttacatatttcccctttgctttgtctttttccagcctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggtcagtgccagaatggggcctttgtgcttttgctaagcgtatttggcaggttttgaaggtcaagtgtaaggagtttgtgtgtgtgtctgttttttagtttttggtccagtgaaccattaggaaagaggttaatgtcctcattatggtgagaaggagattaaccaagtttcgtacatatggtccagaaagtctacaatagatcattttcctttcctgaaatatgtacggaacactgtatctcaattagatgtgtggcataaatcagtgaattaggtaagccaaatttaatttaaggttagttcacccatgactttatgaaacacataatttggagccttgtttatattagatttgataagaccttcatagaatctagtagtgttaaattacaattgctaaatgt

SEQ ID NO: 86344 - DNA, 1168 bp, Homo sapiens
cagaacttgaaaaatacagataaagtgaagtcacttttatgcacaatccagagatgttttagttattagtgcctgtatttcttaagcgaaagcataaagagtaacaaaatgtgtcatgacattttgaggcatgaaaaaatgagacatttaaaatgaaatttcattttttggatattgtaagttgctgttgccagttgaagaaggcaaagggcccttggcctatctcatcgtcttatattggcttcactgtctttcaacaggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggtaaacagaccggtcatgaatctcattgagctcaggtgctgttgataccctcttaaaaatctcttaacattttttttcccccacatcaatggccttggtttcagttattctgtaacctagtctacaggagaacatagcaccaagtaatgtatttcttgcttggcttcttttatttaagtctcaaagcttcccaaagcacctttcctatactgattgtttttccacctcctaggagataggtaagtaaagcccctgtgttctaaccaaggaaaccacaaccatagctagtgatgcatcttgaaccacacatcttgaactgtgtgtggtggccaactagtcctagcacttggaaatctgacttccaaacaaaccattatcagactatacttctttacctctagtggagtggatgctgaatgccagtctttcctggaagatacaatcaagaaaaccct

SEQ ID NO: 86345 - DNA, 2047 bp, Homo sapiens
ccctgcttggatgttacatgtaacacctgaccatcttttgtactgtacaaccttacaattttgtagtgttttcagagtgctttcatctgcatgctaagggaatacaaacttaattactgattgtctttgcaaaatataattaaggtaaatatgctacaaaaatatctaattataactaaaaactgtttttggcttgttttgagtaatgactttacatcacagcttagataattgaagaatgactatatatatattttaaaatatgcttccatagggaaaagaaaaatcggtcatttggaagatatcccaaaacattaaatcttttcttcagcaggatgactctcaattttctaaaggcattgttctaccatacttctgtctcagtggttttctttgtcctcaaactcataccattttacatctctcctctcctgccttggcaggagttcattatcagacaatgtttatcatgcttaagcacatttaggcagcagtggaaaaaagaaagtctggtggaagtagttcaagaaagacaaaagatctttgtaaagacagagtatagtatgaatttaatatatttctaaatatttagttcttgtcaccgtctccaagataaacagatgtttatcaacagttcattctgcatgacactgctatagtgatttttttttcatagcatggaaaaaaatgcagtagttaggaaaacaaaatagaaaattatgatagaaattagtctttaaaattactgtaacataggaagctgaatgataatatggtagttacaatcctttcagactatgattttggggagacgtgactaaagtttggagaagcaagtgtatttttatacatgacagtaatgaaaactttttactttattttatctctcctatatattctttaagttttatttcaggttaacctatgtcatcaaacattctgtaaaatgtgttagccaagtccatgcaaggtctctgttgtagagcaagattatgtcctagaaatgtgaccacagcatgtatattgttccctctcatcttccttccttctgctttgttttaatgtttccatctaacagcaaaaaggggcagggagtctgccaacagcctgcatgttagaacagttctttaaaggaaggaaatggaggaaatcttagaccaaaatcaggataatcatttgaaacatatgatatttttacactagctgttagatccaggatgcaactgttttacttttaatcacttgatttatttataattgcaattttctgatcccaagattttattctttatatatctggttacttatattgatatttgtttatgttgcacagtgtgtgtgtttgtgtttataatcacatgtgctttttaagatggtgtttaaaagaagtaacccttccacagcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttat

SEQ ID NO: 86346 - DNA, 3030 bp, Homo sapiens
ggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtgggggattgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagc

SEQ ID NO: 86347 - DNA, 3011 bp, Homo sapiens
cctgagcatatctaatcatgtataaaggacgtttttcctccactttatcttaggggttctctgtctcagaatcattatagactcattaactccccctcccagcaaaaggttatcaggatttgaagaggtgcttgaaaacgctagactaggaactagagaataaatgagttgggaaaaaccatgaaatgtgatttttttaaagtagaaaagttatacaaataatggtaccaaaccatcaaaagagttgagcttcatgtaccctgactcctcctgacaggagaggtaagtgggtttgagctcaactgtcatcaagggaagttggtaagaggctgtttagacccaaaggatagtcttaaaccagacttcaccacccaccctacctcagttcccatgttattacatgcagagtcagcatggggattagtgtacctacctttgctgagatttcccgatgcgttgccaatccagaaagtgaatcaaaaagttgtttaaaagttaaaatctctattgtttccaaaatctttcccatctccacctgaagacagaattgcttccccttctctttcatggcttagaacacaggataaatttgcccctgtggtatgtgctgcaatcctgctagttatgacaaatgggcagagggcagataaagtccactaggagaaagaaagaagggcgataggtatctgaagttgtaaatggggtgagcaagtcatacaggaaggttaagggatacaccagagcaagggaaattagaaggaagttgagttcaaaaactggtgatgatgagagttgctaacctgtttttgaatcctcaaaagtttaagtggtgttccctttcctgtgggctaagtcacatcttataaggagaatggagagctcaagattgttccaatttctggaattatgtgttcctggttgcaagttcatgattggggtataaacttcaacctactagaaaatactgttttcacttcatagcagtgaaaattgaagcagtgtcttttcaattctgggcctaaaggctgaggaccttactaacctagatttttctgtcatacccaaggccatttctaaccagaaaccatgctgttcagtacctcaatttcttaggcactgttctttcctagataggcatccttaactgtatggttaatgcctcaaagaagtaaacagttaatgctcttggtgctgatcttgggatttccattgttattaaagattgcctcatagcttgactgttttttaactatggagtgacttttcatatcctaatcatccataagggctaagtggaatgggaatggggaattcctcaagggaggaagcactcaaccattccaagggagaggtggaactgctgagtcttctggttgtcctgagaggcaaggtgagcattcctggacactttggttaattttactgtccaggtgtgacagttcttatctgtaggaacacctccagtgttcctaattaggaattctctcaagtaggagattactccaagccagagttgaaagactgggggagtacgacacctgaaggaattactggtggtactccttactgtacgcaactgtctctccatctcctatccacccacttcttttccctatttctctttctccccactcaccattcaactggaataatttaggcctaccatcggtattgattgcttaaccctaccaggtatttagagttactgctatttcattgttttgaaaggtaatgagagtcaattcagaagacaaatgtctatctggatcctcaacctactgtagtggaaagtgaaggagaaagtaaactaaccatactttcttattgctaggagctatgaaaggagcttttcatttgtgttatgtagggtacaaaagattattttgtaccctggccaggaaaggcagggagtcatctttctgtcttcctgcttcccctctttcaaccttcacctttttatcctcttcttccatatcctgagattgttgcttttgctgatgacatttctaagctcagttgcagatggtgtctgtgggaagtaaagcttggtgagaagagggctctctggtatctaagagaaagcagataagagttgctttaatgtcctggtgattaatcactggggtgccaaaacactttgaccactggatttctctcatatctcttatctcaaaaaattagtactccaaggctgagagaaagagactgatactgagtttgtctttcataccctctaagtgggtagtttgttagtggaccattctcaatttgcaaccttcagctacagcatacttctgtggaataagaaggtatagccatgaaataaatttacttagacccaggttctctaggacctgtaaatggatggactttttgatatcttgctctggcatgtttgtaaactacagatagtattgacagctctaaaggaatgaagggcattttatccaggccaaaccaaccctgagggaggcagcatgaagaaacctttaagaagtccaccatatagcagtcagagctaagtaaagaacaaagtctgagtcttggaggatgtcttttctctacctaaggggcctatctgatggactctctaggaggggatccttctccctcctcagtctcagaactacaatagtgcctaatgagggacacccttggtgaggatcagcttgtagatgaccctcctcaccaaggctaatgcaattttgaatgcatttggacctggagaaaacaggctgaattcaaagacctaaagaaagcttagtagcctggtcccttttttaaagtctggaactttttagtttggccttatactagtgttaatatttataatttctgttaggggaccaaaagtctcagaaaatgaagcaatataagaggtggaaataagggtaagaagggagaactagaagagtctggtagctgggctgcagaaagagacttggggtataattccttatttttatttatttatttatttatttatttatttatttatttatttttgagat

SEQ ID NO: 86348 - DNA, 1063 bp, Homo sapiens
gcccagcttggatataattgcttataaagaagagagggatacaggatggaaggaaaaattatggttgagttagtgaaatttataggataattttcttagagattcacagttcatttcaggaagaccccattaaagcaccaatactgagtaaagaattccccttaattacagtagtcttacctttagggttggaggatgggccaagaacccctaggatactatgaagacattttctgtagggaaactagaaaagatgggcaaatatgttaagcaatatgtaaggacatttacttaacactgttatctacatagttcaagagagtaattcaagaataaggaggaatgacatggatgcatcacattaaacagttatttgtattgtttgaatttcaaaactcctgcaagtggttttaggtatgctaagtcaacctagagactagtagtattcctctgccactcattttagatccaaatgatggcagtgcatagaagaacaaacgagaatatgcgaattagagtcacagaatgttagagctacaaaagaagattagtttgtttggttcagtaccatctttaaccagtaaaaaatgcccagaaaggccgaggaacatgtatggtgttgcgagaaagaagggagagaaagggaactaacattgttgggtacctgctatgtgtcaggcgctgcctaagtgctttgtttttatcttgattgattagcaccttgaggctaagggatagaatgaataaatggcaaaccccggctacctgggagcggtggctcacgcctgtaatcccagcactttgggaggccaaggtgggtggatcacgaggtcaggagatcgagaccattctggcttacacggtgaaaccccatctctactaaaaatacaaaaaattagccaggcgtggtggcacaagcctgtagtcccagcttcccgggaggctgaggcaggagaatttgcttgaacccaggaggtggaggttgcagtgagtgaagattgcgccacttcactccagcctaggcgacagaatgagactccatctcaaataaatacatacatac

SEQ ID NO: 86349 - DNA, 1047 bp, Homo sapiens
aaaactattataataagaggaaaccaaaggaaagaaataatcggagaaagtggacttattcagaaacaattatttgaaaataaagaagataggggacatagaacagaagaggaaggtgagcagtgggaggaatctcatggaagagggctcatgtatgttttgtgcagaggctgtgaattggctgaccagaatggtacaggaaaggagtattaggaaatgaagttggaggagcaatctcattggcttgaatgaggaatttgagttgttaagcagtagcagggaacagagcatgatgagatgaaaatcacattgaggacttttgtagcagtacttggtcaaggaagcaggaaagttcactaaaatattattgttcttgccaagacatgaagcactgagagtttacagtagagtaagacaaggagaatcagaggaaagaaagtgggtccataggaattagcaaggcttggtcacagcttggatgtgaggagagggataaaagcctcaggatgatgatcccaagacacatttgtgctgttggtggtgatgaaagcttgataagagggaactgctttgtttttaagtaggaagtgttttgtcttattaaccaattgataggatgtgtcaatgttcagtattgcagagtctaggagggggcactgcccctggaggatagtggagcatgcaccatgtgtccagatgataacctgcatgcaccctgcccttttcaggttgaagaaccaggcaagagggagtctgttgctagggtgtgcccatagacttcaagaatgctatcctactctggatctgggaaagaaaatagtatttttgccagtttcttcccctttaatgctttgaaaatgggatatgactagcctgtggcagcatgtgcctgtggatgcacaattctctagcttgattcttggaaggcctttttctgtccctccctagggatcatttgtatctctgattcctgctcccagagccataaagtgggagcccccatttattaattgggctgggactggggcgggggtcggcgggggactc

SEQ ID NO: 86350 - DNA, 2179 bp, Homo sapiens
ccatacctgctctcagtctcccatttgctttatcaaaattcagggttagagttagactgcctcaacttcttttcctcttaatgggaggagtttgagtttggctctttttttttttttttttttttttgagacagagtctcgctctgtcacccaggctggagtgcagtggcgcgatctcggctcactgcaagctccgcctcctgggttcatgccattctgcctcagcctcccaagtagctgggactacaggcacccgccaccatgcctggctaatttttttgtatttttagtagagacagggtttcaccatgttagccaggatgatctcgatctccagacctcgtgatcagcctcccaaagtgctgggattacaggcgtgagccaccgcatccggccccgagtttggctcttaaaggaaggcctccttctgaaacatacttgtccctttggttaagccagcaagggaaaggtaggcatctataggggagtttctctgcagtggcccagagagaagctgtaaagggcaggaatgaatgtatcacttcctgatggaatgacacgtcttctcccttagggaatcatagattgccagggctaggaaagaggtcaggtaatctaacctctccctttacagagcaggaaactgaggcttaaggaaggaaagtgccttgcccacgcagtcgcacagcgagttaatggcagccagccagaactagatccaagaggccagaatcttgacttctgcgagtagagtgcccccaactttaagatgaccctttcctgagagccctgagcttcttcaggaaaggaaggatggactgtgagatttgaggagggagagagagattgagggggaaaggtagatctagaaagactgggaaattatatatacatatatatatgtgtgtgtgtgtgtatcttaaagaataatctttttttttttttgagacggagtttcgctcttgtcactcaggctggagtgcaatggcgcgatctcggctcactgcaacctccaccttctgggttcaagcgattctcctgcctcagcctcccgagtaactaatggctaatttttttgtattatgtagcctggctaatttttttgtatttttagtagagacggggtttcaccatgttggccagtctgatctcaaactcctgacctcaggtgatctgcctgcctcggcctcccaaagtgctgggattacaggcgtgagccaccgcgcccagcctcttattttctttttctttttcttttctttttttttgaaacggcgtttcattcttgttgcccaggctggagtgcaatggtacgatcttggctcaccacaacctctggcctcccgggtttgagcaactctcctgcctcagcctcccaagtagctgggattacaggcatgtgccaccatgcccggctaattttgtatttttagtagagatggggtttcaccatgttggtcaggctggtcttgaactcctgacctcaggtgatccacccacctgagcctcccaaagtgctgagattacaggcgtgagccactgcacccagtctaagaataatctttcaatgacatgcagattatacaagtgtaatttttatttaaagtcaagaggctggttcattgggaagcagatggcagccacagccaaagatcctgatgccctcagagttaacccaaacttcaaagagcattttgcaactatctctggaggttggatagcaggaaaagatccttagaggcaatgtgaggaattcaccctaaatctcaactgaagctcttttgctatattgaaaagaaaaagggaatggagaaagaaaacacatcggctagaaaactatggtggcggaagggggtccctgaatgatagatgagatgatagaactcagcaaaaagaggtatgctctgagattacaggaaaatggtaaggggaccttctcctctcctttattttagtttttaaagttttgagttgtttgatattctcctttgatgaggcagaaggaaggtggtatgtggtgatccacagtggcctaaataccctaaatagtgtgttcagttggctgacacgcattgctggttctgtaagtcatctcagtctggtgccaagatgcctttccctctttagacccctcctggatgtatctacagtcccttccagtgtttgctttctctgagca

SEQ ID NO: 86351 - DNA, 1279 bp, Homo sapiens
ggtgaagggaggagggcatcattgggcagattagaaagagttaatgggtctaggggagaggtactggggatctgcaaagtgaatattgtctgctgctgatgaagaaatagatcccagtacatatcctttacgttttgttcatcaactttgatagacagcatagaggaaatgtggaactggtctccatgtaaatttgtctctagggaatgtatgatagacctacttgtccagattacattaagtttgctgtcctgcaaacctcctttctcacagtcaggatccttttttgccttagagtccttcctgaaggagctgttatggatgagagagccacaagtccaacctcatgatctgatctaaaactgggtggcctcctcccagtcaccttcttttattagccttatattaaccattaaccttcattgatctttatgattctgggtttcacagcttctgtttctgttgaattccctaactttaagaaccatgtttttgcttttatcagcctgggagctaggtccctggagacaagaattttagaacagttatgactctctctgggagtgtactaaggttagtctgaatccttctggggaattcaggtttgaaggagttagaagagtgctaacatcaccgtcactgttacctaccaatggatgcttcctgggtgcaagaccaaagatgttctttggtgtctagtcccttgtctcatgtctaatgtaacctgccattttcctttacaggtaggagcaacggtgggaatgccctctgaggaatgcagtgatgtccatcagtcacctctcacccagagcctggcaaattcagtctctttcacagaacctaaagccaagccaggtaggggcctaaagccaatcagaggtcactggcctgcttttgtgtgggatgaccctactcccatcccaccccaccccacccctggtcttagagaagtttctttcttttttttttcttttttaatttttattttttgagacagagtctcactctgccgcccaagctggagtgcagtggcgcaatctcagctcacttcaacctgcgcctccggggttcaagtgattctcgtgcctcagcctcttgagtagctgggtaacaggcgatcttttttttttttttttttttttttatggagttttgctcttgttgcccaggccggagtgcagtggcatgatctcggctcaccgcaacctccgcctcccggggttcaagcgattctcctgccttagcctcctgagtagctgcggttacaggcatgcaccac

SEQ ID NO: 86352 - DNA, 1050 bp, Homo sapiens
ccaatttttttagtatatgtgctgccaaagcaagcaccaaaaagctattttctatttctttcttctcagtcaagatagggcagttctgtcccttctcactacctctaatcagcttcttcacttcctttccaggttcagtgggaaatcccacctgtccaaacactgtgtgagacaccagaattagaggcctgcaagcctgcttccttcatccccaatgcccagatgggacaggtcaccagcctcctgtgtctacccccacctttcttgcttgctggtaggtgtgctgctccccctacccatcaaccccaaacagggttatgtttctctctcggagtatttttctctgttattaaatgtctccaacaaggggaaggccttggtgactcgcctgtatgtcttcgtaacttccagcccgaatctgtaaagagccgctaacctcctggtatcaaatgtccatccctttttctatagttcatgaccatttttcccatttagtgggtgtgggaatggaccagtaaacagatggtatttggtactggagagggagagtctaatgacaggtagcctttcttctgggggctagaaatctgaagccacagatgtgcattcttcctagttgcttgctatcctgggagagtactaggatttttttttttttttttttttttgagacggagtttcgcttttgttgcccaagctggagtgcaatggcacgatcttggctcactgcaacctctgcctcccggattcaagctatactcctgcctcagcctcctgagtagctgggattacaggcatgcgccactatgccaggctaatttttgtatttttattagagatggggtttctccatgatgatgaggctggtctcgaactcccgacctcaggtgatccgcctgccttggcctcccaaagtgctgggattacaggtgtgagccactgcgcctggcctacctggatcttttgagcgaatggttttatgtgtgcatttgtttttaataatatccagactgttccgaaaggaaagatgatttatctagtgtctatttc

SEQ ID NO: 86353 - DNA, 1020 bp, Homo sapiens
aggtgggctgaggtagacagagggatagagcaagtgttagcaagaaacgtccctggatgtagtcaagcagtaagtatgcatggggtaccttgagcaccagcatttataacttatcttcatgtcttctgtctaccaggttatctgatcacacagaacaggcctgccagttgggcagctgcagtcatggtttctgccacacgagggcgctgctggccaattaaaactcatgccccttagcagacagtttggggatgagggcaccctttctccaaaacaggggtcagaaactctggggctctctgggccccagagagcatgggcccaaaaagtgagacaaatatttggtaccacttgttcttccttgaaaatggcctgagacccctaaacactttgctctagtggcctgacatctcaatgtgcttccagctgaacttgggaagccccctctttccaggcacttaacaccttgcacaggtgcatctctcccttaaggtgtagcaggttccagctgtatgccccgttgtccccctgccttaatggcagtcactttccgacccagatggtggaggtgcctgtggtttttagggggaaaaaatctcttataattgttctaagaaaagtgttttgttagtgagaaagtgttaggggtgactgaagcctgggagagttagtctccccgtcacctactccagcacaaacctatagaattcaagatggtctagtggatgtttgcagcctcagtggctggaatacaccccaggacattccagggccctgagccaaaaatggtgtcagaaagctggataggagtgtgggctgctttgggccatgagcctcatacccaccctgtatcaggcagtgtttctgctaggggtgccaaatggccctggggcctctatgggactgaggactccacaattgaccctccatctccatgaagcccttccaggctgaacaggctaagggacatgacagaggttctcctcctccttcctacccccatgcctgagggcccctccc

SEQ ID NO: 86354 - DNA, 1019 bp, Homo sapiens
tgctcctcgttatagtcttcccagtttggggaagagcagtgatatgccaagaatggaggcctcagactctcccaatccctgatttttacatgtccccctataaggcccctctgccatctacacttttgcccttcatccacaaagcccaaaaggaaggcattatagctagccatgccctctgactgccctctgcccctttaagggaaatggaaatgggtacccagctgactgaacctactcaacacctccagaaattagacactagggcatggtgccaccctcccaggctggcacatgctaccctggcagaggatcaaataacccccccatcataccctgccccatgtcttcctctactctctccctcatgctttctctctctctctctctctctgtctctctctctctctctctctcagctcaaagcacagctgagccttaaaaggggggttgagggggtggagagaccaagctggggcaggggggtatagagctccaatagcacgttttcacctgccatttaattggatgtatttttaattaatgggacctcagggaccaacatgagacaatctgatatctgaatagggacaggggagggattgggtaagggaggaggattgggccactgggtgcggttaccgggaacccaggcccatcaatcactggccactttgcgttctggcatggagaatagcgaggtggaggaagggaggcactggggagaggtgccaggatttccccccaactgccaggacctccaaacggattggaactatactggttgactcaggtctggagcccaaaatcacagccagaatataaggtgaggctgttttcttgctcctggggttttgtctggttgggcttgtcccagggagtgctgtaaaattgtgaaaggaaggtggggacagagctttgaggtccttgtagagagaagacaagagctatggaccatagaaccagagactatggagagacggaggagaagggcagggttcagaggtatttctgtatgt

SEQ ID NO: 86355 - DNA, 1051 bp, Homo sapiens
gtcttataagatctacagggaaggaaatgcattatttaccccacctccttaaccaagaagcaaatcccccaatcaagactaaatgctgagcttttttttttgaaatcttaccacatatttccctgctgcaatataataagccactggagaaacttatgccaacaaatgtgttaaggagtagtcttatacgtcttgtcccatggcaaagcctagaacagagatagaatttaaattcaaggccctgaaggctgaattagaaatgctcctgaattcatgtggtgccatggccttagagctcttagacccctctgactcttgtagtgttgatgtacactggagaaaggggcaagtttccagctgtacccatccccaaccccttgcttccttcagtgttcacatgctagggttaggagggaagaaatgaaggagaaagggggttctcccactaggttgccaaggtggcatttcttgccatcctcctccttcctcagaaaattcaacatttttagttccatgcttcatgagactaagttaggttagggacaaggataggcacagagcttggaaagcagtgccagtaaaaactttatcacactccccaggcccccaacacccttcccccacccaagagttgccttctcttccccattttatatccccaaatcccctgagaagagcaagatctgcctaagtgccccccagcctcacccagcccttccttcagactgtgagtcatctccttggctgtctcattgcctgccttcttaactgcagacaggatgagaagagctctcctcagatccctccaaaacagtttggaaagaatttatctaggaccccgtgcctacttctaagggccccaggggtgtcagcaggggaggaaggctgtgccaaggggctggaaaggaagattctcttgttgggagagcagataaaaacctgaaagtggtgacaaggcagagggcgaagtttgggaactgagacctgtagtcccacctgtggggctggctgcctaatgtgtggcaggacatttagagcaagtatggtttgt

SEQ ID NO: 86356 - DNA, 1890 bp, Homo sapiens
taggtgcgcaccaccatgcctggctaatttttgtatttttagtagagacgtggtttcaccatgttggccaggctggtctcaaactcctgacctcaagtgatccgcctgcctcggcctcccaaagtactgggattacaggagtgtggctcagcctctcatttctaaggtttagccaagggtgccagatctttgcggggaagagggatgacttgaagtgagtggaagttaaaaatggtagtacccagaatttcctgcactttggagaaaagagactaggtggggtactcaatgttagcctacggctcaactcttactctaataggatctctttcctccttctcccctaaatttttcccactggttgaagagagatctggatgactaaacctcccatcttgacaccttggagtttgttaagcaggtcccctctctgtagcttccaaagccatgaagaaggggaaggaaggccaagacaggggtagatagaggtggcagtgccatggtgtccatcagcacccaaggagaaaggccaaggagaagaaggtaactagagaggaagccaggaggagatgtctgctcctgaaacagcattcttaccccatcctctcctgcttccttgatcacatgccgacagggctgtttgcccaagtgtgccagctcgcctggctagtgatcctgctctgctgtgcaggcagccagctctctgccccagcacagagcacatgctgaggtctctcacactcctttgctcactcatttccatgtgtctatgttgtggattcctagaaatgaaggaggggactgtgggcttgaagataggaagatggcaggctctggggcccattgggcacatatctgcctggctggaggaaggaaagagggagaaggctgctggtagctcagcaagctcaaggttctggtgactcatagcagtggaggtggctcacaaaaacaacagaggggaagggatccaggcctattagagctctcttttgccccatatctccccactctgagctctgtgaatgaaggtccctcatctggattgtggagcaggggaggccccaactataaaaaaaacagggaaatgggagagaagagagcaggggaagctgagcattcccagtgagaggtatctcagtgaggaaaggataggagaggccagttattcttgccctactgtattcattgggtgcacaggaggtacggggcatccatctgtgctagggtagctcagtgcccctgggcactttccagaagaggggtttctaggcaaacacagttactcctccctaccctcacttgcctgcccagaactctaggtacccagctgacactaaatttttagaagtaaaacaagctgtgttataacaccagaacctggaaggataactgctgggtctcagtcctctcctttctggaaacagacacctgggacaagagagaagcagctagggactcctatgctggctgaaccaaggtagtggtgcaggctgtggaggtgggtgcagaaccatagatcttcagaagtgtcgatttcctcctcccttgtgtgccaggtgggcagtatgcatcgtctccatttttctgatagaggggataatagggtaacggggtttgaggtcacaccaggagaaagaggccagaaagtggaccaggagaaccattcatgccttggactccagtcccaggggcctatactggatctggtaaagagtaacagctaggatagccgggcacggcaaatcacacctgtaatcccagcactctgggaggctgaggcgggtggatcacgaggtcaggagatagagaccctcctgaccaacatggtgaaacgccgtctctactaaaagtacaaaaatgagccaggcgtggtggcgtgcacctgta

SEQ ID NO: 86357 - DNA, 1642 bp, Homo sapiens
agagtaagtgtaacagctgctccttgcttgcagtgtttattgttacctagagacaacctcctggctttttcccagctccccctccccgctagcccaaccccctccctgccaacaatcctgctctctccacactgatgggaaatttatagcttgcccataccatgcctttaaccctctcctatccatagggtagatgggctgagggaagccaagtgagcagcaggcatgcttgggcaccagcagggtagaataatgtgtggaggagggagggggcaatgacacccctcccctccattctatgtgtccagtcttaggcccctgctgccctcctggctctcagtggagagaaaagaggaaataaatttggacccagccttgagatcctggaagagctcctttggatttagccttgggatcctagcatctcctcacaaaattatgatcttccctgggcatctctaagccaccaattgggttgcctgcacctgagcaaatacagcaaggtagtattgaaacagaagggtaaatacagagtggcagaaccctcagatccctcctttatgtctgagagagaggtagctgtagagatgtcttatcaagacaagaggtgctggcttgagaaatgctggctggacttctacagctgggtagatgttagacatgaagccggccgctgagtctggtgggagaaactgcccgccttaacatcaccctgagcgcagcactaagatcctgagagacccctgggtcattctctaagctggtctttttgatctggttatgctgctgctttttacttttccttcctgggtcattttctcctacacatcttctagtttgacaccttggggtagatccaagagactgagaagatggaggcatcctagtcatggcctcaacaaagctggggaaagaaaaactccttctgtcctctcttgacctttcatggaggggcactgtgtgttctactcaccatcctcactggaaacagaagagaggaaaaagcatcagattttagcagaaaggatagagggaagacatatggaaaaacttactcatgggatgaaagacttcagattggacctgcttctcttctgagatttttcttctgcctgccggtttgtttttgtgtctacctaagaggcattggatgaagcacagttacttttccaggcctcttccagacagcctcagcacagtttccatacagtgcactgcttcttggttcttctaaatgtcatgtagtatgtgtggtggttagatcacaagttttggagacagacagccctgggttccagtgccatctctgccacttaccagctgtgctaccttggtaattcacttaacctctttgagtcctagtttccttgtaaaatgcagaaaaacaactactccttaagtttgttgtgagaatttcgtgaaataatgtgtgtaaagcacctacaacagtgcctgatactcagtaggtgctcactcaacagtggctggtgcaagagtactactacttttatgaagttagcagggctgatattgcttcaaagactttgtgagtcccctgagattaaaggccaaatgtatgtgcacatgctgggggagaatgtagttttctacacgatgtggagtaggggtggccatcctctgg

SEQ ID NO: 86358 - DNA, 1044 bp, Homo sapiens
ttagctgggcgtggtggcgggcgcctatagttccagctactcaggaggctgaggcaggagaatggcgtgaacccagtaggcagagcttgcagtgagccgagattacaccactgcactccagcctgggcgacagagcgagactgtctcaaaacaaacaagcaaacaaacaaacaaaagaaatatgagagggacatagactggaagtggccaggaagcaggggcagggaagggcgtggggagtggcaaatgccagcctggaagcagctgttagggtccactccaggacctggagctgtcccttaagaatccctgtggatatccccttcccgcattccaagttctaaatattttgtttcccctctctacctgtacttaagaaaatatatttccacagcttcccttgatgctctacgtactgcagtcttttcttccactcttccctgttcagaagttcttcctcagttgtaaccttctttcttcaggctgcggataatccctctaagagctctctaaggcaggtgctaagggaacccaagacagggtttcagttattaaatataaatagacaggggaggggaactgaatatagacacagatattttatctctccgtccgtgttagttattaagaagaaagcactagtggttgctaagcaacaggtctctatagaggacaaggtaccagaggaaaaagcctcctttgactgaatatagaggtgggagggtaggaaaggtgggggtcaaagacctctgaatagcaggccagctatagggaatggttggtttgtcctccaagaccagccctttccccaggccttagcaaactccgcctttacaaccctcaggattggtggtaggaggaaggccttaggcactcctccattcctgccaggaggagggaacctggtttccatagcaacccagaaacaatcctggccttgttttgcttatggcttctctgtaaccccctcttgggacacacactatcatagactcccttctctgaccctcaacttctgatttgagggagagagcccatagaaag

SEQ ID NO: 86359 - DNA, 1119 bp, Homo sapiens
gtctgtcggcctccattgggttctccctgctgccaaaaagtcctcctcctggaaaagcaggtctggggttggggttttcagttggagctcatcaggatccccagaggcaaagctattgtcatctgccttcctcctcctcacccatctgccaggcaagtcgcaggtgagcccccaccaccatggcccctgccctagccccaggtgccagcactgctttgcctggctcccaccctctccctggtgcccccaaggtggctctgaggtcaccccacaccccagtgcctccattctgcatttctacatctccgaatgcttgggaaaaacagaaggagagaggaggtcaattgaaggttggaaatgtggactctgactataggtagagcattcgggggcctggttatcttcctcagttcaaatgaaccctttccccaactcccaccccctcacccccagagacagccagagctttgcttagttaatgaaatacaaaagaaggaatcaggggtggggggtggctccagagccctggaaagcgagggagagagaaaaagttgggtctcttccaaagagttaatgttccacagtatgatcgattaggtgtcagatgtaatttcaaaccaatacaagatgaatggcataattttccctctctcattttagacagaattaagaatccattagctaacacaaatttttggcaagtttaataggagctcaaatctacattcggaggaaatgctccccaaagcctgtttcaagcttttacttctcaggccccctgcctccaacgtcctcttaccaactcactgttgtctgtccacccaccaacccctcctcccccgccgcatgcagcccccactcccttcctctggtccccctacatgcccctccccaagccagcccaagattaactggcctgacctctctcacaaaggccgggcctgcccaccattgtctttcagtggcaatgggtgggggaaatgggtggaggggctggcagtgggcccaggagaggggagaggttgctgaattggccctaggctgcagacaaaccctagggagaggggtatattggggccttgggcagtttgagtctcagctactcctcagtttcacctc

SEQ ID NO: 86360 - DNA, 1063 bp, Homo sapiens
acggccgtgaataacttcctaattggtattaaaagggccctttgaagtcttgagttcttagaggtgcatagtaccattgacactcatttctaatgacacgttccctcaccccgcatttttgggttagtcaatgtctcctggttttcttcgtaccgctctgacagtcggtcaaagtcccgcttcacgttttcctctgtcgcccaacccctcgctctgtacactgaatctcagtggtcttattttcccccacggcttcagctttacaccaactaaatacccagatccacatcttcagcgcagcccttccctggagctccacgcttgcccatccagcggccattgggacagctctgcttcacatggagctcactgggtccaaacttgaactggtcttttccttgcagattaattcttcctctaccccaacccagccggaagtctggtaatttccttacactttctcctctctttcaagtcccacatcttaaaagtgacctagtactgccaacttcctgaacatccttcaaacctgggccagctccatctcttctgttaccacgctgttgatgtattgtcaattcccaacagtccagccctggcagcttgcaacccagtctccaaactgtaactcttgtgatccttttagaacacaagtcttacggtgccagttccttgctgataacctttttctggctttctattgcctatgtgctgaacccctagcacaatttacacagctctctgtgatctgacctagcagtctcctgtgtgcaccctaaggtccaataatacggcactgcagcatgcgccatgcctacccttgctgttcgtatcttcatgactttgcacacaccagcccccgctgcttggaaacctcctccttctcttgtctgctgggctaccttctacatgtttttcagcgcaggcagcgctgcctccgcctaacccccaaggttaattgcccttctgtgtcctgtagcaccctgtccataatagcatagtagctgagaatacagactcctggatcagactgcctgggttctgacctgtttggtaaccttga

SEQ ID NO: 86361 - DNA, 1074 bp, Homo sapiens
gaggctgaggcaggaggatcacttgagcccaggaggtcaaagctacagtgagccatgttcacgcctctggactccagcctggatgacagagtgagatcctctctttaaaaaaaggcagagggagatgattgaaaaaaaccactgactttcccccagataaacagaggcttggtgagaaggacttgcccagagttaggcggaattactggttgcccggagactggggtacaggttccttaactctgggccagtgctctgcctactgtacaggctgtcatttggactttgagctgctttcggtgggagggtgatatcaaaccccctttctttgactcttggccaactgtccccgcccctgccttcgagcccccatgcttggctcccacactccctggcatatttcaactctcccgggctcccgcaacacctctgctctagccccatctgcgtctctcgcttcgacagggacgtctgggcatgtgagtgtcagtgtggttgccactccaagtgcgtctcacacccaagctgctgccatccaagtcctgtccccaaggagagagaaagtcagagggaaagacagacagacacagaagtagactggagtaggcgagcgacagcacctggaagtgaggcaaggaccaaggagggagggagggaggagagaggcagatagagaagagagagagaaatgtggagaaagtgggagagactgatgggagtggagagaaagactcataaatgggagatagattgagaggaagacccagatggggaaaaataaagacagacatggatgacgatatgttctgtgggctgtggggaaacaggcattcttgtacattgctagtgggagtgcaaactgcaaagggaacttggcaatacctcacaaaaccacatatgcaatttgacccagcaataccacttctaggaatctgtcttgaagatgtatttccaacaacgggaatatatatatgcgctcaaggttattcactgcagcatttctggaattacaaatctaagtgctcattcatgggagactgaataaactatggtttgtctataaaatggagtacc

SEQ ID NO: 86362 - DNA, 1065 bp, Homo sapiens
gaatgctagcctcaaggaagcttctggaaaaaaagcctagggtgaatgtctcccctacccggacactcagatctctgggcccttgctgcttcccaggagagccacacacagcactgaccgcagcggcagggtattatttctttattaggtgccacttcaaagaacagggaatccaggtgggtgggggccacagggcaccaggtacagccctcacagcccaaccttctgagcccaggcgaagaagacgcccttgacatcatctacgcctgtctgaaggtgggcaggcatgatataggtgcggaggtcccggaccttgtagccactacgcaccagggcctccctcacctcctcctcagacactggcaccaccgtcagcctggcctccccagccaggtaccacgactcctccagggccccgatgaggaggaggtgccccccaggcctcagcagcgtggtgatgtggtccagggcccgctgaaagctggcaagatctgggctcacagcctccaagcagaaggcagagaccagggcgtcagcaggcaggggagctgggctcccagcacccaggggctggggctggtgcacgtcgatgggcaggacccgtttcaccctggctcgcagctggcgctccttatcctgccagcattccctgtgcaggaggcacaaggcagggctcaaggctgttctacgctcaggcctctgttgccccaaccagccactctatgggaagcctcctccccaaccctcaccccccagtccttaccccttgccctcaatgaggcaggcatgttggctgtacatgctccagttgaaggcccccggctcctcctgcagccagcgccccagctcctggcggttgacctccaggaaatctgtcatggtgatgtcctcaaagtggctgcaggcactgagcagctggtacacggtggggcctgaaccaatgtcgatgagggtgcgtccggacacttcacctgggcagggcagaggaagagggtcctggtgccagccagcccaggcagcccctgcctccttacccttccctcccctgcatctccctgcctctct

SEQ ID NO: 86363 - DNA, 1104 bp, Homo sapiens
ggtagaggaggggttgggacctgtgtcttctggatggcaactctgtgctgtttccaccaggccatactgagtcatctaccctgacccatctggtcttcccagagatcagggcttacagtgctgtgcctgctggccaggatgggggtataactcttaactaggcactggagggtggctcattagtctgaagaggtactgaacctgaggctttggccaaactccagagctgaggactcagctgaggacctgttgcttcagcatgtcaagaataggtggactgggccagttgagggttgcctgcccttcaaacctccttcatctgctcctttttcagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtaggtaacctagcaggactcctgctgtctcctcttatctaggaaggtggagctctacatccctattaacacccaacagggcttctacttaccagcttcccctctgtttcccagggctaaagttgcagctgcagggtggtaaagcctggggagaaaacagggagggtgctgaatcgggccttacctttccagcagagccctaggtcaggctgtttgggaaggagagaggaaagaagggcatttttcttgtcctgaagaaggaagccactaaaagacccagtaggacagtttacaaacacagaggggagatggggggctaaagaggatgctgggaccacaggtctttccaagggcccttctggaggacttggagcaatctcaattccagcccaggcctggtggggagtcacagccatagtctctgtgtagagctcagcctagtctttttttttttttttttttttttttttttgagacagagtctcactgtgtcacccaggctggagtgcaaatggcgcaatcttggctcactgcaacctccacctcctgggttcaagcaattctcctgcctcagcctcccaagtagctgggatgataggcgcgtgccaccacacctg

SEQ ID NO: 86364 - DNA, 1070 bp, Homo sapiens
tgtcagttccggctttgaagacgtgggggcagggatcatcttggaacgttttgtttgaaggagggactttggactggtacattcgatttggaccatagtgggcaaagaaccaacgtattgagcactcactgtgtgacaggtgtcacaatatgtcaagtaatttttatcacaccctttgagatagtttctctaatcccagttttacagatggggattagagagattaaatgccctgcccaaggtcacacagccagtatgtagtaaagtggagtttccagttctggcctgtttgaccacaagcttgtcctctttactattataccactttgcattccagacagagggaacagagagaatggatgccctgggcagatgtgggcacatccaggagctttatttactcagggagcagggtacatgaacaggagtagtgaccaatacggttggaaaggcaatttggagcctcaaaagtcaggttgaagaatttgggcttcattttcataggaagggagtaagatagcaagaactccttccaggagagtaagagcaaatcctatattcaggaaggacaaatataaacccaggtttccatagatgagttcatcagatgccaacatcttgatggacttgagcaaaaggagaggaaatgtctgccaaggtagaaagatcatctgagccctggagttcaagactagcctaggcaacatgacaagatgccttctctacaaaaaataaaagaattagccagacattgtggtctcgctacttgggaggctgaggtgggaggatcgtttgagcccaggaggtcaaggctgtggtgagccatgctctccccactgcactccagcctggatgaaagagcgagaccctgtctcaaaaaaaaaaaaaaaaaaaaaatgccgggtgcggtggctcgtgcctgcaatccccgcactttaggtggcagaggcaggcagataacctgaggttgggagttcaagaccaccctgaccaacatggagaaaccccatctctactaaaaatacaaaattagttgggtgtggtggtgcatgcctgtaatcccagctact

SEQ ID NO: 86365 - DNA, 1377 bp, Homo sapiens
ccgcggacgcctgggctcccaggacctgctgaactggtgtatgcagattgccaaggtatgcacctgggctctttgcaggtctctccggagcaaacccctatgtccacaaggggctaggatggggactcttgctgggcatgtggccaggcccaggccctcccagaaggtctacatgggtgcttcccattccaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggttaggtgaaggaccaaggagcagaggaggctgggtggagtggtgtctagcccatgggagaactctgagtggccacctccccacaacacacagttggaggacttcctcttctgccctcccaggtgcccatcaagtggatggcgctggagtccattctccgccggcggttcacccaccagagtgatgtgtggagttatggtgtgtgatggggggtgttgggaggggtgggtgaggagccatggctggagggaggatgagagctgggatggggagaattacggggccacctcagcatgtgaagggagggaaggggctgcctgtgccccaccttgcagggtctgtgcacttcccaggattagggaaagaccgggtagggtctgtctcctggcatcacatctccccctgctacctgccatgatgctagactcctgagcagaacctctggctcagtacactaaagctccctctggccctcccactcctgaccctgtctctgccttaggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgtgcgtggctgagctgtgctggctgcctggaggagggtgggaggtcctgggtggaggagcccacaaggggcatgaaaggggaccaggatgtatgtagacccaggagccctagtatgttaggagcctcaaaaccttcttgtatcccttttacagtcaaagtccaaagccactcttgaggaacactcttgtacaaaattaagctgggcacagtggctcatgcctgtaatcccagtacttttggaggctgaggtgggaggatcccttgaagccaggagttcaagaccagcctgggcaacatagtgagatcctatctctacaaaaaataaaaaaattatctgggtgtggtggtgtgtgccagtagtcccagctactcaggagag

SEQ ID NO: 86366 - DNA, 1062 bp, Homo sapiens
aaaattaaaagggaaactagaagagatgccaaaggttctggctgaagaccccagagtctggtgctacttctctaccacctgagggctttgggctgtcccttgggactgtctagaccagactggagggggagtgggaggggagaggcagcaagcacacagggcctgggactagcatgctgacctccctcctgccccaggttggatgattgactctgaatgtcggccaagattccgggagttggtgtctgaattctcccgcatggccagggacccccagcgctttgtggtcatccaggtactgggcctctgtgccccatccctgcctgtggctaagagcaccctcctgcagagggtgggaaggagagatgagtccagtatgccaggcccctcacggaaggctgcatgctgggctggggaggggccaccatcctgcctctccttcctccacagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccagggtcagtgccctcggtcacactgtgtggctgtctgcttacctcccccaaccccggtggactagggtccctttctctgatgttccctcaactgtcacctctcaaggaaaccccattatccctacaaaaaattcttactgccttccaacccctgtgaccccattctctccacggtgactgtgtcataccccaaaggtgacctctgtttttctcctgtgaccctgtcaccttccatggagtccccatcccagatccgtgagtgacccccatcatgactttctttcttgtccccagagtggcggtggggacctgacactagggctggagccctctgaagaggaggcccccaggtctccactggcaccctccgaaggggctggctccgatgtatttgatggtgacctgggaatgggggcagccaagggg

SEQ ID NO: 86367 - DNA, 1128 bp, Homo sapiens
gtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatgagttctgtctggcaaggcctggctggctgaatcaagaagggaaccagagctggacgtggtggctcatgcctgtaatcccagcactttgggaggccaaggtaggagaattgcttgagtccaggagtttgagaccagcctgggcaacatggcaagaccctgtccctacaaaaaataaaa

SEQ ID NO: 86368 - DNA, 1049 bp, Homo sapiens
ccctctaaagatttttaatttcactcagagtaaaagccaaagcctttacaatggcctgcaaggcctgagaagatctggtttcccatttcctctctggcttcaggtcccattactcactgtgttccagacacacagaactacgtacacttcttcaaatttgtgccccagggcctttgctcttgctgttccctagttatctgcagggcttactcaccctgttaagaagtctgttaaaatgttacctcgttgaagccttccctgattctcaccctcactcctcagcaactgcttcatttttctcaatagcacttaccacccgctaaccttccaacttacagtttgctcatttactttctttataatctgtctgcccccagtaaaatataaactccacgagtctttttacttactattgtatctcaccacctaggacagcagatgctcactaaacgtgtgttgcgtgaactcaccagtgtcccctgggtcagtgctctgaagaaatgtacggcagcgctccttgtgctcctcaagggaacttctctgcttgtaactccttccacaaaactcacatttgtagggtttctccactagaaggagaacataaggggcactcagtgaccctcaggggttccacacaggtcaggtattggggctctgtgacaactgttcactagaaatgagactgctgagtgaagccagagtatttggatacttttgaatctatattttaaatttggtaagcttaaataaggttatggtctatgattaattattacgtcagagtattcttcaaaaggatcgcctcctatcacaaatggaagaatttggatttagtgattaccatttcgcatactgttttggctccaggtcaaattttgttttctttgggaaaaagaaaatagggcccttttattcttcaaggaggttaatgtggtataagcaatgaaataggaaaggattctttattttggacatccatctggctgtaagtaaagattgctgtagtttgtgggagttagccattcggctagaaactgatggccttttca

SEQ ID NO: 86369 - DNA, 2133 bp, Homo sapiens
ctggtgtagggatgaacagaggaagttggaatattcctgggtcttacactggactcaggctttgggcctccctggccccatctttcctccattggagcttccttcctgctagtgagataggcctacaggcttggggtgaagctgggaggtgggggcggtactgggccaggaggggcccctttagcctgagagctcttgcttcttacgctggtctgggaacctcttctgtaactccttagctgttgggattctgcctttcccctcccaggaagtgagggaggaaggggtcctcccaacagtcttttatatctctccccacccttcccctcccaggtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacgggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtttccctgtgtctggccttcgcttcctggaaggctgaggggagggggcaggggtgtgggcagcggctcccgctgaggtgctggtggggcatcagtgcagctctgacggtggcaggaggggcgctgggactgctgggctttctgctggcttcagcaggga

SEQ ID NO: 86370 - DNA, 1007 bp, Homo sapiens
tctctccctggggctttgtcggcagagggtcctcatgggagtgccatagggggtgaggctgggggatgggccttgacttctctgccctggggctgcgtgcctcttgatgacctgtcctccgatgccctgccagggccctgtcccaatgggatgatgcatggggcagcctgttgtttatcccagcccagcagcaggaaatgagtagagctaagtccacatggactttctccactttccatgcttcagaatcaaaagagtggaactgcctggagttctcagggaaacaagggcctgcctcccagcgggatccgagggtgagagggggcagggaaagcagtgtgacctgtctgacctgtgctgcttgtttgcagaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatggtgagagcctgtctgctgcctgcccctgcccctgcccctgccctgtgggctgccctttggcagggctgagggataggaggagcctgtcgggcctggcccaggtgtcagggtgatgtactgacgacatctgcctccagagcccaggcctagcccttacctctctgccttgctcccccttctgggttcctgccctgtgtaccatgacaggaatcaaatctgcagatttttccacatctctagggtggggtggctgttggcctggaagatgtgctcctgagagctgaacaaagggctccagagagttcccaggacccgagagtcctggtgcctaggctgatacagaaatgcccctttctcaagttagcttctcgaaccgtcttccacttttgcccttctctgctccctcaccacttgctaccttgcactctttgtcgggtaag

SEQ ID NO: 86371 - DNA, 1033 bp, Homo sapiens
tactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttaaaaatgtttccatttgcaattactcaaatactaatggaatataatttttgtctgttagctatttttcctctttgtatgttagttcgtctccatttttgttttgaaattgtggcaatataatcattataccattatatctcttaaccatttatacaagctctttatagaataaaaatatgaatctttgatcacatttgttgaaaatatttttcttttgtatacacagttatctaaaagggtttttttaaatgaagtcaagcccattaatcttttgtgcgtatgtgatttctcccattgttcacatttagaaagtcttttccattaagatctgataaatctggactccaggtttctgtagttaattggtttttcttttcttcctctgtcatcctctaccccatcctgcacccccactgtatgtttttcttgccacttggttatgtcttaaaatcagtgtgtggaatctgtaaatattatggaccccattagggcagaaaaggtgagtggtcgcattttgcccctctgtgagaggctccttagaactccttgcctggccggcacggtggctcacgcctataatcccagcactttgggaggccaaggcgggcagatcacgaggtcaggagatcgagaccatcctggctaacacggtgaaaccccgtctctactaaaaatacaaaaaatttagccag

SEQ ID NO: 86372 - DNA, 1025 bp, Homo sapiens
actcctggtatcaagcagtcctcctgcctcagcctcctgagtagctgggaatacaggtgcatgccaccatgcctggctagttcttttttattttttgagagatggggtctcactgtgttgcccagactggtctcaaattcctggcctcaagcattctcctgcctcagccttccaggtagctggcactaccggcgtgagccaccacacccagctcctccttgatttctttgggaaagactgtaatctttatttttttatccctagcacctaacaaaatcttggcacatggtagacactcaataaatatgttgaaatacatagtggatgctcaataaattcttggttacttgatcagactgagcttttccatggtaacttctgtcctctcctagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggtatccaggatgcagtgagagcgattcataagccccaagtgatgcaaggggtttggcggggagatggtccctggtgaagaaatggaaataatcattgattcttaagaactgtcccccacactctttccccatagaggtatgcgtttgatcccacatcccaggagaacccactcttgctctgggcactgtgggacagggcttgcagtggtcatgctgtaccggtctgtgggggataccagcgtagtacattcttggggaaaagtaggggcatttggagacagaaagacctgggttccaatcccagccataccctaggcaaattaatttctcccagctatatgtaagatggggataatagtgcctaccttacaagatggttagcgttacataaaataatttgtttagaaatacttagcgcaatgatctgcatatagtaagctttcgtgatattttcataaatggtagctgttattatggactaatagctccatttgc

SEQ ID NO: 86373 - DNA, 1052 bp, Homo sapiens
ttttccccttacccagcccctggccgctactaatctgccctgtctctattgaggatttacttactctggacatttcatgtaaatggaattacacaccgtgtgcccttggtttctggcttttttcacttagcatcatgttttcaaggttgacccatgttgtagtgtgtgtcagtacttccttcctttttaaggctgagtaatattccctcgtgtggatgtgccacattttgtttatctgttcatcagctgacgggcacctgggttgtttctactctttggttatgaataatgcttctgtgaacattcgtgtacatgcttttatgtgagcctaagtttccagttctcttggcttgcatacctaggataggaattgctggctcaaatgacaactccatgtttatccttttgaggaactgccacttgattctcttttggcttcctccccaggcacagaagatctctgatgatctgatgcagaagatcagtactcagaaccgccgggccctagaccttgtagccgcaaagtgttactattatcacgcccgggtctatgagttcctggacaagctggatgtggtgcgcaggtacaggcagccaagcatctcacttggggtccgtggggtcagagacttggtcagtcacaagcacacagctgtggatctgcagagggcgaagaacctgtagatgtaagcagggaagaggggcagtggttcccatgccctgcgccacgtgaggggtgtgggagagagactggtgctagatgaagaagtgggtcactgctgggctgtaaagaactgtccccaggttcttcccttcaccccacatcaaggtaggactgagggtgggttaggggtggagggacaggctagaaaacattttacttctttgctcaaaacctgcagtggcttcccgtctcaaggaaagacaaagtccttacaatacctcataaggcctgacgtgatctgctccattttgacctcccagacttcacctcctcctgctcctcagccccactggcctgcctttcctctggtgtgcccggcacactcttc

SEQ ID NO: 86374 - DNA, 1475 bp, Homo sapiens
attcactgaagccaggccccttcctgcacttatgcctctacccagataatgagttctacccactgatgacctcctctcctctagtaacagtccgcctccctaatgagcatctctggctgacacacgttccgttctccaggcctgtgagccctggtccctcgctgttgctgagccacagcacccgcccttctggcctcactttagagcactgtcatttcagagcagactacgcgcggggtggccaggtgaaatgcagctgacggctctgcgaccaaatgtgaccaaagggccacattcccagcacccggctccaaaggcagagcttggattctatgcccagcacaggttttcagggcttcctcctctctctgggcctaaacagtgatccctttccctgtttcccactacatctggcagaatttaggccacatttcattttcttcttccgcccatggggctccctgcccactgtgttcccctgtcactctgtccaggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcatgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaac

SEQ ID NO: 86375 - DNA, 1014 bp, Homo sapiens
ggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgctttgtgcatcagttactatacttcactgcagtattggcaggctcagattttgggttttttggccttagagta

SEQ ID NO: 86376 - DNA, 1089 bp, Homo sapiens
ggcagcgtcctgcagttcatgcccttcaccaccgtgagtaccaccttcccggctctcctgctggtgctggggcctcggggcagcccttagagcagggaggggcctccttccccctgggacagcacacccaccaccagccgtcccgcaagcagcatctgtctgtccgtggcaggtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtgactgtgtgtgctgttggtattggtgccacccggggcagggcatagtgtcctctccctggactcctgtgctgtggccagggaacggctcactcctgtggtgaggaggaggaggaagaggagcagaggcggcagggctcagggtcctatgtgggcttgctcagctggggaagggccaggggaaagcagcttcccttccttggagccaagttggctggcctgctgccccctcccccaaagccagctgtaccctgaaaggggagaggctttggctcagggccccacagtgctggggcagggtggcctgctctgctgtctcccgaacctggtccaacaccacccacactctgactagcctgggatttgatctgt

SEQ ID NO: 86377 - DNA, 1049 bp, Homo sapiens
tctccttccccccctcatccctttacgacttggttaggtatgccaggagagggtgctgggggtctttggtctcaaggaagggatgatgttccagttgagactcaagaaaaggattctgagcctcagagctttgaaggagccacttggtccctgaccttcctagaggcaaatcccgatccctgtcaacccagacacgggctcccccctgccctcgtctgggagctcagccttcccgtccttccacagccaaaccggcctccgtccgggccctgctgtttgacatctccttcctcatgctgtgccatgtggcccagacctatggttcagaggtgagagaggggagcgaccgggacgggggctcaagggaaggaggtaacccggaactctccccacctcactgcctgcgcccccgcagcctctcagccagttagttctgtgggcctcagaaaccaggtgcccacccgggctggagtccgtagaggcaccttcagccctatgttcacattgaccactaggtggcagcattgcccccgtctggctcccttagaccagttcgtccccagtctttgggctgggctggagcagcagcctggcgggaaacagtgcagccccaggtccagcgctggcaggcgccgcgccctccccactcggctggtgccccccttcccctttcccaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgtcagtggcccgggcgcccactccaagggtggcggtgggggcagggtcaagacccgctccctgagcccgttccttgctcccctgtgctgacttctctgcacacccgcaggcagatgaagtggcatgaggcctgtctcagcatctcagccgccatcttggaaatcctcaatgcctgggagaatggggtcctggc

SEQ ID NO: 86378 - DNA, 1429 bp, Homo sapiens
cccatgtctatgcgccaccttgtggctatctctaggactacactcagaggctgtgagtctggtggtaactgctgaagccgctagctcaactggggcctaggtgggctgagttcccctgcacccaaccctctgggaggcgtgagggagacctgacctttcagcctcataggaagtagaccggagtaatccccacggggcgtggagcatagggttgtctgtgactgtgaccctggccaaggtcactgtgtcagtgtgttgggagctgcatccggctccaggaggaaggggcctgcaacatgccacacgcagggtgggtgcgggaggttatacaatccttgcatgcatgtagagggcttatgtaacctgtgtgcaccgaggttatgcaacatgtatgtggagagcctggcaacatatatgtgcagtggctgagggttgctaataatacgctgcacagaggggctcagtcccggctctgactctagctcatggtgtcaccaggcacaagcagggtctcagtttgctgctctgttaaatggaggctgtgcagagggtgtagtgttttctattgctgtgggttatttagcatgtgtgtatgacctggagctcaagcaacacgtgcacactggagggatgagggtggttttatgaggtgcctgtgcagagtgttgtgtaacacatgggcatatcctagaggttgtatagcacatttaagaatgccctgaaaatttcacaggtatgttggccctggtgcatactcaccatccatgggtttatagtgaaggttgcatggttattcatctgtgccggtgttatgttgcatatgtatgtgtgtgttctaaaggctacatagctttaagcatatcctgagaattcttccagcgtattcgtcatgtactgaaagatgaggatgtcctgcagattatgggtgcttcaggtcttctggcgggtgaatgtgtgtgtgttggggctctagaatatgcttgtgccacagccaagccccttatctctctcccctgcaacttccagataactggacccttttaagcattgtcagctgaccctggggggtgggaggtagaatgaggacacaaaatggaaagaatcaggccttgggggattgcataagcctctcggatgagaaaggggctactcgaagactgctctgtgattctgcccactttgcctccatccagtgccaggtcaccagatggaaagcgaaaaagaaagaacggccaatgttccctgaaaaccagcatgtcaggtgaggctggctgtgcgtgccccttctccacgtccccaaccccaccaaacccagccagggctcctctggacctggatgtggaacagtaattcatgtgttccctggggggagcctcctagagggcttgggatggacttgtctgggggtgagaaaggtaatgtgggatgt

SEQ ID NO: 86379 - DNA, 1904 bp, Homo sapiens
gttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagagaaaaatacaaaaaagagagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactgtggctccaactcctaccctccttatatcctgcagtattagctagaaaccggatgctgctgcattggttgggtcgggggtaggagggctgtgcgtgagcgtctcccagaaccctccacccctttagcactctgtttccctgtttcccatctgtcttctgggctctctctaacctctgccctcctccccagctcctactcactgcactaactctgggcgggcaggtaccagaatgggggtgtttagataagtgacacttagttggggccccaggggaggggtggtcggtgctcctttttctttaaagctcttttggccagctgcccctctgccccgggaccccttcccctcttcttttctctaattcagggactttggcttgagcccctctcgccctcctggtgagggtgctctgttggtctgcacttgggtgagctgtcctcctccccctccctgtggctgccgcccactcctcaggggagagagggagagaggaggtggtcctcccatgggagcaggaggtggggtgggacagagcagaccagagggtgctgggctcagggctgcatgtcggcagggatggatgggtggacacagatgcccccggaagccatggggattggggcagggggtggggggaggggtgccagggcttcctgcgctttgcactattggggcaaaa

SEQ ID NO: 86380 - DNA, 1155 bp, Homo sapiens
gccccaatagtgcaaagcgcaggaagccctggcacccctccccccaccccctgccccaatccccatggcttccgggggcatctgtgtccacccatccatccctgccgacatgcagccctgagcccagcaccctctggtctgctctgtcccaccccacctcctgctcccatgggaggaccacctcctctctccctctctcccctgaggagtgggcggcagccacagggagggggaggaggacagctcacccaagtgcagaccaacagagcaccctcaccaggagggcgagaggggctcaagccaaagtccctgaattagagaaaagaagaggggaaggggtcccggggcagaggggcagctggccaaaagagctttaaagaaaaaggagcaccgaccacccctcccctggggccccaactaagtgtcacttatctaaacacccccattctggtacctgcccgcccagagttagtgcagtgagtaggagctggggaggagggcagaggttagagagagcccagaagacagatgggaaacagggaaacagagtgctaaaggggtggagggttctgggagacgctcacgcacagccctcctacccccgacccaaccaatgcagcagcatccggtttctagctaatactgcaggatataaggagggtaggagttggagccacagttttttcctgggtgggtgccaaggtgtggaaggaggaggtggatggggagaggcccctagggctgggcacttaaaggggagctgtgtgggcagcagggcaggctggtgaggggccagctggcatccagcatgagaggtagatggaactcagcgggcacgagtggcagaaagcagaggacatactagggttggggggtgccaaaggggcacagagggcggggtatggcaaggggggtggccaggaccctgttgtgttaactcacagctctgatcggcagccctacccttggggctctggtgtgggggcatttctctctgatgtgggggaagaaggggcagctcgcaaagtgcatggggtggtaaagggggggtcctcccctctggtcagcctcagttaataacttaatatcatctctctctatcgctcgctctctcttttttgtatttttctctctgtctagtttttcttcatttgt

SEQ ID NO: 86381 - DNA, 1231 bp, Homo sapiens
aaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaactgcgtctgcctcctcccccgggtcaggcgagagcctgacctacctgcagagacaagcaccaccgcggtgaagaggcccagctcctcctcggtaagcgccagggagttgagcttctcgctgaagtcgaacatggcactgagcaggtctcccatgcccatggcaccaagctcctgcaggctgtaggtggtgcggcttaggaacatcactgtctggtccttcacgttgaacaacgaagcaaagcgcaccatcagcacctaggagggaaggggaacagtcatcctgggtgtggtgggaggagcactgaccaaatcgcccctgtagtttgccagagggtttagcggtgctgccttcgatttctcagtagagtgggggttgtttctgaatggccaatgagggagcccaggtggaaggatggctttgggatccaa

SEQ ID NO: 86382 - DNA, 1041 bp, Homo sapiens
tccccggcttctctctctcccggtcaccagtaacctcaggacgaggtcagtcctgcaatcacgtgaagccctcacgtttgcaaggtttgcagaaagggcctcttagctttgatctcccagacagcaaacaagcttgccagtccctccccagaaattcacatgcccctgccatacaggctttctaaacacgccaccctgactcttcagcgcaccccaccccaccccactctcagctcctcccaggtcccggcaagcgctttgccaggcagaaaggggaaaggcacgcagtccgcccactttgtcggtggactacaaatcccgacagtcttgtcgttgcgcaggcgcgcaagagctcaacgtgccggctgttggaaaagtgtgtcactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaa

SEQ ID NO: 86383 - DNA, 1109 bp, Homo sapiens
ccttggtcttcattcccttttttttttctttatggcttccacacagagatgctcccctatcttctacatcaaccagtaactggaatgtgccttcaatcatgtaatattagtctatgtcagtcactgcggttactctggggtaatggttggggaggccttctaggatagagccgcagtcccaagtttctaccactgtgtcttgcctagcaggatggggatagaaatccattccagtgagacaagagcgttctccaggctttgtttggctgttctggtgacaaaattaagtgggaaagctagattagtcgtcttaatgatctaacctctattaggcctcacacttgagtacatgagatagatcaggatcctgatctaggttcagatttttgttggttcagtcagttgaacaggttcttccttaatggttaacctcttttgctgccatggcaatgctgcgtaacaacttaagagaaacgtgaagcaacttcccatccgggattgggtaatggcttggtccagagctgttctgtgtgactggctatttttgaaaatcctttcttccctagtacagacaatttcaaacacctctgagattgtgggcatagtgaaacaaaggagtctaattggggagatcccagccccttgaggagcctgagttgtgaataaacatgtgaatccttattcttgatgcccctatctcaagaggaaggctcaatggcttgttctaggggagccaaagtctttgtgcatgttgttcaggctggaccagcaaggtagtttgtttggagggaggagggagctgtttaagaagactacatatgtaagttttgagaacactgatcttttatttgaaaaatagggtcaacttttactcacctgccatgttctgagtttaaggtttgatatccttggccatcaactgttgcagggaaaccaccctaaataatgaagaaaagaagtcgtctcagtgtaaaaaaaaaaagtggtgggcttattttcttttcttttgtctgttgttccctcttcccctcccccagagagaaattctcaaaagaacaactcaaaaaacaaaatggcttcctagtgagaacttcagtgatgatcctttc

SEQ ID NO: 86384 - DNA, 1034 bp, Homo sapiens
acattttttttctccccttccaggtaacctgcacatccttttcagacttcatggaagcctagatatgaggtggaaccaggtggcttagggatagccatgggtctttgacagaaatgaggctacctgggcaactagcttttgtaataagattcccaagccaataattaggagtattgctttttgagttagaaatagatgattccatcactttaatggtacacagttgctctggctttgaggcaggaaagacactccaaactagtcagggataggagtggtaagggacatagtgacttttttgtagttgctatcatgtccacactgaatcccttctagtcttgcaagttgatttcctcatccttttttgccaggaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagtt

SEQ ID NO: 86385 - DNA, 1069 bp, Homo sapiens
agaagtgatgtgatacaaggacatttatacaggttttggcatgccatcccaaatactaagtgcttttgtttacagctgtaacttgttctgaaactaaccatccccactttcttttccaaagattttggtttttgagcagtaaagaaattgttatccattaactgaaaaaataatcacagccaaacatcccttcccacatgactgtatcacagaatagtttcaaatgaacaactatcttttcagacagttatctaccaactctccgatgtcttttctactctgtgaagatggcttgcttcatcgcttcacttgtcattcctcttctggtcctaaagctcatggtgaggttgtttgttttattttagggttaaaaatcactatacccactataaggagggtgtaccagggtgagaagagtgccatgcaggcacagctctaaaggaaggggctgcttcatcttccacatgtctaatgaagagagcccttttacccctttaacataggcaaatgtatagaaacagacccctgaaacttctgaatctgccatcctatagctttagcttgagagcccatttcccaaaaaagggaaaagaaatcccaatcaccctccataactcacaattagccgaatgaaagagtttttgtgaaatcagagtaatgaaaacaaagtcaaggaagtatgaaagggtattatcagcgagtgataacatatgtgaggacaaaggtcacatatacaggtctctgccactctcgggaatggcatgctacaactatctgaagacagggttcttgccagcacagctatttcctacacgtccggtgaggtgtttgcttcttctggatctccaatctgcatcggctacgctcatccaaccagggtagctcaaaattcctggcaaaaaaggatgaggaaatcaacttgcaagactagaagggattcagtgtggacatgatagcaactacaaaaaagtcactatgtcccttaccactcctatccctgactagtttggagtgtctttcctgcctcaaagccagagcaactgtgtaccattaaagtgatggaatcatc

SEQ ID NO: 86386 - DNA, 1638 bp, Homo sapiens
ttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaatttttgaacttctgcttcaatttattatatttattggcaaacaaacaattctgcttgtatatttgaaacattggaaaaagaaatccattttctcaataaaaaagaataacacattattttcccctttataataaggtactcacttccatttgtgtataagtataatgtatgtttcatccctctttgtccagtgtacttccttaagtataatcagcaacttggctgggcgcagtggctcacacctgtgatcccagcactttggtggctgaggtgggcagatcacttgtggtcagaggttcaagaccagcctggccaacacagtaaaacatggtaaaaccccatctactaaaaatacaaaaattatccagatgtggtggcatgcacctgttatcccagttacttgggaggctgaggcaggaaaatct

SEQ ID NO: 86387 - DNA, 1019 bp, Homo sapiens
gcctttttgtaacatagtggttaagagcataggctttagcagtatagtcttcagcaagttaccctctgagcctgtttctccttttgtaagtggggactataattttatccacgttgtaggttgatgtcagaattaaatgagactcttagtctgacctgtaataagcagccaaaaaatgtttctgggtttctttttttccacatatttctgttttatttcagctgttctctcggattatgaaagtgcagaagactcggaagtgagtatgacaggttttttcctatggtatagatcagaaatgctttttaaaaacgtgtacacaccttcgttgcaaacgtaccatgacctccgtgtttatcctcttgtgtattcttcatttatgcttctgaaaaagtgttacagaaggtcttgttcactttagacctagggaaaacttggggcacgccgtctcaagccacaggtgttatactgttagttggcttctcttcctgtctgaagaatatgaggttctaaataagagagtgaggatatcttgaagtcctctgaaagatgtttgacagtttgttttatgcagtgtaggttgagaagccagccaattggttatttttttccaaatctatctgaagactttgaaagggtaggattcggaatgttttgtgccaagagcatccatcattttataggtggggatttttctgtttttaggagaaagtttcctgtcttttggataaactactagagatgccatcagagtaagtgtttgtttcctgggttgttgagtggactcctgagttctggtaatgggattatatatagggggaattggatggtggatcaaagattttgtctatacatttttagaactgttactacattttagaatctgttaagcccttgaggatggaatagtgaacactataacaaaattcctatctttagagatcttacaactcaataaggaagtcagacaaacattcaagcaattgtaccacttgctgataggggatagcactgggata

SEQ ID NO: 86388 - DNA, 1356 bp, Homo sapiens
gagtctcactctgtcgcccagactggagtgcagtggcgcaatctcagctaactgcaatctccgtctcctgggttcaagcgattctcctgccttagcctcctgagtagctgggacctcgtgtgtcaccgtgcccagctaatttttgtatttttagtagagatgaggtttcaccatgttttccaggctggtctcgaactcctgactcagatgatccacccaccttggcctcccaaagtgatgggattacaggcatgagccaccgtgtgtggcccccttgctagttgtaagtgctgttctcagttttgactgttgtgctttcccttgactgcctgttgattatttcagtgttctcctgttctcaggtccatttgctttctctctgctttctcctgcgtggacaccagtactatacaggtcctacagctgttggtgctttgttatgcacttacattttgggtcttgggggatacctggtaacttaactttgttgcagtgttgtctgaaggttttggtttcttttttattttttgagacagagtcttgctgtcgcccaggctggagtgcagtggctttgccttccagattcaagctattcttgtgcctcagcctcctgcgtagctgggattacaggtgcgtgccaccatgcctggctaatttttgcatttttagtagagacgcggttttaccatgttggccaggctggtctcgaactcctggtctcaggtgatccacccacctcggcttcccaaagtgttgggattatggacgtgagccactgtgtctggccagggttttggtttgggtctcggttttgctgtccagagctctcattccatgtggagatttgaagagagataaaactgtgccactgccattttctgagagtcttccaagaattcttttttttttttttttggcaaatgggtctccttattttgcccaagctgagcttgaacttgaacttacaatcctcatcagcctcttgaatagctgagacaataggttcatgccactgtgcctggccaaaaaaacttgttaaagaaatttgactgagggaaggctgaagagatggtagttggagaggtagctttgagatcaagaggtgatttggatgttttttaaaaagttaggagagtatcaaataaggtcaaagattgaaaaaaagaaaagaaagggggaaaaaagagagggaatagataatgatattgagtactggtatttttgactgagtatatgagaaaaagtaggaaccagacaagattaacatcttccattgtaattacagagaagtgggaaggaaaggtatgtgcaaaggaagattagaaaggagggaaaagctgggtgcggtggctcacg

SEQ ID NO: 86389 - DNA, 1080 bp, Homo sapiens
taagaatattgatttgtttgcttttcagttctatgttgtactaaaaatttattgataaatgtattcctaaagagtagaaaattgaaatgcagccaggcacggtggctcacgcctataaacccagcactttgggcggccaaggcaggcagatcacgaaatcaggagttcaagaccagcctggccaacatggtgaaacctggtctctactaaacatacaaaaattagccaggcgcggtagtgggcgcctataatcccagctatttaggaggctgaggcaggagaattgcttgacccctggaggcagaggttacagtgagctgagattgtgccactgtattccagcctgggtgacagagactttgttttggggttgggggcaggggtgggaattaaaatgcaccgttcagatcttatatgcatcgctgacagggaaacttttttcagggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggttagtacattccacagtcctccattttagaggctggaatagagattcttgaggcttggaagagtaaggatccctttatctgtcctctaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcaggtaaaagccacttgctgctgctgctgtctaacatgtattttacacatgtaggccaggtacttcgatttgcctgtatttcatttattacagcattttaagataagtattatgattatccttatcgtacaaatgaggaaagtaggcttagaatatttggtaactcttggtgaggcagctaagatacagacctaggacagtttgtttccagaactcatcttctcttaattattatact

SEQ ID NO: 86390 - DNA, 1335 bp, Homo sapiens
tcctgcttcagcctcctgagtagccaggattacaggcgcgtactatcgcgatcggctaatttttgtatttttagtagaaatgaggtttcgctatgttggccaggctggtcttgaactcctggcctcaagtgatctgcccgtctcgatctcccaaagtgctgggattacaggcctgagccaccgcgcgtagcctccttttgttaatttcctaacagtttcttcattccattttttgtagatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtaggtatcataggattggtggctagctttttcccctttgcatcatcaggtttaggggcatgggacttctgtctcaggaaggtggtgtctgacaaatgtctacttctttttttttgagacagagtctcactcttttgcccaggctggagtgcagtggcgcgattttggctcactgcaaccttcgcctcccaggttcaagtgattctcctgcctcagcctcctgagtagctggggttacaggcgcacaccaccacgcccagctaatttttttttttgtatttttatttatttatttgttttgagatggagtcttgctctgttgcctaagctagatgcagtggcacgatctcggctcactgtaatgtccacctccgggttcaagtgattctcctgcctcagcctcccgagtag

SEQ ID NO: 86391 - DNA, 1502 bp, Homo sapiens
agaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgcc

SEQ ID NO: 86392 - DNA, 1043 bp, Homo sapiens
cctcatcgccttgcactgccatcttcccacccactcccctcaccccctggcgccctggccgcccctccgctgccgtgggtgcagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctgtgagtgcggccgtcggcgggatggggggccggaggccggaggcccgcgccgccgcccgcccctgaccccgcctcccacccccgcagctgcaagcagaaccaggacctgctgtctttctacgccgtggtcatggggctggacaacgccgctgtcagccgccttcgactcacctgggaggtgatgagacccctcccgttcctacctgggaatctgggcatcccgggctccccgaagtgcgtcctcccgggacggccgccggcctggagggagtctttgcgccagttggagggaggcgccctcttctggcatacgcaaccccagggcgcacagcttggctaatggaccctgtctttgtgcaaattagtgaaaagcccggatcccgcctgagtcacggcaggcagcccttggccaggtcaggtcgcagacttggctgtgggagttgggctgattttcatccacactcagtgggggcatctttatacaaagcacctgcataagacagacctggccttccccagaataatgaattcctctgggctgtttcaagcctctagacttagccaaggcctgacttcatttccccacccaccagcttcccagccccctacaagccatgcaggcccttttgccctccaacagggagaattaatccgaggctcccatgtaacccaaggagctccactctgatatcccttctccttccttcaaactctgcagaagctgccagggaaattcaagaacttgtttcgcaaatttgagaacctgacggtgagtgggtt

SEQ ID NO: 86393 - DNA, 1095 bp, Homo sapiens
gcctaacgctaggctctctgcaccctataatcttagtaggattgggccaggcgcagtggctcaagcctgtaatcccagcactttgggaggccgaggtgggcagatcacgaggtcaggagatccagaccatcctggctaacacagtgaaacctcatctctactaaaaatattaaaaaaaaaattagcccggcatggtggtgggcacctgtagtcccagctacttgggaggctgaggcaggagaatggcatgaacctgggaggcagagcttgcagtgagcagacatcacgccactgcactccagcctgggcaacagagcaagactccgtctcaaaaaaaacaaaacaaaacaaaacttagtagaactggtaaatattggttgtgtgaacagtacatgctgtcttcaggggacagacctgggttaggggaccagtgccctcactagtaattattctgggactgctgtgcctcaatcttctaccttagcattagaattaaatgtgatctcatatttatgccacctggaacatgtatgaacgaaaacatcccatcccctcttctgagttccaggcattatgtgacatgtcttgtgaggttggcatcttttcctctcatccacattttcttttttggcagagtcttgctctgttgcccaggctggagagccactgcgccttgcaacctccgcctcctgagttcaagctactctcctgactcagcctcccaagtagctgggattacaggcatgcaccaccacacctggctaatttttgtatttttagtagagacagggtttcaccatgttggccaggctggtctcgaactcccgccctcaggtgatctgcccgcctcggcctcccaaagtgctgggattacaagcatgagccactgtaccccgccacccacattttcaaagtcactccagaacagccctgctcctgacagcactgggcggccatcccctctcccctccctcagcacttccacagcctcaaagaaaacagaatggagaacaacaggcaggttgattcatagactttatcggcttcttctccacccagcggtttctgcaatgacaaccgcgcctgtacaataca

SEQ ID NO: 86394 - DNA, 1012 bp, Homo sapiens
attttttgtattttttttttttttttttttgtagtagagacggggtttcaacttgttagcgaggatgtcttgatctcctgaccttgtgatccacccgcctcggcctcccaaagtgctgaaattacgggcgtgagccaccgcgcccggcccagcctgcttctttaacataatgattttccatttttcctatcctgtcacagttttccgttgctctgcttgagccagtcctatgtagaaagtggcaaattacacattttttctccccttttagtctctggtggacatcttgtctgtgtcacagtttgatactaccaaattgaaaggattcttcactgcttcagatggggagggtgacagaagctgagctgtttcctgggtcagataatggcctctgtcaaagcaaagaatagttgtagagacacaaactgggcccttgaagctgtgactaacattttggcaacatgcatccctttgccaaataacttcttttcttcttgagtgtgattgttgatctccttctcaaagtaggctcttgttgctactattcttcacacaactcccaagcaaaagttggcagagttccggttgactgactgtgtcttgagggatatgccccggattagagtggatggggcgttccatgtcaaaatgaggttcattggcagatcctgagagctgctttgcaaagaaatagaggcagtactctttactgaatgttcttgcggtcctttatctttcttctaaattcaagtctgtttcttattcatctagtgattaaatgcagaatcattgcctttgcctagcttcgtgggcattgtggaagagaagacagtatttccaactttttttttttttttcttttctcacaagccattgagcctgaggaactacaggctaaatttatgagcatttcttgatatctacagagggctactaaaaaaaaaatgctgaatagacctttatggggaacaacaatgttaataggaaaaaaaggtgatatgtttgctaatgt

SEQ ID NO: 86395 - DNA, 1024 bp, Homo sapiens
cattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctcc

SEQ ID NO: 86396 - DNA, 1050 bp, Homo sapiens
acagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctc

SEQ ID NO: 86397 - DNA, 2194 bp, Homo sapiens
agagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgcttaaaaacaaaaagtgaaaattgtgtactcttgtctgga

SEQ ID NO: 86398 - DNA, 1032 bp, Homo sapiens
ttctcagattgaggctaaagaaaagaagggtggggacaaagcatacagaatgtgtgtatctgtttttatgtgggtgttggctgtttttcgtcactgctttttaagctgaatcttagctggttttcttgaactttgactttaggtgtaaaaattcaaccagacattctctccttactgtggtcagctgacatcataaccactaaggcttaatgagcttaacttgcactttcatcactagcaaaggtcttgaagttatttctcttactgattcataatgggtgtgtgtatgaatcactctcacataatttagatataaaaacctatgaggatgagggagggaggggaagaaaaaaaaggactcctttcattttcatccgtacttcccagatgggctgaatctccgattatttgacccatcattgttattaatatggttaataaactacctatttattgattgaattgttcctcctgacttgaaatagcctgcaaatggagcttgcctaaatgaccttcgacttcctaaccctataattcattctgtcttcttgtgatggtattgctagtgtgtgtgtgtgtgtgtgtgtgtgtgtctacacacacagtcacacaaaaggatgccagacaggttcttccagtgtgatttgattccttctccatgatactgtgtatgagttagcaggtgataaggacactagttttccttccattactgaggcagagctgcttgccatgaatgtacctcttaagtatttcccaacccaatctaaccatgaactaaacgacccactggaagaaagctgcctgtctccaacttcctagtactctgcaaagagaggtaaaggaactatggaaaatgaattagaactagaaatatgtcagcctcaggattctgactgccccagaggacaactggggaaatgctttgcctctgacatcactggagcccagtctggatcattttcacacataattgaattcattctccattcctaggcttaggggtgtgagacttaaaagactgtatgctct

SEQ ID NO: 86399 - DNA, 1026 bp, Homo sapiens
tcagcctcccaaagtgctgggattacaggcgtgggccaccgcgcccggcccatttcaggtaacttgttattgcatcgctcaattggttaagaacttgggctctggcaccagatgcccggggttacattcctgtttttctgtgactttgggccactgtttatctcagttttctcatgtgtaaaataaaggctaataatagtacctactcctaagatcgttgttaaacgagttggtacctaaagtgtttataacagcgcccttccacgtagtaggtagacaacaaatgtcagctgttcttgcatagatttggatgtgaagcaaaagtgaatgctaaaataagtgtgataacataattaggaaataagtgttaatcatcagtataaataaattccatgttagttattttctcttcactttcacatattgactagttgtcctcttattttttttaatctagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggtaaaccatccattatatcactttttcactagcagctcgtgacctttcttttcttggtaagatgtgtgtcctttgaaggagctttctaagttcagttaagacttctttttttttttttttttttttttgagacagagtctcgctccatctcccaggctggagtgcaatagtgcgatcttggctcactgcaacctccgcctcctgggttcaagcgattctcctgcctcagcctcccaagtagctgggattacaggcgcccaccaccaagcctggctaattttttttttttttttttttggatttttagttgagacagggttttgccatattggccaatctggtctctgaactcctgacctcaggtgatccaactgcctc

SEQ ID NO: 86400 - DNA, 1900 bp, Homo sapiens
ccaatgtggcgaaaccccatctctactaaaaatataaaaattagctgggtgtggtggtgcatccttgtaatcccagctacttgggaggctgaggcaggagaatcacttcaacccgggaggcagaggttgcaatgagttgagattgtggcattgcatttcagcctgggcaacagagtgagactccgtctcaaagaaaaaaaaaagaaagaaagaaaagaaagagtagaagtttagaagattgagggtttcttcaaaataaaacatttgtaatttcattgtttaaatctttccaaatgaaagtagagcttccttacgtgctgttagctcttcaaagacattttaggctctatcagatctttattttctgaggccaaaataactcccatatttgcatttttttttccagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgatgtaagtattgttctgcttcatgttgctctgtgaaaatctgcaaggtctgttgcccataaaaagtacattttgtatattttctctctgaaggatagttacataaacttaaagggaaagaagagaaggaagatacacctaattttaaattggattacttatagatgatgtggggtatccttgtagcagtaactagagataggttagattatgatctttaaactggtctcagctttaggaaagtgacctgaagtcagcctatatcaaacattagagggttaagaaggtgaatatggatactaactgtttctctttttatagtgtgttggtattggacgagatggatcaactggacagcaaaggccaggatgtattgtacacgctatttgaatggccatggctaagcaattctcacttggtgctgattggttagtgctcaattgttaatgttacatggtggttctaaagtattttttaagaatatatattcagcttatttatcagctattttatcttaaaccagctttctgccgtgtcaaaataagaaagttaaatgactatgtacatcttacctaatagatacatcttatctattgggatggggtaggagacaagtggcaagcaacaattagaatgctagattctataactggagatttatttagctttcagaagatttagttttccctttaggataatttgaccaatgatcaatgttgttgatctcctccttaggtattgctaataccctggatctcacagatagaattctacctaggcttcaagctagagaaaaatgtaagccacagctgttgaacttcccaccttataccagaaatcagatagtcactattttgcaagatcgacttaatcaggtcagtgccaactattttgccaaattatgtgttccttggatcacctgtgctaggaaaatttaacaatagttctaaaatatttttgccttgattgctttattaatggagcaaggagttcctatggaccatagtgagaacatttttatgtgaatttcagcttcattcatttactgggtgtctcagtgttgaaataaaagcaggagttagaggaatcacccaagcgcttttttttttttttttagatgagttttgctcttatcgcccaggctggagtgcaatggcgtgatctcggctctctacagcctctgcctcacgggttcaagcgattctcctgcctcagcctccccagtagctaggactacaggcacctgccaccacgcccagctaattgttgtatttttagtagagctggggtttcaccgtcttggccaggctggtctcgaact

SEQ ID NO: 86401 - DNA, 3405 bp, Homo sapiens
tcaggtttcttaaatgattaaaggctataagcaatgtgacttttaagcagcgtttgttctcccttgtttcctaccagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtacaactgcttttttgtgacagtgtttttaattgtcctattttgtagagtgatgctaaagtaaaggtttattgttaaacaagatgaccacagttagttaaacaagtcgttttttgttaggtaaggtttaaggtgtgtaaagatgggagtgtgatatgaatattttttcaagccattggaaaaaaaagtgtttaacttgcttgccttttgtgagaaaaagtttaatatggtagaagtttgtatactgacaactttgcttttgtgagttccccagtgtgaaaaatccttttctcttctttccaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtagttttgagggaaagggggaagttctagtttgatttgtttgggagattgctgtcctttcataactgaagcaaatgcttgaaatgtaaaccatgtgtgatacgaatgatctgagagccagtgaccaagtctgcttttccctgagctctcctgctgccgcctctacctttctgacatggccttccatttggaacttgatatgtgtacaagtgatctgttggccactgtttcattcatcctgaccactgtatccgtgtaatgtgatctgagctacaacaggtggtatgggatagaggcaaggaaagcagagagagccctctgaaatgaacactacccactggtgtgtgtagcacatgatagtctgtaggcatgagtctgaatgttgttctcacactcctttactagagtattcgttccctctgaaggtagtttgaacatggaaacacagttctatacctagaaggttggaaagtgtctgggactataagggttaacatgcataattgcaaagattgtccgaaggctgatggaaagcagagactgaatgggattgagaacagatgcgaagcttgatttaaattacattttattggatgctgcagccttaagagacgtgactgctttacagtttgtttccacactgtgggcagctgctgtctgttctgtgtccacagtaggatcctgcccaataaggagcagcctccccacctcattgtgtttgaggcttggcgccttcctcttaactgtagggcttgagtcaggaacatggcttgactcgcagtggggctgctatgtatcctccctggcttccagccaaaatcacattggtagattcaaaggggccaaatttctttcccctctatctttccctttcccctggttttggaaatagagttttctgtctactgatttgttagtttccttttcttctcccctcactgtcaatttctaggtcattgctgctcttaagactttagcagttggaacagggttggttctgtcaatgatgcatgaagcagacttagtgtccctgcttggcttctgctgcccttgtgggagcaaaagctgatatatgtttgtcagtaaagtcttaagtgtaattcagactgctgaggaagaaagccctttccttgctggcttttctccctgaagctgagagcttcaggaaggtggtaggagttttagtgggatgggatgggatgggcttgtggttagcagtttttgccaggatcataggctgcttcacttagagtagtggcaaagatgctgacctacattcttccttttgaaggtgatggagtgtgtgtctatatcctggtttatctctctcccccaccccaaggaagctgattaagcttccatagagtgttgggtgttgccatggaaagagcatagacaaaataaattgtgtgtttcaaccccagagctgccacagatgtttctggctcaatggagacttgcctgtggctagctaactctgcaagaatgtgtgaggtccaggctgggggtggtggctcacgcctgtaatccagcactttgggaggccgaggcgggcggatca

SEQ ID NO: 86402 - DNA, 1043 bp, Homo sapiens
ttttggatcttccagtaggggcgcccaggagcacccctccgtgctcaaagactcacactcaagcttctctctcccgaacaagtctggagaagccaggaaagctctttttcatgttccagctggacaggatctgaatcaccctccatctgagagacccccagtccccaatacagtcatgacccccctcccagcctgcagctctgtttgggaggatcctgtccccatcgctagcagtccactggcgggcttagggggaagcagaattgcttagaatactcccctctcgccctgttcccaggcagagaagtggccacaagtgcccccacagaacttcccactggaaggggaagtgctgcactcccaggcctccagcccagtgaggagactctcagcctgacccggtggcagagctctcaaacccactggtccgacggaccccgctttacaaacaaggaaagagagtccaagagcaggcactgggttttgtgcacagtcgcaccggttgcagagccgggtctagaattgaagtatctgattgtccctggctttagcccaagagccatggtaaggtaggacaagccaggatggcgggaccctttgccctgagggccggcgcacgggaaactgccccagcagtgctgggccgcgcttccccaggccccttcccgcctgctgggccggagctgtctcccgctcccgtctggatttccgtccgccggtgcgaacctcccgcccagcccctcccgccctgtcctgtccagattcatccgcaaacatgcgctcagccggcaggaatgcgccaatggctcccagatgtggacgccaccgcttaaccccttaccccccagccgcgctcccccaagggccttccagcctgagccccgccaacagcagggagctctgcccaggtgagaaccagcccaggactggagtcagcgccagcccgcccctagtgcccacggacacctcccaacctagatcctacctgtcttccttccttgaggctggaggggaaggctcatggacacaagaatgcaagcatg

SEQ ID NO: 86403 - DNA, 1042 bp, Homo sapiens
ggcctgagggacagggcctccccctacctctgctccgtaccctccgccccttcagtctggggctccgggtaaagtttcagcctccgcacgtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgaggtaattcctcccctggggattttggggagcccctggttcccgcaggcgtcggggccccatgtcctgccccagattggtgctgcgggaggggactgggtaccgggaggcttccgacgggaacccggggtttcctgggcttcccaactcgctgccgccgtgtccagggtgggggagccccgtctgtgagtctgcctgcgccgtgtcttcgcgcgcagccttgaggcgtctggggccgtctgctgcgcgtgtcccccgcgctcgagctgttgcagaaccgccgctgggaacttctgttctttttctctttaatgataagcaaaacaaaaagacttgaattcaaacctgtttggggagagatcggatgctcaacggactagccccctctctttttccctcctgttatctgagctgccctgtggtttggggagaatcagccagggggcccactcccaccagagggagccggccgggggccgggccggttcagctggtgtcccccgtggagtgaggggaaccgtcagaattgggtgcgggagccaatgcagtatgtgtgtaggggtgttcctgggtcttgtgccaccatggggtgtgggaactttttggggtgaggggaagacggaatagactgacttgtcgactttgctctgctgagggtgtctgggacctggtgccacccacgaggcttggaagctgctggccagatgtgtgtgtgagcctgttgtggggttggggggacggctgggaaatgagcttggctatgtcccctcatctcctctctgggcact

SEQ ID NO: 86404 - DNA, 1020 bp, Homo sapiens
ctcccccgctgggcacagtcacccacacatgccatgacgtggttcctgccaccccatctaagtatgggggagaggacattgtctgagtggcccctcaggtctgttttggggacattcacccagaccccagctaatgcgcgccccttcccctaaaccatttagtcttggaagctgactctgccctctgggaccttttcttccaggccactccttgctcagactccagtctcaggtgggatggtcctcagaaccgtgtgatgtgacggtggggcctgtcccaaaatacaaaccccaatgcccagtttccagtcctcttggaagcatgggcaggacaggacttaggctaggctggaggggtggtttcttttgacctctgtggggtctattaatatttgggagcactgcctgggatctggggtgataggcatctggggatggtaatcctgtccctgcgacaaataagcggggtaatctccgcttgctcagtacccacacccatcttgtgtcggtagttttgggagtgtgggaagctggcagggcccctggcaagatgaccagtgttgtcttgacttactgggttttgggaaaggagtatggcaactgataccccggctcccagggctttggctgaacattctctctgacgcctgctgtctttcctccctctactcccctctccaccctctggctgctgtctggagcccacacagtttgtggggggatgcacggtggggggcagggcctggatctccgtgtgtgtccagggagtattctgggaattggcaggattggctgagggtgtcttggtgtccccgcagggtgggcggcatgtggggacctagtgtgagaatgtgtcagcgttggtgtgtctgtccccagtctggctcgggtgtgggtgtctcgggtgtgggtgtctcttgcttcgtctggatcttgcctcccgctccagtcccgccctcccctcgctcccccctagctgggaccgcctgcttgctttccctctctccccacaactggagc

SEQ ID NO: 86405 - DNA, 1097 bp, Homo sapiens
aagaaaaaaaatgtcttcctgtcacgtggctgtcacttcctgtcccactgtggttcctgggatgtttgttgttggttgccatggtgatgtctgccgtgggcactacccctggttcttgtggggaaggagctacccctccccaccaggctgggggggtacttgggggacttgactagggggtcctttcaggctgagtgtgtgtggtctctgatgccccagattccccaggaccccccagacttctgtctgtggggaggagtcactgccacctactcagactgagtgctggggagactgtgaccgcatctggctgtgcctgaccgtggctgtgactttgtgagtctgactgattttgcagcccttgtcccctctggccggggttcctctcgctcatagagatgcccattcagggaacctctgtgctccctatctgtcctcatatacagttctggagcctgctcccatcctgtgttctgatggaaaccaccttccccagggagtttctgtggcttcctggactccaggctggagtgtcaaggggctgtggggcagggtcctaggttgcatgtgtttggggctggggaggtgggggctctgcagactatgccttcccctgcacacacagcctgcacccgcttctcccttgtctggcaggcgctcttctctaaggggaaggccatggggatctgtgacctattatccctatccacctgtgggcttccctgttcagctggggatggtgaggggaagagattccccctagttctagccccaactgagtaggcgggtgtggagtaggaagttgcttgggggggggtcaatgggtcggagggggggtatggggcagggcacagtctgactcaggcctggtctggggtcagagccaaaaggatatcctgaggcaggacttggtgggggggtgtattcctggattccctgcagcgtgggtccccagggtgggatgctgagagggggctggtaccatctagtcctgctggcagtttgccctgggactcagaatatggcatacgcagggttgggctgagctgaggggaggggtgagggctgctgcagcctatctccccaccctggccctg

SEQ ID NO: 86406 - DNA, 1030 bp, Homo sapiens
ggtgaggcaagggaaagcaggccgactgctgaggggcaccaaggtggtggcaagaggcatggggatggagggctccagttgcccgggcctcccctgtgccaagctctggtctgggtgctttccaggacttcctgtctgaaatcgcacagctcgttgttgaggtaggcagttcacaggcgagtaaacagatgcttagagaggttaagtgacttgcgtaaggtcacccagagtggcagagctgagatttgacccttccgacttctggttctttctcccatcttcgtggctcagaaagctctcacctttttctctaggtgtgtgactctggggtgtaacgcgtgggcagctagggatgctgatgctggagaagggatcctggcaccttctgagggtgagagcggccccagtgggcaggagtgtggggctggttgcaggtgctctagccccctacccctttttctgctgtgcttaggctaggctccatatattggaggtgtgggcctgtggttttctctctctcaggggagggtgcccgtgggcagtggaggtggctggcatagggtggaggttggatgtgggtagtttgttttccctctctttggtactggtttcgattctctgccgaggccttctccacccctggggtgtagggggctggggcccaggtgtctctctgagggtcatagcttctgatggaccttctgaggcagagtctgtgcccttttgggcccaccctggtcatccctacccttgcccatccctgttctctggtctttctggcccttggcctatttctgtgacctttagccctcctgcggctcaaggccctccccagggagctgagtaaatttgcactgaaatttgcaggcagagctgggttaggctttttggaggctctgataggggtctggggaggccttccagccttgccctgtagtgtgtgtgggtggtgggctgggggtgaggtgggggtagtggggattgaagtttgattcaatttcaaactccactggggcagagttgaggtggc

SEQ ID NO: 86407 - DNA, 1030 bp, Homo sapiens
ccctccttcccccagtgagggttacctgaggtcaagatgcagagaacgtgtgctgggggggaagagggagggggaggaaaagccgcttccctaaagcattggcacttctcagaaaaatgactcctaagccagggggcccctcttacaccacttcccccccagatccaagccccagcaccccagacgggtttgtcccacaggccctgggaggaggcccatttacgtacacactaataggaaaatgggaaccaaggactcctaggtatcacctccaatgcttaacagcatggatggtccaggggtaggcgatgtgtaggagggcaaggaccgcccaggaagcctcctacccccaggcaatgaaggagagattgatctcaaggttcacccacatacttctgtctgcagaagcaaaacacatgaactggggtgggaggtgggcagaagatgaaaggccagatgcccccttcaccagtgtgaatacagatccacaccctgtttgaacagctggcaccagaggatatgcacagataataccatggggtagagacagagacagagatgaacccagagattccataacacagtgagacagataggcagcaacaagagcaaagagagagaacacgaagaacatatccatacgaggacaagaggatgtttcaaatccattttgggtacaggttatatataaatacatatgcatgtatttatatatgaaaaatacatatatgaaagacaaaagaaaagagacagacaaaaagaaacatggccaatcaaaagcacaatgaggctgggggcggtggctcacgcctgtaatcccaccactttgggaggctaaggcaggtagatcacctaagtcaggagttcaagaccagcctggccaacatggcaaaatcctgtctctactaaaaatacgaaagtcagttgggtgcggtggctcacacctataatcccagcactttgggaggctgaggcaggtggatcacctgaggtcaggagtttgagaccagcctgaccaacatgccgaaac

SEQ ID NO: 86408 - DNA, 1067 bp, Homo sapiens
tagctaattttttttgtatttttagtagagatggggttttgccatgttggccaggccagtcttggactcctggcctcaagtcatctgcccgcctcagcctcccaaagtgttgggattacaggcatgagccactgtgcctggctttctttcttttttttttttctcatagggtctcactctgtctcccaggctggagtgcagtggcatgatcatagctcagtgcaggcttgaactcttgggctcaaggcgttctactgcctcagcctctcgagtagctgggactacaggtgcgtgccaccacaccaggctgattttttgatttttcatagagacaaggtctcaccatgttgcccaggctggtctcaaactcctgagctcaagcagtcctcctatcttggcctcccaaagtgctggagatatgggcatgtaccactgcacccagctcagggtaggatttttgacgggggaggagttagggacctgcgacctggtgcctgtggacaacttgtcctaacccaggtgatggcaacagagttcccagacactctgtccatctggagcctgggctcattggagggttggaggtgggggctggggcctggccccatccttgcccatcctggccagagggagcaaatgctttgccttcccctcccctcaatgttgcaagcttcttcctctttcttagaggtgggtggggaaggcttcccatcctggtaaccttctccccaaatgtgggtggggtgcccacatttcaggcaagtgtagccttcttcggctttctccacccaggttaggcaatgcccccttcctgccccctccctctgtgagccttttggtttccctgcccctcccctctccctagtaaacaacaacaacttctctccctgcccagacccttagcttctgagcttctcactgaccttcctcttctctgggacaaggtgtggccatgggtctgagggagcctggcatctccctccttctgcagagccagggctgcctggtggacagagctcctgagctctgagtaggaaagcatggcagataaaattatcacatgcctg

SEQ ID NO: 86409 - DNA, 1031 bp, Homo sapiens
ggtcagcgcctgtgagggctgcaaggtgagttgaaggggtcattgggaaggacagcttgatgaggtcaatgggatgtccccacttctgtgtcctgggagtgtgcagttggggggtgtccctgaagttgctgctcttctttctctgtggaagttggcagcaagcagggacacctaccacagtttccccacaggtcctcccccataaatgtgcagggctccctcaaaccagaggtcccctcctgcctcagctcctttccctgtctctatcctccagctggcagggcgtacgcctgctctgccaccgctgcccaggttgccatggtgagctggctgccgactggctcttggctggggacccaggaggcctcccccggcggccctgcctgaacctcaccatggcagcctggcaggaggcagttaggagcaggcaccctgccttagcttccccttcaggtgcccgggctgtgggctccccagtgtctggctggatttccccatcctcacgttaggtgccagggtgcaggtatacctggtccttagcagccctgcgcccggcttctcctcctttccctggggcctgagcctctgtgtgcgtttcttcctccagagattggggctcagaatcttcacagctttgggccttgcagctctgggctgctcttcagcctggagtagctatccccagatgtgggacggaggtcaagggcaaagcacaaggactcaggctgtgtgtctgcctgtcctgtctggttgttcctggtctgttcttcctctgtccgcctgtccctctggtcagcctgtatgtggagcccctggccagcctgggtctgtgtctgtgatgggtcggtgcacacctgtcttggtgaactcacatctttctgccttgctcctgagtgcatgtgtgtgttcgcctccatttctctggccagcccgtgtatctgcctcctggcctcttcgggcttgtcttcttttcctgtgttctgagttcaggggtgtgggttccagatccctggctgttgcccagttagccc

SEQ ID NO: 86410 - DNA, 1066 bp, Homo sapiens
acccagccatccatccatttagccagtaataaagattcacgtaggagccaggtgcagtggctcatacctgtaatcccagcactttgggaggccgagcgaggcaggaggatcacttgaggctggaagttcaagaccaccctgggcaacatagtgagaccttatttctgcaaaaaactaaaaagattcacctaggatcctctggccagtgttcgagctgggtgtcaggaacccagcggtgaatgcaccaccatcccctctcttgaaaaccttccatgtgaggcaagagataagtcaacagaggttgcaaaactgtgatcaatgcttcctggagattgggggagggcttgtgactgcttgggcctgaaggatgatgtctcagaggaggtgacatctaggggtttgtagagggggaggtgagagggtagccctaactcaggagcaggaagtgaaagacttgctgctgtgaggccatgctgagctcaggggactgccgggcactcggtgaggtgagcccgagggtagactgggctggaggctggatgcagggggtgggggcaggaagaggtggtgggaactgccaaagcctaggctggagggagcactctccttcctgctgtccctgacaagggctcggtccacctgttccctcttggtcacctccagggtggggaacctgggatttgacgagactgtcatttctttttatgtttttcttttttgagatggagtttcactcttgtcacccaggctggagtgcagtagtatgatcttggctcactgcagcctgcaactgctgcctcccgggttcaagcgattctcctgcctcagcctcctgagtagctgggattacaggcacccgccaccacacccggctaatttttgtatttttgtagagacggggtttcaccatgttggccaggccggtctcgaactcctgacctcaggtgatcctcccgcgtgagccggcagactgtcatttctccatgggcacctctgaatgttgaggcgggtgatgggtgggaggtttagattgtgctgcctgcaggggctcccatccccatgccgt

SEQ ID NO: 86411 - DNA, 1061 bp, Homo sapiens
caaccagctgctgcccctggagatggatgatgcggagacggggctgctcagcgccatctgcctcatctgcggaggtgggcagggggcctgggtctgggggctgggctgggacgggggtgcagccctggagtctcttccagggagctctttcaggccacctctgttaggtatctctagagggcagggtctggtctgcaactacacagcaagggggccatgtggggcctggactcctgttcccgatttctgggcaacaccccttctagggaggttaagagtgagggtttgagggtcggaccaaccagggtcacctcctggccgatgcatgaccctgagcaggttgctgaacttctctgggcctccgtttctgtacagtgggggcggtaacggtctctagctcatgaagttgatgggaggattacggtggtaacagatactgtgcaggtgcccagagcgagctccagtgcttgttagttgctattttattgttgtgatttctgccatttcatctggtttccagaataacaggggggagtgggagcctgcctgggaaccctctccctgcttgaggatggcactgcccatttggggtcccatcccactaactgggctcagggagggtttggggcaccccctcaccctcagctcccgttgctcccttttaagggcctctgtaccctgcggcagcagagaccccatgccctgccctgtgtggggaggcgcctgcgagctgccctcctccatggcctgggcaggcacgccccccggtggccgaggctgggggtgcagctgtgttcccagctgctcagggggtggttctgcttcctcagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggtgaggctcacagacctggaggggtaccggcccccgacacctggcccaggcccccacatccaagccagcacc

SEQ ID NO: 86412 - DNA, 1047 bp, Homo sapiens
tcaaagaactgaatcccaagaaagatgctaatatcagcagtattgatcttcccacctcgagccaggcttgctggggctgggggtgggagggctggcccagcgtgctgacctctgccccctcctttcctgcaggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccag

SEQ ID NO: 86413 - DNA, 2525 bp, Homo sapiens
atacagtcatcacattgctgaagaaagttcgcaatgagaacaattcatctaagagtggctgtgactaggtcaggcgcggttgctcatgcctgtaatcccagcactttgggaggccgaggcgagtggatcacctgaggtcaggagtttgagaccagcttgaccaacatggtggaatcccatctctactaaaaatacaaaaaattagccgggtgtggtggcacacgcctgtaatcccagctactcaggaggctgaggcaggagaatcgcttgaacccaggaggcagaggttgcagtgagccgagataacaccactgcactccagcctggacgatagagtgagaccccatctcaaaaaaagagcagctgtgacaaatgcctgtattgaattgcaggtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaaggtgagtgttgatcctagtcagtccttttgctgtagatgttctgaaacacgtaactaagccattgctcttaaaaatttggcatatctttaagaaaattaactctcatattctgttagcttttactgtacatatttagttttaacaaagttaaatatgccacttatttgggcaatggaagagttggccttagatctgcttcttattacttggtagaaaatagaaaactccttgaatatagtgtcttgatacatttttttacattacaattatgttgtcagatttacaatgtgcaagttacctgggcttttctcttttagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaatgcctcttttaaaacacacactacacccttttccttattctaaaatatagtcttcacttccctttcagaagcattccaatcatattgtgacagaccttacagcctctggctaaggtgataagtccaagagataggcattaagacctaattaaggccaaagactctttattgagattttatacatgaggactaagttcttcatctccaccacacttgatcagtaaatatgcatgtatcttttttttttaatgataccttcctttaacaactattttgataacctagtcaactacttgatggtatcagtaagatatattgaggcaactggctaatccatttagaaaaaaaatcagataaatctctttcacaccttacaccaaaattaagttcaaatagatgaaatatttaaatgtcaaaaactatttaaaaagtaactataaaaaaagtaatcttgagttacagagggataaactgaacaaaaccc

SEQ ID NO: 86414 - DNA, 1468 bp, Homo sapiens
ctcctgcctctgcctccgcctccctagtggctggaaccacaggcgcactccaccatgcccattaatttctgtattttttgtagagatggggttttgccatgttgaccaggctggtctttagctcctgagctcaagcgatccgcctacctcaccctcccaaagtgctgagattacaggtgtgagccaccgcacccagccaagacagggtcttatatcttaccccagctgatctcaaacccctgggctcaagtaatcctcccgccccagcctccctaagtgctgggattacaggcatgagccactgtgcccggccacatttatttatgagattaagtgaccaagctatatgcaccacaaaaacagagaccatatctgtctcttttcacgattgtattctcagaactatcacaggagttaataaatttgaaggatggatggatgatagatggagaaaagtgggtctaatatataaaggtgattaatttctatctcccctctaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaagtaaggaaaactaaagaacattatagataaactgtaagagtggaatggccaatatacttcagggtactttgccccagaaattactgtgtcttaatagagcagtaaattatgttaaagctttgaaacactgaagcatctttcaggagatttaaaaactaaaatattcatgaaatgttatgtcaacctatgaattgtttctcctactaccctctttgatttttttgtatatggtttttttactagcaaaaacaaaattcacaatggatttggattcagatgaagatttctcagattttgatgaaaaaactgatgatgaagattttgtcccatcagatgctagtccacctaagaccaaaacttccccaaagcaagtatcttatctaatatgggttttgtcatgattgtttctaatatattgttttttgcttgacacatttagaattggttgtcaggatttttttttttaattctagacttagtaacaaagaactgaaaccacagaaaagtgtcgtgtcaggtatgtatttaagtaaaagtagtgagacatctgccttactgggacactcagatccaactgggttctaatcctggctacattatccaagtacttcctttggaaataaatttgagttcttattaacattatgttgatactgttcactgggtttagtttcacatgtaaataggtactgcattcagtatactaaaagtaatcatagtgcttgccaggtactttgctaggtgctagagatacaaaaaataaaaactgttcttgctgataaaaaattcagaaattagaacaaagttttaagagt

SEQ ID NO: 86415 - DNA, 2005 bp, Homo sapiens
ctatgatcatgtaccattgtactcagcctgcgtgtctcttaaaaaaaaaaaaacaaaaaaaaaaccaccaaaagctttatttcttaaatttaacatgcaaatttgtattactgcacttcagtatagatgcctagctcattgtaatcagttggttggataagtgtgcatcacttcctttcatattttgtatgtgagtttacaaatatatatgtatatacatgttttatttttagtttctcccttgttttcctcaaaaaggttaagtggtagaatcaggaataaaacccagtccttctgtctccacaccttccttttcaaggtgtgttttaattacatcttcactattgttgatagtatactaggttatggagcaatttatcactagtttttaagatgtaacaaaatgaaatcagtttaactgttgggtgtttagatattgtaatgtttttgttaacatttaaacttgctttcttatatcccttctgtaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaaggtaatactcttgtggtggctcacacctataatcccagcactttgggggccaaggtgggtggatcacttgaggtcagtggttcaagaccagcctcccaacatggttgaaaccctgtctctactaaaaattaaaaaaattaggcgggcatggtggcaggcgcctgtaatcccagctactcgggagactgaggcagaagaatcgcttgaacccgggaggcagaggttgcagtgagccaaggtcacaccactgcactccagcctggccaacagagcaaaactccatctcaaaaaaaaaaaagaggtaatactcttaaaaatattatgcataaaatattgatgcatatgtccacttaaaattgaaaaaaaaatgtataaaatttttttgttgttgttgttgagatggagtctcgctgtgttacccaggctggagtgcaatggcaggatctcagctcacagcaacctccgcctcccgtattcaagcgattctcgtgcctcagcctcccaagtagttgggggcacatcaccacacccagctaatttttgtatttttagtagagatggggtttcaccatcttggccaggctggtctcgaactcctgacctcaagagatctgcccaccacggcctcccaaagtgctgggattacaggcgtgagccaccgctcccagccaaaaatgtataaaatctctaatcccatagttcagaatttattctatatccaaccctaactttgctatcttttagaatgaaaatactgaaggaagccctcaagaagatggtgtggaactagaaggcctaaaacaaagattagaaaagaaacagaaaagagaaccaggtattacaacatttttagaaaaatggtataaagtgaagattaaattgtgtttgttacctagtacattccacatagatgttcaaaacctttttgttgaattgagaaacgtgaaagaggactgtatctcaattctacttggacctctttttttttttttttttttttttgagacagtttcactcttgttgcccaggctggagtgcaatagcacaatctcggctcactgcaatcttcacctcctgggttcaagcgattctcctgcctcagcttcctgagtagctgggattataggtgcatgccaccacgcctggctgctttttgtatttttagtagagacggggtttcaccatgttagtcaggctggtctcaaactcctgaccttgtgatttgcccgccttggcctcccaaagtgctgggattacaggcgtgagccactgcccctggcctggacctctttaatatcgtccttgggatttgattcattatagaaaatattttgt

SEQ ID NO: 86416 - DNA, 3431 bp, Homo sapiens
ggtgatctgcctccctcagcctcccaaagtgctgggattacaggcgcgagttactgcacctggcgccctcagtgtcttttctctgctcaaatgttttcctatcagaaacggcttaactttccttagcacctcttcagtcactttcccactttttcttctcttgtttatcccaccacctaacaaaatatgtgttaattgcaaacttctactggactgtgagctccttgaggattgagactttatgtccatgtgcgtgacacatagcaagtgctcaataaatattgttaaatgtatattagtcagcaagtaaaaccaagataattttcatgtataatacatgtcctttccataaaagttaagtgtgaaattcagtatttttgtaaaataacattctttgtttcttttctttagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatggtaagtattctgtgtgtgttaagagccttaacttttccttgggtttcagttgaatagattgtatgattaaagatgatgcaaacataaaatttaatttcatactttagatttattgttaaacgctgttgtgatttccgtctagtatcacatttagaaaacatactgtttttttaaatgccaatttagcttccaagttacaagaacttcaagggtactattgaagaactggctccaaatcaatatgtgattagtggtgaagtagctattcttaattctacaaccattgaaatctcagagcttcccgtcagaacatggacccaggtaaataattatggatttcttttttaggtttgtgatcaaaagaaataccttttgtactattgctgttgactattcagaagcctatattttagaaacttcaggattatttctttctttagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtatgtatttgttttgtgagatgtacacgtttcaatttatattaaagattaatatcaattttaaaagtatatcttagtctacctttataaagtttagccaatttgtctattcttggctctaatcttgttttcctttttcaggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattggtatgttttgggaataataactgcttactaaaactctagttacgccaaactttctttaaacatttttggtgagagtaatggtggagaaagaggcaaaatccatttaattcacctggtcacttatacacgcatttctttaaaatatctgattaggtatttatagtttgaaagagatgatgtttccttgactgagcatcttgagaaatcaagatttagttgacaattagacatgaggagaatagagagctagaagaccttgcataaactgattgaccaagagaatagatacactaatcatgtctacaggaacagaaaataaaagagacagagaagagataataaatctgatggtaaaaaaaaaaaaaggcaggaagattacgaatggcttctactctctgggtgtggtggcgcatgcctgtaatctcagcacttgagctggggaggtcaaggctgcagtgagcctaggtagtgccactgcactccagcctggacacaagagtgagagagaccctgtctccaaaaaaaaatgatttgatcatatatgatttgactgcccccttgtggtaatttacatttgtcaatggtttagggagacttgcctgtataccgggatatacaaatttatgcaagcacgaagacagtttaatttccagttttaaacttttgacttgtgtaaaaccttatccccttcctaaaatattactcaaaatcattatctctgtttacttttttaaaaatagaaaataagcctaagaaagaattaattaaagttctgattcagaggggatatgattcggatcctgtgaaggcctggaaagaagcccagcaaaaggtaatcttgggtggcacttttctatattgttaaagactatgtattgtacaatgtttatgtttcacattttctaataaagctagattttaattaatcctttaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagtgagttgatagtaggatggtacatgctgcttagttttgttctattctaatggtaaaagtaaaattgtgtgttgcatgaaaatgctgcttgtatacatatattaactcaattttgtaattatcttatgaaggaacaagagctggacacattaaaaagaaagagtccatcagatttgtggaaagaagacttggctacatttattgaagaattggaggtatgtagtttataatgcccatgttagaatttttattaatgaaataatatattccagcagtatacctttgtcaagatagttcacaattggcaataaaaagaaaataagaggcataaggataaattccaaatagcgtataaaagaacagattattggccaggtgcagtggctcacgctggtaatcccagcattttggaaggctgagttgggtggatcacttgaggtcaggggttcaagaccagcctggccaacatggtaaaaccccatttctactaaaaacacaaaaattagccaggcatgatggtgcataccagttactcaggaggctgaggcaggagaattgcttgaaccgagaggcagaggttgcagtgaaccgagatcacaccactgcactccagcctaggcaacacagcaagactccgtctcaaaaaaaaaaaaaaaaaaaaagggacagattattaaatactacttagaatacaaggccgggtgcggtggc

SEQ ID NO: 86417 - DNA, 1540 bp, Homo sapiens
tcgggagttcaagaccagcctgaccaacatggtgaaaccccatctctactaaaaatacaaaatattagctgggtgtggtggcacgtgcctgtaatcccagctacacgggaggctgaggcaggagaatcacttgaacttgggaagtggaggttgtgggagccgaaatcgtgccatcacattccacaagagtgaaactccatttcaaaaaaaaaaaaatacaaaaattagctgggcgtggtggcgggcgcctttaatcccaggggctcaggaggctgaggcaggagaatcgcttgaacctaggacgcagaggttgcagtgagccaagatgacaccattgcactccaggctgggcaagagaacagtaactcccgtctcaaaaaaaaaaaaaaaggaaaacagtatttttgtttttctgttgttcgttctttgtagaaggatattttggaacctattagcctattagtaccagtgacatcttttcatcctttaatttataggcctttagcaaaaaacagatagatgatcgaaaggaatggttaactaatttcatggaggatagaagacaacgaaagttacttgggcttcctgaggtaaaagttttaaatatatgccacaaaatggattgttagactgaccttttggtattgatactatagcaaattaaacttactgaatagttattttagtaaaaaatttgatatgatagagttgtgcagcagttaaatttgctttatctttaaaacatataaaatatttctgtattattcaatattttttaaagacttaagaattacagaaataattcttagttctgaaaggtttctgtttgatttttgtgttgagcattgtttagaccggtagactcatgtaatactatttggtccttcaggattacttgtatggacaaactaccacatatctgacatataatgacttcatcaacaaggaacttatcttgttctcaaattctgataacgagagatctatcccttctatggtggatggtgagttccaatttgttagtctgttttcattgtaagatggaaatcaaattccaaaattggttaaattgaggatacttacgtttgctcttatttcattttaaaggtttgaaaccaggtcagagaaaggttttgtttacttgcttcaaacggaatgacaagcgagaagtaaaggttgcccaattagctggatcagtggctgaaatgtcttcttatcatcatggtgaggtaaacacacaatccatgtttccagaaagcattatatcagaaatccctgcagagtcattctcaaaacagatttggtgaaagtataagctcatatattcatagtaaagaacaagttggtaaaacctgtgaaagaataaaactgcttgccctttgatttctgaaagtaatattcctgcagggatattcataagtctgcaaaggtctacattaaaaaatgcttagtatgtttattataactttgtgatgtcaaaatttagacctccactgatttgaaaattgttataataaattgtgacacatgtatgcatgga

SEQ ID NO: 86418 - DNA, 3409 bp, Homo sapiens
acctctacctcctgggttcaagcgattctcctgcctcagcctcccgagtagctggaattacaggtgcccaccaccacgccagctaatttttgtatttttagtagagccggggtttcgccatgttggccaggccggtctcaaactcctgacctcaggtgttctgcccaccttggcctcctaaagtgctgggattataggcgtgagccaccgtgcctggtctaatttgttttaaccactatatctccaacaagtagctcagtgctagcacaatataattatatagtaaatatttattgaacgaatgaaccaaaaggagcagctccctcagtggtgataacctgacatgggaagatgtgccaccctctatccagaaattattgttctacatctttttaatttttgaatcatttttatttgtattaaggctcatttgtattctagatttctgatagatcccttcttccctaatatgatccctaatatgaatcttctcgttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcaggtatatatttaataatgtttccaaacttttaagtcttatagttgttattttattcattaatggcataccacggatatttatttttcccttgacagaataactatattcaacagaataacttgttaaaaatcggcccgtttcctattatggaagatttaggtcatttccatgttataaataatattgaggtgattattttggagtataaaacaagaatgtttatattatgatctattacctaacaaataattttgctcattatatagtaaattgtgttttatcacaaggctataaacagcatgttcaagttagtatatttgaggttgaactaaatgtgctaatattaatatgtatatttttattttagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcaggtagaatataagacgatcttcagaatctaaatctaatttataatacaagactttatgcttatatttaattccctcattaggcattttaaaatatattttagacaatttgtgcttattttgagaaattaggtacattgtagcctattttaacagacctttctgatgtagtaaattataagctaatagctcaaaatactggagctcaagaaaatccaagcaacatatactgttaaatttctttgttcttttcaaatttataaacgatgctttttttggtatatgtccatttcagatcatggaaaatgctgagattaacaatatcatcaagattgtgggtcttcagtacaagaaaaactatgaagatgaagattcattgaagacgcttcgttatgggaagataatgattatgacagatcaggtcagatttgttattaaatttttagattgttcaactaaattaagcatgtcttaatttaatttcattgttttttgccatgaaaataaattagttaaataggagctttattcatcatctctaatcaacatctaatcagatatgcttatatcatatgtatgttgcaaatacaggttaagtgagtctggatttgaacagaccttttttgattcccatagaaaatttgacaaattgccagtaggtcagtcataatatttttttatttctaaacaattctttgtttgtttgagatggagtttcgcccttgtcgcccaggctggagtgcaatggtgcaatcttggctcactgcaacctccgcctcatgggttcaagcgattctcctgcctcagcctcccgagtagctgggattgcaggcggatgccaccacacccaactaatttttgtatttttagtggagacagggtttcaccatgttggccaggctggtctcgaacgcctgacctcaggcgatccgcctgcctcggcctcccaaagttctgggattacagatgttagctaccacgcccagcctaacagttcttttgaactttggctttcaaatctttctaggaccaagatggttcccacatcaaaggcttgctgattaattttatccatcacaactggccctctcttctgcgacatcgttttctggaggaatttatcactcccattgtaaaggtacgctaatttctaagtaccatcatggatattttaagaccctactcctcaaacctggatatacatataagccccgtcacatgtagtggtatacaggggaccccacagtgtacaaagccacagtcattgttttttatcacaggtatctaaaaacaagcaagaaatggcattttacagccttcctgaatttgaagagtggaagagttctactccaaatcataaaaaatggaaagtcaaatattacaaaggtttgtaatgaaacccatatagaacttctcattttattatacaccctgtacaagactatatgaaggaacttggtatttttggttttataggtttgggcaccagcacatcaaaggaagctaaagaatactttgcagatatgaaaagacatcgtatccagttcaaatattctggtcctgaagatgatgctgctatcagcctggtaggtttgagttgtattttatatacattctaattttagaaatcactactttagccagttgaaacatttacatttttgtataagactccgtatcaaaaaaaaaagaatgttttatagaatagaatgtttccagtaagcatatcccagagaaggaatcagatattttagaaaattttgatttttggctgggcttggtggctcatgcctataattctaggactttgggaggccaaggcaggtggatcacctgagatcaagagttggagaccaacctgtccaacatggtgaaaccccctctctactaaaaatacgaaaattggccgagcgtagtggctcacgcctgtaatcccagcactttgggaggcagaggcgagcagatcacaaggtcaggagatcaagaccatcctggctaacaaggtgaaaccccatctctgctaaaaatacaaaaaattagccggccgtggtggcacgcagctatagtcccagctacttgggaagctgaggcaggagaatcgcttgaacccgagaggcagaggttgcagtgagccgagatcaggccactgctctccagcctgggcaacagagtgagactccatctcaaaaaaaaaggaaaaaggccaggcgtggtggctcacgcctgtaatgccagtactttggaagg

SEQ ID NO: 86419 - DNA, 3883 bp, Homo sapiens
atgtcaggaactaagcatggtgggaaatgttcctgctgaatttcagaaggtatatatgaaaagtgccaaaaaaattgagggctgggtatggtggctcacatctataaccccaacactttgagcagttctcctgcttcagcctcccaagtagctggaatcacaggcatgcgctaccatgcctggctaattttttttatttttagtagagacggtttcaacatgttggccagaactcctggcctcaagtgatctgccctcctcagcctcccaaagtgctgggattacaggcacaggccaccgcgcccagcctgaatatacatattttagaaataatagtatttaaatatttttaaatgttaagcattcgtttaatgtgttgtaaaatacaattttcaatctttttttcttagggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtagagtattgaggggaaataacatatttgttgctaaaaatatatatatttaaatgactgtctgtggcatgagggttaaagatatggaaataaatctctataattgaatagctctgccagtgattaagaaataaagctgtcaatgagatagtaacaataaaatagtgtttcatatttatttgcccaggtggtcgaaatggctatggagccaaattgtgtaacatattcagtaccaaatttactgtggaaacagccagtagagaatacaagaaaatgttcaaacaggcaagtaaataagtgtcttgtaccttaatgataaatggtagtagtatagccatttataatggcattaatgattggtttaatttaacataatttataagctattgaagtatggaaaattataagcatatatattaggttattaggactcataaatttatgttatttacttccagtttgtgagatgacttgaatttttcatgtttcctattctttacttccatagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtgagtattttcctggatgttaaggataataagggattttgtaatcattgtcaagtgcaaaattgaattttttcccctcccatatgtttttgtttgtttgtttgtttgtttgtttgagacagagtctcacactgttgcccgggctggagtgcagtggcacgatctcggctcaccgcaacctccacctcccaggttcacgcaattctcctgcctcagcctcccaagtagctgggattacaggtgcctgccaccacacctggctaattttttgtatttttagtagagacaggtttcactatgttggccaggctggtctcgaacaccagacctcatgatccacccgtcttggcctcccaaagtgctgggattacaggcatgagccactgcacctggcccaaccatatgtattttcttaccacttctcacatatgttcttgaaaagagaatggtatgccacattttttaatcagctcattttaaacttaccgaaggaatttctttctcaaagaaacacctaaaataaatatttcatgtcctttttttattttcctttttctttcttttcttgataacctcgctgtgtcacccaggctggagtacagtgatgcaatcacggctcactacagcctggacctcccaggctcaagcgatcatcccacctcagcttctggagtagctggaaatgcaggcagcaccaccatgcccagctaatttttttttttctttttaatagaggtggggatctcactatgttgcccagggtggtcttgaactcctgggctcaagtgatccacccacctcggcctgtgtcctttaatgaccattcccttatgcctatcagtgaacatcattgcattggttttggaaagtcctcatagtctatcattgaacctattttttaataactttcttaatactgttacctttaattcctgtacaggtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaaggtaattttattcttaaattattaatcatgatttatctttacatatatgtgttcttattgtttttaatatataaagtggacttgaatattgggctagcttagtataaaggaggttaaattagtttttaatgtttgattattataattttgaggatactgagttttacagtttggtatttttccttattagggtggcagacatgttgattatgtagctgatcagattgtgactaaacttgttgatgttgtgaagaagaagaacaagggtggtgttgcagtaaaagcacatcaggtatgtgcttttggcagttttctttttctaaagtcaaggaagaagagaaaggctataaataaagcatgagtacatttttagtggcttaatatcaacttctattgcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgtgagtacttagaggaaaataaaaatagaaacacctgactttattttccattgcacttcttagctctgcagaaacaatgattcttctcatagtgagcttctccaagtcttcccaatctgaaaaggaagtaaaaaagggctttactttaactgatttaccaaagacttaatgaccgtctatatttcagtatttcccaattacattttaccattaagcttagatcacttttgaattaatctagctgtttaacaaacaccctcacttaaatgcctaagacttgctttcagtcaacacatccaaaattgaatttgttacctccatactcactgatttgcccatacaagcagccccccactctccaacaaaaaaacaacttcctatcttagtaaaaagccccaaccaacctctaggttgtataaacaagaaagctgggagccttcctttatttcccctcctctctaatccggtcaataagaatcatctcttggatgctgcagtagcttctcaccattatctcttttttggtttactacaataggttcttaaccttcatactggttaagtcctttccttggaatgcttttgagtgacttttgtgttaaaacacccatttttatcttcactctcatttgaaatctttcaatgacttccactcagggaaagtccaaattccataatttggccaacaagaaagatctgctgtaatctaattacacctacttctccaactcatctcagtgccagtttttcgtatattgtcctgttgcttttaaattactgaaaagcacagtgctcttcccctcctcagagtttattcacatgctaatccctctgcatgaaatacatccttttcacctggctactttaggtcttgtcctttcctcaggaaagcctttactttctacccttccccccacctaagttggttccaatataatattgaacataccttatta

SEQ ID NO: 86420 - DNA, 2983 bp, Homo sapiens
ctcccattcccctcgctaacaacgtcagaacagaggacagtttttagatttcagggatcttaaatagattggcagttcctggagaataaacatcctttgcttttctcctgcacacttttgcctcaggccaccccttcccgcttccaaagcccatctcttccaagctttccgcacgagaaaacaagtgagcccttctcattggccagattccctgtcaatctctccgctatgacgccgagtggtgccttttgaagcctctctagtcccgcctccctaacctgattggtttattcaaacaaaccccggccaactcagccgttcataggtggatataaaaggcaagctacgattggttcttctggacggagacggtgagagcgagtcagggattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcaggtacggctcgcgggggggactggcggtggagcctccgcgcggcccgggcatctctctggccgcccgtgacgggtgaagctctggggctgcggtcaggccggcgaccggcttgggagcccatattctccattcccggttccggggtgatcgtggagaggcggaagccccttctggtgctagtagtgaagtatgacccggcttccagggtgtcgtgcgttgttgccctgtttctaggggcaggagtccgttggtcccgtagtggatccatgttacagcggcccgggtgcgacgttattgagtcgcgcgtacagatgctttcccctcctgcccgctgcttgaaaacggtcttgaatgtccccgatcttggaaagggcagagcctagcacagtgtttctctggagcagctggccagcttacaaaagcgcccccttcctgagttcacaacgctcaggtggccaagggattgaacggatagccgcccaaactgctgctgccgaactagaattatttacggtgtcgtgtgctcgggacaccgtaaataatttataataataggcactcggtaaataatgtatgcaggaactgaaagaagtgggtgtattttattgatgacatctaccatgttgctcaagaaaagaggtttccagacagacccacttggtgagataatatgtgtctgtttaacctgacacctggggacctggccgcagcgaatttaaattgtcctatttgtacaaaactggcaactccaccactgcctactaacagattgcaatgcatgttgacatctcactatggtaggcattttgttcctagtttagggtaaacttatgattaaaaattcccttctttctctctttttttttaattgctagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccaggtaaaatcaagctcatcaaaggcagttaacctagtagttgaaatggatactcttctttctgtacctttcatgtactgagtgtgacctttctgtatctctcatgtactgagtgtcactggaactggcctaaatatggtaatacttaatatgaacactttatggtaatcatgataacagaacaatgaatatagaataaaaataacagtatttctttgccttatttctagcaaatgtgggtttacgatgaagatgttggcattaactatagggaagtcacttttgttcctggtttgtacaaaatctttgatgagattctaggtgagtaaatcctttaatataaagatctggtcaaatctttcataagaagtatcattccaaataaaaatttaaaaaagataaaagtaaaaacaaaaagtatcatttctaccaaacctgctgtagccagggctcctgtcatttcaatcagttgataaaggtgagctggtttcctggagcccaggaggttgagcttctcgtagaaacagtactatggacaaaaattgctaaattaacaccttgttaatgccactcctgtgctgtttgggaacttttttttctatatcttacttagagttacagaatgtttcttaaaacactaatttcttacaaatgtatattttattttctttcagttaatgctgcggacaacaaacaaagggacccaaaaatgtcttgtattagagtcacaattgatccgtacgtcttttgcttagtttttgttatgtagctcgttgctattgttagctgcatgtattttgattactggtgaagttggcttttcctaaacagaagttgagaaaagtacacaaaagcagaatgctaaaatgaaaaacctatggatacccaccacctagatccaacagttgccaacgtttttccatattttctccatcttttttttaattagttaatttttttagaggaaggggtcttgctattttgcctgggctggtcttagaactcctggcctgaagcaatcctccagtgttggcattatgggtgtgtgccatggcacgcggcctatttgctctggatcatttcaaaataaattacaggacttatgacacctaatccctaaatatttgagcaagcaccttcagtaattgctttaagtattctggcatctggagttttaactttttctcatgatgctattcaaacagtaaaccagtaggtggtggtagagaataatttgatctgacatttctgcttataaatgcggggtgtcccttagtgggtgatcagggtgcttatttcacttttttgttagtctgattgattatgacaaagtatacctggattttcctaaggactcaatatcatagtctttaaaaaatgttgagcta

SEQ ID NO: 86421 - DNA, 1569 bp, Homo sapiens
ggggtgggtcacttggggtctcttttcctgcgtcggaactgacccctcatgtccttctcttggcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgattgtgtttggttgatttattctcagttagacacagggatgcaccaggggtggagagacggggacagattttgggaggtgagtattgtgtggtccccagacctgtctgtatggtaagggactgcagaaggacggccaatccaccttcctcttccctgcaacggaagtttcctagggaactccttggcttcaaagtctgcgctgtctttacttagactcctgg

SEQ ID NO: 86422 - DNA, 1036 bp, Homo sapiens
atgtagaattggctatcccattccacaaaggaggaagctgaggcccggagttacacggcgtgcccaaggctgtgtagctagtaagaagggaggtgggcatcctctgactgactctgagggcgggaccgccctgtgcttgcggggagcacaggggcattgttcttactgctttgggtccaagaccttctgagctcttatgagaccactgctggggccagctcacctggggactcagttcctgcccccactccccacccgttctttcttgccctctctctctccctctccacctccatccctgtcccctttccgtccatgcgcccacctccctggctctccctttcttctggtcccagccgctgagtggggtgggtgagcccagggccgaagagagaggtgggagatgtttgcaggtggaggacatgaacctgttttctctccaagccccttcccttcacattgttctgctgcccccaatgttaagtcaattgaattgtgtcagcaggctgcagggcataggctgcatgttgtagcgttgcttgtgagcgtctggaccccttctgggtatcaatgtgtgtgctttggcgcgtgaacatggggggctattgctgtttgtgtgggtgttgcatttgtggcatgcatgtgtttgtgcatctgtgtgtatgtgtgtagcggatgcactcttgtctatataggtaggatttttttttttttaattttactttaaggtccaggatacatgtgcggaatgtgcaggtttgtaacataggtatacatgtgtcatggtggtttgctgtacctatcaacctatcatctaagttttaagtccctcgtgcattaggtatttgtcctaatgctctcccttcccttgccccctactacccgctgacaggccccagtgtgtgatgttcccctccctgtgtccatgtgttctcattgttcaactcccacttatgagtgagaacatgtggtgtttggttttctgttcctgtgttattttgctgagaatgatggtttccagcttcatccatgtcct

SEQ ID NO: 86423 - DNA, 1035 bp, Homo sapiens
cggaagtatttgatctgcatttatttaataaatttcattcatttacagctaaaaagtagattttcatacccaaattgttccaacattcttaaaagttctttagtcacactggttcatttcaggggtttaataaccacatgtggctagtggcttctatattggacagcacagctgtatactgtcagcataactagagtaaaatttcatcttggaactgacagtgacaaatgtgtgattacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttag

SEQ ID NO: 86424 - DNA, 1052 bp, Homo sapiens
tgatgaagaaaaacaagaatatttaaacgaatacgaagcagaaaaggtagggtaggggctcacagtgggatagataatgtgtaaagtacataaaacattggcttactatttataaaagtaacataagatttggtcagaacactgatgcagtactgaggctctgtctacctgagtcaagtcagtttctcaaggcctcagatttcttgcctgtaaaaaggagataattatcccaacaccctgtttacatcatatcttttgatattcaagtgagataacataggtctgcattataacctgcaaaatgttaattataaaaccaaaaaacatttgaatttcagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatggtaaaagaaaaaaagtggggttttgtttatgctttctctgtgagttaagatatgagaaatctcttaagtataagtttttatttcttatcctaaatggaaaagaaagtataatttaagtatcgtcttagtattttggttatattgagtaagatttgtatgtgaatttcccacaagaaaaagaaatatccttttcagtgcagaaaatagcaaaaattattgattgtttatcaaaatctttgtactcaaaatgcacgaaaggtttttaaatcacaatcaggattttgcctcatctgcttttaaaaagctaaatgcattctaattatatcttgttttcttattggttcactaaattcgctgaattaaaggctcttaagggagaagctaatgagtatgtggaaacatgaagtttcctttccatttaattcagaaatccaataagaatgtataaatatagctcatgctactatttgtatgggtgtacatgagggtatacccatacaaattgtatacatgcacacgaatggcagagcttcctaattgcc

SEQ ID NO: 86425 - DNA, 1105 bp, Homo sapiens
caggaaaaactgatcactttatctttctctttccttctttttttattttttctttcacctatttttgctttacctttttaaaaaatatttttcagtcttccctccgcctccttttcttctgtctctcttttcctgtacatcacatctttccttttcctctgtctttcccataaaactgaacatttttaatggaatggagcttcttgatataagacctcaaaaataacgtaatcaggcccgatatctgccacttctctgttcctgataaacttgtttgcttttacactgtgattaggactcaggacaaaacaatgtgtgacttttaattcacacttctcattcccctttacaagaaaaccactaggtaacagacagaaccttaagagaaataaaatctctagcctggcaaaggaggtaaggtggtttgttatttcactaattgtttttgtttttgaacctgggaagttgtttttgtggtggtgttgggagtacattcctagtgctaataggttaaggcccctgtagacagtgtgagaatggtaagtgttaagggttcagatcctgctgcagataatcaagtgttgactgtatgtgtaatggtaattgagcagaataagagggtaccaggtaatgtcctgaacttgagacggttgatatataaccatatattttcaatgtatgggttactgtgtaatattttatttgttcttgcagccaggttgtcaaagcattggcaataaactgctaagtaaaacatttaaaaattatgtgcttaaagtcattttcttttgaacatttctgaatttgcagtgatagctattttcagtgaagaaaatatttggacgaatagaagaaaggcgcattagaattttttaagggactctcttttcagtttgccagtgaactccttacagttgaataatgaatgtatttaactctttcgtaggcatcctctggtatcacgattccaaaacccccaaagccaccagataagccgctgatgccctacatgaggtacagcagaaaggtaggtgcttaggacctggtaaggagtgaggacactgtctttgctgcttctttgcttaacatccaactttagatcggc

SEQ ID NO: 86426 - DNA, 1608 bp, Homo sapiens
aacacattgagacaaaaatgtctttaaaaacagcctatttctgtacattaatagaaattctgccccagaagaaagctcttaaataagttcttgctagagaaacagctgagaattgcaaaagaaacaacaacaaaaaactgagtaaccaagataaatttcacaaaaccatgaactttattcataggagatttcctaggaccttgctcttctgtaagcacagttctacccgcctccccattggaaattgaaagcagaaaattggaaagagagttgctgctagaggtgggtttcctgatagtagcaaggaaagaaacagttcaaaaatggaaacacattctccaaaagcatagcccctaggccgttgaaagagtcaacaacagattttgacatctgacagagggttacagcacagcaaaacagtggttgtttctaattgaatcttatccagaaagggtctaaagtatgttcagctttttttaaagaaatgtttaagacattgtagaaagatgtctgtctgagacgttaaataaattggaggtgtgtaatgatataaatctttactatcctgaaaaccatctggaatttaactttattattgttttggggtgtttttttagtttgggtttttgttgttgttgttgtaagttgactggtctcaatatacagatgatttgtgtacctttctttgggagaaaggaggggaaatagcaattccattaatataaaatgtgattctttgaaaaatatcaaagagcaaatactactgtgtttttaaagtgttttaattcatattaaagctcggaagcataggcattttagaattctttacctctttaatttcaaaaaattttgacagtggtcttaccacctcagttatgggcacaattccaactttatttgtaatccatttcatggaattctgaaggtttgtgttggatatgagttggaaatactttctagtaactttatgtgtgaagaagcagacttgtgtgtgtctgttcctctgaatccataaggttagtcttataggaattctctttccccttgaaagaactatagaccctgatacaggtttccctgtattggctgcccatcctaccacttttgacagtttccatgcccctggccatctcactctcttacccactgctggccaaaaacagtgtctgtctacctgggcactagcatgaggtgtgacaagaatgcatgggaggaatggaaagagaggaaatactgcttccaaggcgaaatgctttgaagaagtagagttatagggatggagagagacccttgtaggaagaggaaacatttcttgatcatagtggaaaaggacacaaacatgctaatccctgagccctcaaatgaaaaataaggttatgattggggtcccagcccagagtggaggagtatctctggggttttatcatagcaacaacagaaggggaagcgaacaaaatgttactttagttttcctataaggatttgccaatcctgtctttcgataattaaaataaagccaacacttcatttctccagcctagcagggagagtcaatatcagagatctcctgaaaatttgcaaattgtctgaaatagcaatgatttttct

SEQ ID NO: 86427 - DNA, 1946 bp, Homo sapiens
gacactgcagacaggtttctcaatgaaagaaaaatatttaatttcctcagtggaaaaaaagaacaattacaacacatcattgcttgtttaaattcaggttgcttttgcatgccatatgcagatcatttttcatttctgtgttttcctcgtttgagctcatttctcattcgtgtttttgtctcatttgtttccatcagcaaatgcccagcacaccagggtttgtgggatacaatccatacagtcatctcgcctacaacaactacaggctgggagggaacccgggcaccaacagccgggtcacggtaggagaatcaactattacagcatccggcaaacaactggaattgaccagaaatgccttcagaattaggtctttttgaatcataagcacagccatttaaaaaaaattttttaacctagctttttgagtattttcaacattcgttgtagcatctcacactgaaaaaataaatagtgagatctggaatgtatatagaagaaaagaaaaatccattctgtttggtggttggtagggttaaagccttgagcacttgatgcttatactgtatgtaaacaaacagaatttcttaaggtaaaaatatcctttttgacataaagagtatttttcatttttataaggtgattggcattagtctcaaggattgagtttctagtagaggctggtctttcagacctggctttttcagggctggaaagcttttggctggtacaccagtttgaatcgctacccatagttatttgtcttttggatttagtagttgaccttctaactaagactcatttctctacagtgaaaaagagaaaaacgttttaatgtcacctcaaagaaatgcagagtgaaggttgaatgaaattaatttgaagtatcagactagatatgtacaacgagaagtgcatttctaatccttagtataagagataggatttctgaaacttagcatgtttcatttaagtgatcagcctaagatatcaaaattggatgatacacttcaaatcttttagtttagaatcatcttaaatttcattcaaaaaagtttaagcaccaaaaaatgccaataattataaaaatgacttactaaagataaaaaatccaaaagtcaaatactacattggaatgtagtgttggtgagaatttatacaacccagaatggctgtaaagtttttaatacctggtttttgtttgctgtattcataaataacaagtgccttctattaatgtaacttcaaaaaagccctctcaccctgtagtcaagctggaactgaaagcttgtagctatcaaatgaatgtctatcttgataagcatattgcttagcttgataggttttgtttgtctaaatttttcattgtttctgcataatatgtacttcataagcatatcaagttttatgtgccatgcatatttcatggtatctgaaaaagaattctgacaaagtgtgtgtatgtatgcatttcacaatgcatacaatttttatgtgcatcaatacatgtttttccctggcctaaacatgttgtttcacaagtgtaatggatggcaaggttttcaaatgataaagaacatttcagtttaaacaatgaacggaatcaatcatggatcttaatgttaatgcagcaattttttcacgggcagtaaacaagaatgattgcatttaatagctctatacagtcacctcttgattatctatgttaatggaatagaaatgataactataatattacagtaatttgtcttttggttttgtgtaagtattttgctcttaacttggatgtagctgtgggggattctcagttaaaaaagtgagattgttcgatggagactaggaagagaaagtgtactccctatctgaagtcactcatctgtttcttcccattccttcttggcgaatgttaagaactgaacatttggcgtggacactagctacatagt

SEQ ID NO: 86428 - DNA, 1043 bp, Homo sapiens
acagctctgagcaaattgttcaacatttctgagtctcagttgccctgaactgccaaataaggggctaaattaggtgatgtctaaggctctttgcaactctaaaaatatcctacaactttgtccagaaaatgcatcttagaggccacacgcgagccaccctcagcaccagctaatcaggctccagactgtttaggccaaggcaattccaggagaccacccctgactattctggtggcaaaacaattttatacttgtcatcactccctgaacccagtcaaatccaaccaagtggactcaaaaccagtcacgtccaaccaagtgtctcctgtcccttgtccctcctttttcctgccctgccaaccctcttcatccccaccctccacagccatggcctcaagaggaaggaggcttctccttggtcacctctccttcccttccagcctgatgtcccagccctccacactcacacacccagttaggaacaacaccaatagtaataataatggcttccattcattgacagttttccatttgccaggcaccgcactaagcatgatctcatttagtttttcaacaagcttatgaggtggaaactctttttacccacactttgacaattacatgaaccttttctgcagacctctctgcaaaatagttcaactgaaatgattctttaatagcattaaccactttctgctgaattgtcctaacaactttttctatcagaaacttatccttcatcctcgatctccattcccatctctctcccctttcctctcattttctcccacatcttttcctctcattttctcccacatcttttcttgtcatctcctctccatcctccttcttcacttccatctcctcttctgctcccacttccacacacctaacataaggacttcaaggcagagtctgtgttctctagatccccaatgccacatctagctttgtgccacttaattcttatgctaagactcctcttttgaggcaaatgccatccaatggcccctcaccacatacactcccctctgcctcatcat

SEQ ID NO: 86429 - DNA, 1007 bp, Homo sapiens
ctgagacagtacctggcacagagtaggtgctcaactaacaggagataaagaaatgcgtttctttgcaagatccattttccatagcactcctactgcatccccctggaaatgctgatgcagctatgggtctctgggtgttccccaaacacaccaggtgcattcccgtgtctacctggacgattttccaccttgtcttctcagcctggcaaagtgctgccctggcttcgaaacccagctttgctgtccctccctgtgaaactatcctccgaggcctggtctgaatgagttgctccctccctgggcctcccaaggtgcctgtacacacatacctttgtcactgcacgagtaacattgcgctgcactgaactgttttgtgtgtgtctcactcacggcctgctctcactaagggcagggcttggctgactcagtactgaattctgagcacccagctctgtgactgcacacaatgaacccaacaattaggtgctgaatgaaatccaactctgggctcttactgcctgcgtccattcagcaagcatcaatagggcaactactgtgtacgaagcactgagtcagaccttgtagtaggtccaaagatgaacagaaaaccaccttttggctgtaaaggattatcaattgagaaggggagcagatccgcctctcagtaattctttttttttgttgctgttgttgagatggagttttgctttgttgcccagactggagtgcagtggcacaatctcagctcactgtaacctccgcctcctgggttcaagtgattctcctgcctcagcctcccaagtagctgggattacaggctcttgccatcacacctggctaatttttttttttttttgagacggggtcttgctctgtctcccaggcaggagtgcagtggcgcgatctcggctcactgcaagctccgcctcccaggttcatgccattctcctgcctcaggctcctgagtagctgggactacaggcgcccgccaccatgcccggctaatt

SEQ ID NO: 86430 - DNA, 3239 bp, Homo sapiens
ccaaaccaattggaagcggcgccgcctgggcgcttggggcacgacgctgtgggtggggtcaggacgtgagggcagcgcgctggcgtcagaggcgcggctatataactaaacacaggcaccgcccctctgccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtggggcaccgcctggcagcccggactcccccgacatgtgatcggcttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagaggtgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggaaaaagcagaagggacttgtctacctttggtttactgtttctgtggatctacttcacagatgcaaatttgaatagcatatagatgcattgtaaaataagccaaatgctgggttgttcctgtatttgtaaggacatgagtttttaaaaatgaatttcctgagtattaatactaaaatactgttacatgatcagctcttgatataattgaagagatttcagatacctgatgagtctcattctcacactaattcagaaccttggaaggcactgagtgttcaaaaaaggtagctcttaactgaggaccctctgttgaaccattgtgcgcacccctggctcttgggcagtgtagtagcaggaagacagggttgttgccattagaaatggaggctttaactctccctgtcccccatttaaaactttgcccttttgtcttttcagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaatacctgacttgcagattatttatatatagtcgatcttgtgcatataaaggaaccatagaaatgggcagtggaggattcgtccacacccacagcttctcaacgggcctgaatttggccaagaaaaacctttatgagcttgtccctctctggtcaactggttttttgttcgtttgttttttgagacaggtttgcccttgttgcccaggctggagtgcagtggcacaatctcggctcactgcaacctccacctcaggttcaagcaattgtcgtgcctcagcctccctagtagctgggattacaggcaccatgcccagctaacttttgtatttttagtagagacagggtttctcc

SEQ ID NO: 86431 - DNA, 1050 bp, Homo sapiens
tttgagatttgttcccttgtcaaaagtttaactctgatagaaggttggcctcacattctgatgtttggacatcccttagctaggatatgtctggtcgaacagacctttgtggcaagccagatgtcctatcacctcgctagcggtaagagggcctctttgagctctgtccacctagtcaggttggagacaccaggggatctaccaccaaaagctcccttctagtagtacagctggtgcttctgccttaccccatcctctcctctcagattcaccgaggactgttcaggtggtaacattctcttagggtagggaactctgcagagggagagctgaggaggttccggccatagttgtttgtaatcttagggctctgggcttggctgaaacatgacggtattgcttggtttcaggcttgacactgccaggcgcctattgcttgacctctgtttaaatgagggacttcaagactagacagcatggctcttttcagtttattgcatgaaggagttacactagtccaagttaaaagcggaccccaaatggttacattatacaagctgtgaggtttttaaacctgtgacaagggagagaagggaaattctactcattgcaaggaaatcctcacttaagcttcagtgagccacaagcacttaaaacccatgaaccttcagctgatcgtccttagccagtccaatctgaaaagacaaaagggcaaagttttaaatgggggacagggagagttaaagcctccatttctaatggcaacaaccctgtcttcctgctactacactgcccaagagccaggggtgcgcacaatggttcaacagagggtcctcagttaagagctaccttttttgaacactcagtgccttccaaggttctgaattagtgtgagaatgagactcatcaggtatctgaaatctcttcaattatatcaagagctgatcatgtaacagtattttagtattaatactcaggaaattcatttttaaaaactcatgtccttacaaatacaggaacaacccagcatttggcttattttacaatgca

SEQ ID NO: 86432 - DNA, 1305 bp, Homo sapiens
agttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggcccagcctccagctgtctctctagggagtgtgtgtgtgcacttggcagggcgaagttgtagagaaagggtggatgctaatattgaagtatgtgccgaggactcctattaaatacgccgtttaatcatagcagcagctcctagagggcggtgggtgatgtcataagtgtctgttggatggagaaactcaggccagagtaggttaagtgatgccctcaccagcagatcatggctagtgtggagctgggatttgagctcatgcttccctgatcctttcaccccagagactgactcagtggcctggctgtgaaagataggatgggagagagtcacccactgtcttagggtgaagtccccagagcagacctggaacagggttt

SEQ ID NO: 86433 - DNA, 2070 bp, Homo sapiens
ctgctcatggccactacctaaggttcttcagcttgaccaagccccagggactgcagtttcggcttccattgtctcataatgaaggtccttttctctttgaaggaattatgagatgcccagaggggacacatccagcctaaggtaagcctgccaggggctcccctacaacctgccctcagctttcagcagccagacagcccacctgcctctggttctgccaccctgcaactccggagaaggccctgctatctcggctggctgaactgagaactgttctgggaaggagctgccccacttttccttcaaatcttgccccctgggtggccgtctgattccaggcagctctgagtggggactgaagctttcttttcaactgactatgggctgagaggtgacaggcactggcttaggagctgggaacacctgggactaaggcccagcgtggtccctttcctgactgtgtgtccttgggcaagtcatttgacctgtctgagcctgtctagaatggatttgttcctatggcaagtagctgtggggtgggctatgaaggttaaatcatgcaggagggaggcagaagtgggtgttaaccctgttggtgtattccgtgcagggtcagggacataaaagaagatggggcctatgcagtgttggtgaccattcttcctccctcccaccagggggatgggctgggtatttgaagccttggagctggtacctagctcccctctcccctggctgggacagaaccaggaggaaccatcaggatctgtgtggagacgggtgggggtgggcctggggggttggactttccagcccctcaaaagatgtcgctatctcccgcccaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggaggg

SEQ ID NO: 86434 - DNA, 1050 bp, Homo sapiens
ctgttctgggccctccccgtcccagtgtcttatgatggcctctgggcctttccagtcagcttggacccatgtttttccttctttgcctgggtgagcttcacttgccctgtggtcttagcttagtggttcctttttccaggaatccttccttaccttgcaggtcgggttgggtgctgtagctgtgatgcccctgccctgtacacccttgacatttgcccatcatggcctgtatgatgtgtgactgtggtctgtctccccaccaactttacctcagtgtggcggctgggtcttactgaccactcaccctggtgccctgctcagtatcagtcaatgaacatttcttgaatggaagacctgagtgaggaatgcaaagccctgcaggacccactggcacagcgcagcagccgagggtgggggagacagaggcatctgggagggccagagctggtccctgaaggccaggggagccagggctgacctgtcctctgccctccccagcggaggccagccaacagatggctgagctgtcggaggtgctggtgctcaggctggaaaactatgaacggcagcagcaggaggtcgctcggctgcaggcccaggtgctgaagctgcagcagcgctgccggatggtgagtcgggtgtgtgtggaaccctcttgtcgtggccccatgggaccctagcttccttcttcctgcctccactcggctccaccaggcctgaggtccctttctgtgtcagagtcagagacctcagagagccccttatcttgaccccttgttatcttgaggagaccaaggcccagagagggtcctggagtcttctaggaaccaggctgcgtgactcccctgccttctttgccctccttccgtgtgacttgtcatttcatgggctgccaaggactcactgatgtgcctgggaagacttgctggaagcagggggtgccctgagtgggtaggcctcagatgggggttcactggttttgggtccttccagtatggggctgagactgaaaagttgcagaagcagctggcttcggagaaggaaatccag

SEQ ID NO: 86435 - DNA, 1050 bp, Homo sapiens
aggaggatgaggatgaagaagaggaggaggaagaaaaggaggcagaagaggaacaggaagaagaagaagcagaggaagacctgcagtgtgctcatccctgtgatgcccctaagctgtgagttcctgcctttgcacctgcaagtcctttctctgagcctcaatttcctcatttgttaagagggacacaggtgatgtgcttgctggcagggttgctggaactaattgagaacactgcccttagccctggtgggctgggaactgggaagccccactccctgcaccctgactcccattcctccctcccctaggatttcgcaggaggcattgctgcaccagcaccactgcccacagctggaagccttgcaggagaagctgaggctgctggaggaggagaatcatcagctgagagaagaggtgagaatgggggaggagggcgtccctgctagcagggggtgttgacttccctgtcccttcctctttgtctccctccaggcctctcaactcgacactcttgaggatgaggaacagatgctcattctggagtgtgtggagcagttttgtacgtaatgttgtcactcggggtggggggttgtcccaaggagcagagaaaagaactcaagatgtggagtatggagatccaagttcaagtcccagatctggcactcctagctgtgtgaacttggatacattccttgacctctctgaacctttgtctttagaatggggattaattttctcagccccactgatctctccagggtttatgaagattaagagtgtcaacagctgaggaagtactttgtgcaaactataaagagctatacagaaattgtgggtctcaggccaggcacggtggctcatgcctgtaatcccaacagtttgggaggctgaggccggcggatcacctgaggtcaggagtttgagaccagcctaaccaacttagagaaaccctatctctactaaaaatacaaaaattagccagatgcagtggcacaagcctgtagtcccagctccttgggaggctgaggtgggagaattgcttgaacctgg

SEQ ID NO: 86436 - DNA, 1096 bp, Homo sapiens
cggctttgggcagaaccattctccggagatggagagggcagaaaaaatctttcgctcccatcccaactcggagccatccggaacttgcactcgcccttcttgccctgcttttcttactgtgctctgttccgtcaccactagctcccctcccgcgcggctctgagtcccgcttgccactagttgcttctcggcagcccccacccctacgcgtggtccggcccggcggctggcgcaggttataaaggtcccgccgcagcagcggacggcagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaaggtaaatcgggcccccggggtcctggaccgggtggggactggggcaactccagggaggaagtggccccatcgggtccaggcaccccgccccctctagcactcagtgtcacccgtccaccacccccgcgatgtcactgcggtgtctgtctggtcgccccttctccatctcctcctctgctcttgtcccctggtttgtgcccgtgagtcaggttctggggcctgcacgctcgcccacccacctccacgcgcctcttgctgcggcagatctgcaccccttcagcgcccctctcctgggtctaccgcagtgccaggagaggggcggggggctgcgggagggcgctgtcccgcgcgc

SEQ ID NO: 86437 - DNA, 1057 bp, Homo sapiens
gcaatcttggctcaccgcaacctccacctcccgggttcaagagatcctcctgcttcagcctcctgagtagctgggattacaggcatgcaccaccttgcccagctaattttgtatcgttagtagagacaggttttcttcatgttgatcagactggtcccaaactcccaacctcaggttatctgcctgcctcggcctgccaaagtgctgggattgcaggtgtgagccaccgtgcccggccaggccagttcatttcaatgcagtgagttggccacttcagttttcatggaagagctagctgagccttgcaaccttgagaaagtcagttcgcttctctgaacgtcagtttcctcacatgtaaaatgaggatgatcccttctccatgtacctaatgtgaggatgaaatgagaaagcacagggattccaggtaggcagaagggaggaaagggcaatgggctatatcccggaaaggttatgcctttttgattttcagaagggacatctaccctggggacttatctggaccttggcctgagctatgtcgcatgcccatcctttgctgcaaagacagctgggaaatggagactattttagctgcacacagtgcccccttgataagaatcagggttttttgtttgtttgttttatttttaagagacagggtcttgctctgttgcccaggctggagtgcagtggcatgatcacagctcactgcagcctcgaactcctgggttcaggtgatcctcctgcgtcagcctcatgcgtaattgggattacagactacaggtacacaccacaatgcctggctagtttttttttttttttgtaaatgatttgtaaagatggagtctggctatgttggccaggctggccttgaactcatggtctctagcaatccttccaccttggcctcctaaggttctgggattacaggtgtgagccactgcacctggcataaaactcagggttctgacagtaggaaagaaaaagatggataaggcattgggtacatcaccacagggggctgccacagctaggaacaagtctccccagactaacc

SEQ ID NO: 86438 - DNA, 1050 bp, Homo sapiens
catggctttctaagcttcaaagcaaggaaagagatcacaaatggaaaaaaaaaacaaaaaacaaaaaaacttgagattcaaccatataaacatgaaaaccatctgtatttcagaaagaacctaaaaaagcatttttaaaaaatcagcaaactgggagaatatgtgcaagtaccataacagacaagaagagtctaacatctttcacatcagtgagctcattaacactagattccaatggttagatgaggcagagtcacaggtaatttcaaggtagctcatgaacaatgctcagcccagtttaaagcagtaacacttactccccagtgacggcccattttccactatggaattgctacagggtggaggtgggcagtgctgtggggtgtgttgtccggcctgcctcacccctttccacctctcccctgcttcccacgtcccctctccccagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactggtgagctgggggagggcaggaggctgggtcccactcccccagccacgatggaggctggccgacgtttaacctggcttttcctttcctctctgctcagccacctacgctgctgccgtcctgttccgcatctccgaggacaagaacccagactaccggaagcgcgtgtccgtggagctcaccaactccctcttcaagcatgacccggctgcctgggaggctgtgagtatcctaggttggaccacagtagttggttgtgcaagttgggcactgcccatgggcaacacttttgggggtctcctactactgtcaacttcatagatttttattttgtaattggatcatttataacaattcctagcagatggaagtagtgggttgaatcatatatccacaaaatgccaatttttattttgcccaaatgagtatacagtgtttgaggtgggggtgcctt

SEQ ID NO: 86439 - DNA, 1056 bp, Homo sapiens
ttgggcaaaaataacctgctttccctcttctctgtgccaaggtggaggaggggagggcattgtaattatgttggctacatgattagtttagctaatctggtttgtggctgtgatgaaaagataatactgaggaagtactgctaggaggtgcttggtgaaaactggccactgactggactgggggatgcgggggaggaggagaaggtaggacccagttagtcatttcttgctagatcaagccccagcttgggtgacttgagccctcccacccccactccacccctcccttgcaccctggctccaccccattccctctggagcctctgtttgggctgccagggccgaggctttgagaatgcagtgcataggaacgaaaaaggtcgggctagggctgccaacctttttcccatcctggagccaccttagagtgagatgggtcaattgactagtctacagaaggactgtttatttggagagatgggacagtggggcagttctgagcacagggctttgggcttgaactgagctgggtttgagacccagctctgtctctcattacctgagcctcagtgacctctttggcaaaatgggaatactaatacctatctacccagtaagtacttgacaaacggtaactcaagatcaaggtaagactttacagaaaccaagcactttcttttttttttttttttttttttttgagatggagtctcgctctgtcacccaggctcactgcaacctccgcctcctgggttcaagtgattctcctgcctcagcctcctgagtagccaggattacaggcgtgtgccaccacccccggctgatttttgtatttttagtagagacagggtttcaccatgttgcgcaggctggtcttgatctcctgacctcgtgattcgcccgccccggcctcccaaagtgctgggattacaggcgtgagccacctcacctggcccaaaccaagcactttcattaactatttttacttaatccttatggctggccaggctggatggctcagacctgcaatcccagcacgttaggaggcccagaagg

SEQ ID NO: 86440 - DNA, 1050 bp, Homo sapiens
gcaagggctcagcctggaactgatgcctggctttggagggattagtgcgggctacgcaggcacaggggacagcagtagttcctggcagggaaacagtatgagcaaatattatgcatggactagcaatattcttgccagggtctttatgcttaaaaggtggggctgtgcaggggcgatgtttatgctgacaccaaattctgctggtggtgccctatgcagccactcagggaggggcagtttgggaaaaatcctcaggactgtctcattagatcttgagactggggagggggaggggctttggggaccgagagatgggatgggaagtcccattggccaggaagggagcccatatgggtttgggcgtactgtgacccggtttctcccacaaccgtggcgctactctagatggagctggaggagacagaaccgcccctggagcctgaggatgccctatctgacgccgagtttgagggggagggtgactacgaggagggcatgtatgctgactggtggcaggagccggatgccaagggtgacgaggccgaggctggtcagtgacacgagtccttggggggtggggatgcagcctgggatggaggttggggacagatgcattcacccgctgggctccggagcccagggtgtgtgtgggtgctggggcccatcctccaggggcctccagcctgttggcaacccctgtcccgcttgggggtggtggtgcagcatctcccctggagctgggaccagctgagacctgtccgggggagcctcaccccacctcccatcaggacagcacctggacacccattgggagtgggtgggggagcaaccccagtgctttctcctttccttttcagagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcact

SEQ ID NO: 86441 - DNA, 1030 bp, Homo sapiens
tgcctcacctgcaaaatggcagtgatactgccacctcaccagcagtgtccagacgagggaggtatgaaggtacacatccactcctacctgctcccctccctaccttcattaccctcactgctgacctttgtccctctttcccaggaacaccctaggtaaccaatggaggaaatctgttggagttgagggccaggctggcaaatatggggcacatggtgccactcctgccttccttgtcagtggcagacattgctaatcgattgagggactctttgtcaccaaactctcagaatccttaacccagtgttccaagcagccacgatgatctgatgagcttgtgagctgatacctattctctgatccttgagctagaagagggccagtgggcccagatcctaggagccctggcttcttgccatctggcaacagggtatggctcaccccccaccccgtccttccctccttccaggaggccatgctctaccacaaccagaccgccgagctgcgggagctgctggagttcacccacatgtacctgcagtcagatgatgaggtgagtgcctcctgctttccaggattgggctgtgatggggacaccttggaccttttcctggggccaccagtgtgccagaattcagccccagcccctggtggtcagctgtcgtgaagaagagaggtttgcctgttccttgtctagactgtccgttccttccccagccttagtattctcatgtcctccttttgtacatgtctcaatcctgttcctcccaggcccagctcacatggtgcctcctccaggaagcccttgctgcatgccctggctctttgttctgggctagcagtgcccactctgacctgtgtgcctccctggccacctgtggcctggacctgggtgattgcagccctcgtccatctcagccctgggccccttctccagccagtatccaggagaaccgcactgcaggacacagggccacattattccctgttctcccacatcctgcacagagcctgggctcagaaactgagt

SEQ ID NO: 86442 - DNA, 1105 bp, Homo sapiens
ccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggtgggagcccgcccccacccggggacctgtctcgggctgggcgtcgtggctccccacagatcggtcgaaggagcgttatcttcacccaaggcacgaagcccgccgtgcgctcggggccgcgagctccggtcttgctgacccgctcccccaccccctaccccccgaccaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggtggggtggagggtcaggaggaggcttgtagaggagggctagtagaggaggggagatgttgggggcgccctgactccccctgccacgccccttccaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttct

SEQ ID NO: 86443 - DNA, 1999 bp, Homo sapiens
ctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatattgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttaagtaacacatcccacttacagttgtttgcatgattagtcttgtgtatcatgatgttcaactttgcttttgctgtgccagttcaaaaatatcttttttgctaaaaactcttaaaattcatgacataagttttgttttgatcacccggttttatatagtatttctgggaccaaaaaatttaaatatacctttttaatataaaacagaagtttgaagctggaaagatagtgtttatggaagatttgtgtgcttttgtgttttttaaacccgtcaggctgctggtaaggcagtttctagggctcacttttcctccttacctcttgactagtgtagcatgtggtatgtttaaaatatttcattttctgctttgtaattctaaagtcaacactatactgtatgtagacaggagagctgatttgtatattttagttatttggtctaatcaagcataactaaagggacttcttttttgatacttttctcaaattaagtttaaatatagtatacgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattgtaccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttatcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaactcagaggagatgtagcatttagaacaccttgagacatgacattgtaaaatagcttgttttatgttcctgaagctatcttgttctctgttaaagctactaattgtctcagtgtaagttttaaataaacatatttctttaaagctggtttgtactgtgtgacttttttttcttatttatgcactgtcggatataattgctttcttccatccctcctactccctcattcatccagccattggctctcttaagttgaacattttccagtactcttcaaagtttaaacactgcatttttttaaaaaaagaattaattcttattgcttagactttttattagctaaatgaagaggctcatacaggtagggtacttgtcgaagcagaata

SEQ ID NO: 86444 - DNA, 1203 bp, Homo sapiens
caaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgcaatttttgtctttggtttgtttgtttgtgctagctaaataagatcttattaaggacaagtggaaaaatcaggtgtagttgcttagctgttttcctgccaacgagttatgactcctttgtcttgaggacttacgttttgaacatgctttaagcaccaattttatttgcacatttactttgatattctttttcattttttattaaatgattggttttggcaagatctgacttctgcattgagccctcatctgcaggaggcatgtgcaatagtgagactgaaatttgaatgaaaacactcaatatttcagcaagataatttgagaatgtttgcattgatattttcttatgtttatctagaaatgccagtttccttcctagaagatgtgactgatgagaaattttttactggctcatgcattttttgaatatttttcattagcagctgtttatagactttaagccttcaatctgaggtgacggtagttggcaaaagtatagatctttagctaattgactaaatacagagcaagttacatgtgtgaactttgtt

SEQ ID NO: 86445 - DNA, 1101 bp, Homo sapiens
cccagcactttgggaggccaaggcgggcggatcactttgaggtcaggagtttgagaccagcctggccaatatggtgaaaccctgtctctactaaaaatacaaaaattagctggacatggtggtatgccccaactactcaggaagctgaggcaggagaatcgctggaacccaggaggtagaggttgcagtgagccgagatcacgccactgcactccaacctgggtggcagagtgagaccctgtctcaaaaaaaagaaaaaagtaaccacataaaatatgcacatttgaaaaattaatcttttctctttttcttgattttaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatactttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaaga

SEQ ID NO: 86446 - DNA, 1031 bp, Homo sapiens
cgccccgcgcgcactatttaatcccagaatccctctgtgtcgtaccaacagccgcatcgttccgaggctgtggaggccgggcgcagcggcgtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggtaggcgagggaggcgggagcgcggagggcggcgggcgcggagagggggagatgctcgctggcggaggggagggcagtgcctgccacggcagctcgcgagtcctgagtgaatgcattggtttcacactcgctgagcgcctgcttgggggcagccaccgcggtgggcgaggaggatgcaccatcaggtccggcgagggcgccccgcgcccaaggagctcagatactaggtgatgggacaaaagtgatgaaaaggaaagtcagtatgtggtaactgttgtgctgacgttcaaaaggaatgaaaggctagggattgaataaagatctttctgaagaggtgaagtttagatcgacctctgaatgtcaaaaaataactgaccgtgcaaagatggg

SEQ ID NO: 86447 - DNA, 1082 bp, Homo sapiens
gcctcccaaagtgctgggattacaggcatgagccaccacgcctgaccgtagatgagcatttttaaaaccatatatactgaaactattagtacagttcaggccaggccaggcacagtggctcacgcctgtaacagcactttgggaggccaaggaggatggattgcttgagtccatgagttccagaagagcctgggaaatacagcagaaccttatctccacaaaaaatacaaaagttagcctggagtggtggcatgctcctgtagtcccagctacttgggaggctggagtgggaggactgcttgagcccaggagatggaggctgcagtgagctgtgatggtgccactgtactccagccctggggcgacagagtgataccctgtctggaaaaaagtacagttacaaaggaatacagatcaaaggatatggatgccaggagccagcagtatgccttcattgttactatatagtttatttaaaccagactatgataatacagagaagagactgaggtggcagctgcccagaatctttgtggattacagatgcaaagtagttaggagtccttggacccacacttcagttacagacagacaaatcagctgcataaatacagagaacataagacacaagacatttcacagctttctgcatttccattttaaatgtatgtatgttacaactttacatattaagttactactccacatattttgtgacaatggctaaggatgcaatggccccatccccctgacataaacagactctggtctgcaacacagaacatttcagtgggataccaaacaagcccttaacacgtaacatacaaaaagatctttaaaaatcagattaatacaatgttcttcatgttatataaggaagaagaaagggaagtaaaaaaaaaaaaagagagacattggggtgctttaaatgtatagtatcttgaggccataaatgtttcattcccttcctccaaaggagaaaaaaatgtttaactaatggaaaaagaaagcaacatcctaacgccctacaatgaggaagaccccatcctgacagtacttagatgcttccatataataaatac

SEQ ID NO: 86448 - DNA, 1932 bp, Homo sapiens
ttagaaatgattgctagcccaggaaaatttttttttttttttttgagactgagtcttgctctgtcaccaggctggagtgcagtggcgcggtctcagctcactgcaacctctgcctcccgggttcaagcgattctcctgcctcagcctcccaagcagctgggactacaggcgcatgccaccacgcctggctaattttttgtatttttagtagagacggggtttcaccatgttagccaggatggtctcgatctcccaacctcgtgatctgcccacctcggcctcccaaagtgctgggattacaggcgtgaaccaccgtgcccggcctatttttattatttattttattttattttttccctttaaaattttgttttaatttaaaggaaaatagaatcagatccagcagctcccttgtacaaagtccgcctcatctacctatacagtggatttggactaaacttcccactgctttgtgtctactttttttgtgtgttagaaagatttcccttccttagcctcttcctctcaccaggcttatgaagctctaataaaaaagatgtgtttgcttcattttaggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggctcctggcatccatatcctttgatctgtattcctttgtaactgtacttttttccagacagggtatcactctgtcgccccagggctggagtacagtggcaccatcacagctcactgcagcctccatctcctgggctcaagcagtcctcccactccagcctcccaagtagctgggactacaggagcatgccaccactccaggctaacttttgtattttttgtggagataaggttctgctgtatttcccaggctcttctggaactcatggactcaagcaatccatcctccttggcctcccaaagtgctgttacaggcgtgagccactgtgcctggcctggcctgaactgtactaatagtttca

SEQ ID NO: 86449 - DNA, 1149 bp, Homo sapiens
ctgtgttgctggagtgcagtggcttttcacaggtgcagttataacacacttcagcagccccgaactcctaagctcaagcaatctccctgcctcagcctcctgagtagctgggattccagaagtgttctccacacctggcttatttttacttcttactgtattaaaaaaatggagctagtatttatttccaaagagctgagattacagacctgagccactgtgccgggccaagtatacgtatctgaacctgaattagtgagccatgctttacaaataaggctctcttttgttctgtatgtctcttgagagagagaggagactttcctaagcaggaaacccagtgggcaagtgtgatttctcttggtcattctctccccagcctggccagaaggggctgggcagtaatgcaggggctttgtgattctttgtggtgaatctggaagtcaccttcctccctgattgtggtttctgcccccacaggttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtaatcagctgggaagccaaggaggggcttcctgctttgagagcagtgggctaggagacgatgctgtgtcctgcaggctgcttgctgcccctgagttccaggcccgcaggaatgctgctgaagtctaaacaatggggcatcactgctcttgtctcaggactgacagagcatgaaatcggaaaacacagaacagggcaacaatgtgcaggaggggcgactgggctttggggataattctgtttgttgtgattggccatagggaggcagcagagtacagtggttaggagggccagttctgaaattggactaaagaggttcaaatcccattttccctctttagtagggggtgggtggcaggggccatcctggtccggttacttaacctccctagacctccatcatttttacacatcaaatgggtaaataatacccccacctcatggggctactggaggaataaatgaattgtaat

SEQ ID NO: 86450 - DNA, 1021 bp, Homo sapiens
taattttgtatttttaggagagatgggttttctccatgttggtcaggctggtctcaaactcccaatctcaaatgatctgcccaccttggccttgcagattgctgggattatagatgtgagccaccgcgcacagccaggggtttttgtttggttttaaagagacacacatactgctctgtagcccaggctggagtgcagtgatgcaatcatgcaactcactgtagcctcaacctcctgggttcaattgatcctcctaccgggtctccctgtgttgcccaggctggccttgaactcttgggctcaagggatccacctgccttagactcccaaagtgctgggattacaggcatgagccactctacctggcccctacaatactatcttgaccctttacagaagtttgctggccctggtttagagccaaagagaagtgattcctggatctgtcccatgcccctcccaccccgcctctgggctgagtgtagaagcagctcatttctcttaaacgctgaccctgtcctgtggggatggtgacaagactcggagggtcccatgaagaaaagccttagatagctgctttatgagcaggcacaggaacaggtagacaacaggagggtgtgagcttttgggtgagagtgaacgtagctgctatgactgtagcagggcttccgaaatacctgcctctcttgggtggatcactgtggtgttagctagtggagatcagtttcggctatccaccacttgtgttttcaggagatggttagagtgattacgagcagaggcctgtgggaagaatgagatgcatattggttttgttttttcgttttgttttgtttttgtttttgagatggagtctcgctctgtcacccaggctggagtgcagtggtgccgtctcagctcactgcaacctccacctcccgggctcaagcagttctcctgcctcagcctccctagtagctgggattataggcgcgcaccaccatacccagctaatttttgtatttttagtagagacggggtt

SEQ ID NO: 86451 - DNA, 1082 bp, Homo sapiens
cagagtttcactctttttgcccaggctggagtgcaatggtgcaatctcggctcaccgcaacctccgcctcccgggttcaagtgattcttctgcctcagcctcccaagtagctgggattacaggcgcctgccaccatgcccggctaattttttttttgtatttttagtagagacggagtttcaccatgttggccagggtggtctcgatctctcgacctcgtgatccgcccgcctcggcctcccaaagtgctgggattacaggcgtgagccaccgcgcccggcaaattttttttttttttttcaatcggtcagcttcccaagccagaggaggctcagaaagactccaacatttcattataaaaatattacatatttattatagaacagtttcaaaatactgataaatactgttttgttgaaaataaatacttgaggtcccatttcagaaaaacatgactgctgctatgacggtatgtccttatctacccccttttctagatttgagcaaagggaataatactgtatgccactcatataatctgctttcttcagttgctctttccacatcagtaagcactaactggcagcatcacttttgcttttgcaaatcttgtgatgggcaatctcggattaacatttgcctatatccttaattattccctaagcataaatttctagaagttgaactactgcatcagaaggtgcaggtttgaggctgggtgcggtgactcacatctggaatcccaggactttgggaggccaaggtgggtggatcatttgaggtcaggagttcgagaccagcctggccaccgcctctactaaaaataaaaaaaatagctgggtatggtggcagacacctgtagtgccagctacttgggaggctgaggcaagagaatcacttgaatccgggaggtggaagttgcagtgagccaaggtcgtgctattgtactccagcctgggcgacgagagactccatctcaaaaaaaataaaattaggatattgattattttgttgaaaattatcatctgatcccagactggcttatttcagtttatgactggagaatataaaattgtcttgat

SEQ ID NO: 86452 - DNA, 2038 bp, Homo sapiens
gtcctgagcaggaaagagccacctggtagaagggagaaggacaggaaaaacaggagagcaggttgagggcactggccctgtgtaactagcttgctgctcctgccttgtgcagagccctggccagaaccacagttagcgataaggctgctgtgtcctcagccccggctgcacaaacctcttctttggacctacactgacctagaattcatgctgattcaaaccctgactggagctggttttatgtccagatttacagggtaataagcattgttggaacataagtcctgaacccaccaaaattgggcgagctaagcatttttttccaatgactttaaaaataatttgttaagacctcatttgcatataagctgatgacacaccttgcctgggaaatgaagcaggtcctataggaattatcctgggcatctttgactgtggggcccttctttctccattctttgcagagctacttaccagctagcaggccctcttagcttgatttgctctttctgccaccttcttccagaaaaatcgaggcacctcctccccaagttctcagaattctgtcctcttgacattcctttacggttgtgatgaggcatcaccctgtggacatggggcgtggaggggtctgtcaggcagccctggcccctgcaggtctcctgggggtatgtgttctgggtgcactctctgtgtctttgcccaccaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcacgtgagttaccccatggcgggaaatatctccttcctctgctaagacaaagcttggggctgggcacagtggctcatgcctgtaatcctagcgctttgggaggtcgaggtgggagaactgcttgagcccaggagtttgagaccagccctgggcaacatagggagacccccatctctacagataatttaaaaattagccggatatggtggtgtgcacctgtagtcccagctacttgggagggtgaggcaggaggattgcctgagccttggaggttgaggctgcagtgaactctaattatgccactgcactccagcccgggtgacagagcaagaacctgtctcaaaagaaaaaaaaaaggcaaggcttgaggagtcagtgagctcattccctttgctggggaaggctttgcccatcctagagacagaggcagtcagtattcctgggggatctttgtcccttagatgaaaattctttgagggcacagaccatgccttttctatcttctaggtgaaattcctcccctcagcttccccttccccagtcctgacaggttgaggatatcctaattcttcttttactttctcacagtggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccaggtagatcactgggctctggagggtggggggtggggaccatgaactatgcgcaggtagatcactgggctctaggggacagagggtggggaagcaggaatggctcctggttgatgtcccgtcactgctgcctgggacaaagggctggggatttgggagtagccagtggtttaggtggaaatggttggagacacatgatcttcagaagtcaggatagtgacttagggcaggtcagtctgggcagaggctgcttatctgggcttacaaagaggctgctcaggcctgggacagtgacttatgcctgtaatcctaggactttggaaggcagaggcaggaagattgcttgaagccaagagttcaagaccagcctaagcaataaagcgagacccattctctacaaaaagcttaaaaattagtcaagccaggcatggtgact

SEQ ID NO: 86453 - DNA, 2632 bp, Homo sapiens
ctaacagacattccctcctttgaatccccagcaagaaaagcccccgcctgtcagcccatctgtatttcaactaatttttctctccgtgtagatgtgattcctgccggccagcccttgcagccagctctacataagtggtgttagttacccctgggctggtatacctgtgcagcctcttcctgggacacactttgctatggcattttggaaaatagtgacactgtcccaaatcagcatccttgtccatggcacgggtcaaccccatgctggccaatcatctcatagtgtttcatggagacaaaaagggattggcattaagagggtgggactgcgccagctagagagcccagagttcaagtcatccagctgtccctgcagagggcctgggggaggcgctggtgttgagcacatctgcccagcctttgtcctcctcctgccccctctctgcccgtttggtctttgctctttcttgcttccattctgctcatcggtgctttcacctcttctgctggccttactccgttgtccattgcagaacaggagagggatgatgagggctttagccctgaaaggcttgtccatgggacccttccctgttcccaccctctccctccaaagcctccagccatcagtgggtcactcagttgccttggtcattttctttgacagattcagtcccaagtccaagatccctgcaaggtaggatgcccccaccctgcccccactccgcgtgtggctttgttagcgggtgacagttttactgtgtgctctgtttccccctcccctggtgggttgcagtgtcgtctggtctattttctgtccctgccttgatgtggcctgaccccaagtcctaagtcttcgctcttcctcccctcctatccgtgctcagtacgcgccccactcagtcctctcctcactgtgtggctgtttctggctccaagcttgggaaggggtagagattttggaaggagcaagagccagacccacagccctggagagtgtagtggtgtcaaggagagagtgtcgcctgggaaggagggagccatccaactaaatggggagtggcagagagtcgtgggcgtctgtcactgctggggtgcagaaggggagccacaagtcacccctgcttctcatttacatctcctgatgtcattttcccacctttcctgcctcggcttcaccactgccagcttcatcctcaagctccagggaccagtttatctttttctggggttgtggtggaggaacaaaagaggtgaagaaggaggtagacggaagcgcagaagggtgtgcagcggatctagtgactgggtaattggaaggggtatgagctttgtctggtgtatgaggtcacattttacagtggatacttctgtgcatgcgcattcacccaccagcctagctgagtagattaattggttcatggcatcagagcgtccatttaactttgacattcacagccgtggaggcggggaagtctttgttgtccccttgctaaggggaggggaaggagtaattggcagggtcgataaccagctggaaaggcctggaatgcagcactgtggccacctggctttaatcctgatgtttttgcctctggaaaaagttaagagcagagtgagcccagtgtggaaagaacagggaccagccctggttctccaggagctctctgtgctctgaaggggaggagggttatgaggaggggggttatccttgttactttctggagtgagagaaataaaaggagggtgtgtcagggagaacagattatggctgagcgagccctcccctcagcgaggccagaggaggcctggtgtagggggcatagcccctggcacagaggttctctctggagcctctctgctgctggtgggctgaggatacacccttcagctttggtttctctgtgcttgaggaagggccactttacctccacccttcctgctggagatgctggtaggttggtagattccaggctttgtcttgatttctgtagctggcagggtagatagatcagaggcatgtgcacgtgcgtcacctggcgggggtgacatgatgcaggcttcccctgaggatggcgggtcatgaactcacacttatattctccctcctcactttcacagttgagctgcattttaagtgattgtgtaatcctggctctgatgctggatgacctcggacctcaatcatttggcatctctgggcttcagtttcctaggactgggaagtgggagaactggattaggtggctccccttgttctgtgatctcatgtctcagcagaacccggggggtctaggtgacagtaaatcccaggtatttgcaacatcaggaaccttctgtcatgagaagctgtaaggctgtgatggaagaggcaggcctgtacagggatttaatgagaccatgaacttggttagccaagcctgctctagtacagtaggttaattaatacgagatgccactgggctagatgcatcattcttcctaggggagctcagaacctccctgagggctgctttcctcctcttggacttgcagggacccagaggggaaagtcaactgcctgaagcgtggtaaaagtcctttccctttaggctaaggactgcacttttttctttttttttttaaatata

SEQ ID NO: 86454 - DNA, 1047 bp, Homo sapiens
agggccagagccctgggggaatgggctcagggtgtttaggaacagagaccaagcactggtggatgcatgcgatgagggctaaggaaagctggagagctggggtccagactgcgaacaggaggaatatgggctctgataatttggttacttgaatcttgccagtaaatatgtttcttatgtggttttttttttttggagacaagagtctcactctgtcacccaggctggagtgcagtggcgcaatctcagcttactttgcaacctctgcctcccagtttcaagggatcctcctgcctgagcctccgagtagctgggattacaggcacacgccaccacgcctggctaattttttgtgtttttagtagagacagggtttcaccacgttggccaggctggtctcaaactcctgacctcaagtgatctgcccgcctcggcctcccaaattgctgggattacaggtgtgagccactgcacctggcctgtttcttgttcttgttatcagcaagtggcctttagaaagatttgtctggtggtgaaattatgacagctgatttgtcctggatattggtcttgcactgaatgcgccaaacactgatcatggctgtaaaaggccctttgcagggtcacatggacttgggcccttatctgcagacttgaattatggatttttttttccttcccttgcagggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcggtaggttccagcctccccaaaccttacaggaaggaaccatctcatcttttccactaggatacagtcttcttcctctgttccctgggggcatagaggaaatacagcgggagttagtgcatggttggtttgtggatctctgccaatttttttcctgtcctgattaaagtagtataatggaaggacaaaggattttaaaattggatcc

SEQ ID NO: 86455 - DNA, 1033 bp, Homo sapiens
tttttttttttgagacagagtctcgctctgttgcccaggctggcgtgcagtggcgcaatctcggctcactgcaacctccgcctcccggattcatgccattctcctgcctcagtcctccaagtagctgggactacaggtgcccgccaccacacccggctaattttttttgtatttttagtagagacggggtttcaccatgttagccaggatggtctcgacctcctgacctcatgatctgcccgcctcggcctcccaaagagctgggattactgacttgagccactgtgcccggccatcctggtcttatatctttctgtcatgagccctttttccaaaagattggaatgaagaaagtgctttgatgatccggggctcctctcatcctactggggtcttctcaacctgggtgcctgttcacgagtcagggctgtgtgtgcacatgctttaaagcacatgtgactgctgtcaacaaggaagacagagctaacgtgtctcaagagtcatccctttcaagatagccacccaaggaggccatttattaatattccatgctgtcagatgctcagtgagtgtattcaaaagagtgtgtgccacatctggtggtggatccatgtgagttttgagaataatgactagataagtgtcaaacttgaaagtctgaggtctcaagaagtgagaggctgggcgtggtggcttataactataattctagcactttgagaggctgaggcaggcagatcacttgagctcagaagttcaagacaaggctgggcaacataatgagatctcatctctactaaaatttaaaaaaaattagtgggttgagctaggaggattgcttgagccccggaggttgaggctgcagtgagccgtgatcgtgccactgtgcttcagcctgggcgacaatgagaccctgtctcaaaacataaataaaatgtggggccagaccccatcagtcctgcccaaaacagggtgtccataactggacctgatttaacagacaaatctgggacaggggagcctcagcagcttt

SEQ ID NO: 86456 - DNA, 1001 bp, Homo sapiens
ctttaagcatggtagacacctgctcacttctagatgtgcaatctgccattcccttctgtgtgtgactggcactatttcctctggctgcagcacactttctcttgggtagcccgtcagggactcctgcagtgtgtgattttgcttgtctttgtgttagggaggtgctcattgttcattttacctgccattgtctgtccagggctccccagtgccttagggctggcagagtgcactgcccagaagagtctgatgtagcaccattaacctgcaggccagacttgcatgggaattgggggctggagatccaagaggccggttccacaggctaactccagtgttttgagggatccgtgtgtcctcccaggcaccaggctgccactccctgccccaagtgtgagagccatcactgacttctgtctccttggcagcgataccatctgtgatctagggggtgtcaacgagctggcaaactatggggagtactcaggcgcccccagcgagcagcagacctatgactatgccaagactatcctctccctcatgacccgagagaagcacccagatggtgagatacttgcacacacacatacctgtccccacttccccaggacagcccagcaggctgcaatgggacagcttcgtctgaggagtcaccaaggctgtgtgtggtcctttgcaacttgaggctaatcattgaactttggctctcagtttctctgactgcacagagggcagggaccacatctatcagtgggaggggactgagagggcaagaggtgatgtgtgataaagcccttcaaacaagtgcaggggaggaggtggctgtggcatgctcctgctacaattgcagtaaactcagtttatccgattgcgataaactctgattgcaataaactcagtgaccctcttatattacctggcctctgtgagtctcagtgcccctttaccacctgtgttttggagctctgcataccagttcttctttccttgagccagagagg

SEQ ID NO: 86457 - DNA, 1582 bp, Homo sapiens
gaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggattggtttcctctcccagtacatggtagaccatcttccccagttcagcgcccctcaccagcttcgcccccacaaccccaatcccactgtcctgtctcttcacctgcaaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagagttgagtgagagggacggtagggaggtggcagttcggatgagaagaccgacaggctctgggcacagactggggagagcagagcggtctcctctctgggagccaggtggtagacacggccctgtcctgaggaagacagctgggtgcagggcggggactggcttggaaccagactgaaatatgccgccagcatccctcacctccttgcccctgtctgtctgacacctctgcctccagcttctcgcctgacagctcctttccgcctcagtggctgaagagctatgtccagggagcaggggttgcagaggagatggaagggccagtggggtgcgtttagggaaatggagctgtcggtggcagtgagagattgctgcggggcgcctggggtgctgccgagctgctccctgatggatgaactgtccctctctccctcccacctctagaattctggccagttttatctccggcctcttcaatttctacgaggacttgtacttcacctacctcgagatcaatccccttggtaactgggtgtgcttggctgggagggggcaagggtcccagtgcctatgacagccctggccttggcattcagagaaccagactcccacttgccagagggtaacacaagacagatgtgcacaagcagaggggtccccatgcaggtttagtgccagttcctgtttctgagctctcagaagactgtagttcttctcttagtcaactccaacctctctctttggtcttagagacagagtcttgccctgtcgcccaggctggagtacagtggcacaatctcagctcactgcaatctccgcctcctggtctcaagcaatttttctgcctcagccttccgagtagctgggattacaggtgcccgccaccacgccaggctaattttttatttttagtagagacggggtttcaccatgttggccaaggctggtctcgaactcctgacctcaggtaatctgtccacctcggcctctcaaagtgctga

SEQ ID NO: 86458 - DNA, 1094 bp, Homo sapiens
tcctcctgcctcagcctcccatgtagctggaaccacagatgtgtgccaccaagcccaaattcaattattaacttctcccagcttggtgatgaatttcaaccacgtagatgagagagttaaagtgaaacatggtttaggaagggtaagagatgcctggaataaaattatgtttcttcttattccccaggggagctggaggactaagggagggagtggagctgaggcctggcctagcctgggaagaatgtgccatccacacctggctctgtagagcacgtggctctgaagggcctggtgctcatctggggtgaaactgtaccagggatgagctgttctcttccttggctgcctcgagaatagcaatgaaggtggtgatggagatgtcttcctccctcattgggcttcctcagagtagcccttaaatgttaatttcccagtttctggccctcatgggtaaagcgggatccttgaagttgcacatggacccaggcgtgaagcgacctgtcccttgagttcccaggcctttggagagaggatggtgggattggagggagggatgctgagcatgtccccagggagcacatcctgcttccttctgctggcctctgggaggggaaggtgggacatcagacatctgagctggcagcagcgttgggccagcaggagtggctcattacctcttatggattgctgtctggtccctgactcagcagtgacgcacaggccaggcgggggttttgggacttactaggatgagggctgtctcgccacagccgccgccagggaatcactcgaactgattagctctgcaggcctgtggtcctcagccaggagagtctgcgtggagaagtttccctgattaagccctggctccccacttctccacccattccctgcgcccggacccatgtcctgaggctgagtcactgtgccttcctcaaggctcatgaagcagaatggttacctcccttctacccggtttcccctccccgtcaagctctgccacagccgtgacttgttggagccctttcacttgcgcaggtcctgtgtcaccctccagaggaggccaagagtgggcaaggtcggtgcctgtt

SEQ ID NO: 86459 - DNA, 1026 bp, Homo sapiens
cctggccctggagatgtatgagcagtggttaggggctgcttattgggcctgttgtagacagggttcaagcacagggatggggttgaccagatgacctctaaggttccttgctgcctcaaggctctgtctctctgttttcctctttggaacacatgttctggtccatattctgaggggcttactgttgaatgaagaagctaatgtatcacatagggagggtagagaatcacttattcactcagcaggtatttgctgagcgcctactctgtgccaggctccatctgggcacaaatgcctctagatacctggttgtcaaaagcaagatattggctagggtaggtggaggaagcatccaggagttgactctgaaggatggttagggctggctttggagcagagtgaatgggaagtcaatccctgctgtcctctatttggatccccaaaatactacggtttatctaattcttcctcactctaaatacaaaccgcttttgttccagaacttggtagtcaagccagaccagctgatcaaacgtcgtggaaaacttggtctcgttggggtcaacctcactctggatggggtcaagtcctggctgaagccacggctgggacaggaagccacagtgagtgggcatggggtcaggatgaacgtgtgtggtaacagaagcaaatatggtcacctccaggtcagcagctctgtggatcacccccacagccagtctcattgtagctcagggaaggcaggagtcctgtggcgctgacccactcaggtggctgccagcagtaggctcagtcttgatgcccattcccagctccctcatcatccaaacttctttgttttattggtttgggcaagatgtgctgcagaggtaacctcaatataattcaagagccaggtggaaatggtctgattctttttttttttttttttgacagggtcttgctctgtagcccaggctggagtgcagtggcgtgatcttggctcactgcaacctccgcctcctgggttcaagcgattttctagcc

SEQ ID NO: 86460 - DNA, 1145 bp, Homo sapiens
ttgcaatttcagccgtactctgcactggtcagagaacagaaaggtgtttcagtgtctgcccacctcagatgggaccagcactcagatttgggtcaaagcaccggttttcttggccttctagccagctgccttttgctccaggatgagtgtggttgtggatcagctagtttgcctagagggaatggggcagggtaaggcaagagtcccaggggaaatggcacttttgtttttctctatcttccctcacccattatctctggatcttcttcctctgctggcaaaagtgctgcttgatatctctcttccatccctcccgctgggacagcattttttccttcctcttgagaaaagctgagatctggttttattgtctgggggcaactgggagtgggtctgccctgctggggaagatagtgcctccacacgcctgcccccttctgaccagcttctctctcccagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccaggtgagccctgcctccactttgggcctttcttccaggcccggggtctgaggaagagaaagccattggtttgttggtgatgccgatagggtcatggggttggaggctgccagcagcagctgtgggaagcatgccatgggctgagcagggtttgtgttcatgctgagccctgcatgttgaggtaccccagcatggtataccctgccatgggcttgaaactggacaaactggtgtccaaatcaaagctgtgtttattaaccatgtggcctggggcaagccatttcacctcttttgagttttagattccccatctctccaatgggataatactcactttgagctgtaaagattagcaagaagcatttagcgtgcttggtgcctggcacatggtagatgctcagtaaaaagtagggatgtgccctctcctcccctaagtggagtatatcaggaatgtatcaaggcaattaggaagtgtgatgttgtactttgtgaagaatggcccc

SEQ ID NO: 86461 - DNA, 1047 bp, Homo sapiens
agaggctcacaggggctccaggcccctgtggatcatgcactcgagttggggaaactgcagacattctggaaggcccttctgaaggcaggccagcccccagcctgtccccttggtgtgtttctgggtcttttcagtgctgccttgctgagtgcttgcaggtttggattgtctttttgcattgactgaagccaaaagcagctttaggtagttcatctaaaggtagaaatgagtagatagacacaactcccaatacatgcctaagccaaagagaaatgcatttgactgactcgcagtcatgtatctcccagacacaatttgtgtggatcattctgagtcagtaagtgtagattaacctgagggtaggggtcattggaggggccagagggaaaccaagggtggcaggttcccaccagagccctgccttctgggattgatctgggtggggaaaattaatggtgtaggtgccaaacacaggggctaagctccctctaccatccacaggccttggacgatgccaacaagggtatcatcagagaactgaggaaaaccaactacgtggagaatctcaaagaaaaaagcgagggaggtgagttcctgaaactctgaaaaggcaacttcagcattctccctctgctttcttttcctctagtccgagacacatgcgacagcagctccccaatctgggggcttggcactgcccatcgtgcattctaatttcagtgccaccagcagccctagcctatctctggggcagtagagggtgaggattcagcccaccatgggctggactgtctggccccagagcgcactcatttctctcttcaattgattcatcaagtatatggtgagcacttgtcatgtacctggaaggtgttagattctggggagagaggcccatccctgccctggaggagcccatggccctttgggcaaggctgaccagtggagttgtcagctgctgggatcctgcacacaggtgctacaccgaggtggaggtgtgctgccatgagggtgcatgcaacggggcgtgggctcctctggggaggc

SEQ ID NO: 86462 - DNA, 1121 bp, Homo sapiens
gccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaatgtaggtggcaggttggggccttataagcccaccttgctgggcacagggtgctgcgggcaaaggaccatcattgtactcaaaggatggagcacgaagcagcaggaggcagagagaggctcacctcagcgggggcaggggcaagcggtgcgtcccagtggtagccttggggagttggcagcacattgggaacacgggggcttcccagagcgcctttcctcccaccacacctatccttctagccctcttctctccgacacccttttcccagcctgaatgtagaccactgtcccttgtcttggaggtgggaaaaacaaattactgtagtaacaggaaacatgtcctcttctaatgtaaccttagagggggaatcaagcccagtgttttccaacgcatttttagcagcagaatcatgttccaaaaaataataataataatcacatgaaattgtaagctgcaaaaaaattaaaact

SEQ ID NO: 86463 - DNA, 1037 bp, Homo sapiens
tttagcaaaagcccctggccttctctgctccctttctgcatgcaggagacacactgctcacggatgcagcggcatgcaccatgctgtcctgtcaagcgtggtgttcaaggtgagtagccttcccaggagctccaggcacagacttgaagctctagctgaagttcagagatggccagggacaggccttgacctagaaaggtaacttaggatttctcttcatctgagctcctgcccctttctttcaagtcttccccggctggtgccttagccatggtggaatgatgcctgagtcaggtcttggaagtttcccatgtggctgactaggcctctgatggcctggaagggactcaaatgttagatcttccctggtgcttgaagtttcagtgacctgcaggtggccttccctagagaactgggagaaacccataccaggagcttccggtcttactgaactctttctgatccagtgggctggggacacctgtgggcttggtgccctggttaatgggggatgagaggcttttgtgctccacatccctcgtacccagccaacccccaccttctgtatgagtctgaggccagcctctgctttctgcctcctcatgaaagccaacactgttcagctgcccaacctcaccacagctgtgcccggccagcagaggggagacaggaccgatggccccaagctgtgggacaaagccagtcctaatacacccagccctagggaagactgagctgggcacagaagggtaagagagactgcacacagctaggattaacatgatttatttcattatcagtcttacaggttgctgaggttgggcaaagccaggatagtaacttaaatccaaagcacttttgttgagtgacaacccgattagcaaggccctgttactgaacagagggcagtggagggcaccccaggaaccacagcacacagactagtgttagaaaccccttcccagaagcaaccggtgggacttggcccttaccagccaggggtctactccattggctcttggtgcccaccagcccct

SEQ ID NO: 86464 - DNA, 1131 bp, Homo sapiens
ctaaggatgaagacaggaaggttcccaggcaccccttgccttgggacctttagccaccgcatctctgcagggtcagggaggcatctctaactgcctagtaccaaggcttctctgcaagagcaaaggtactatatagataatgctgaggtcagaagctacccatgtataatacagtcacgtgctccctcttgcacccaaaaacagcctgagctgtttgatacccatagagtttctctctgtgtttgagtttgaagcagcccttgaagacttttccataatcagagcaaagtgatcttccttagaaaatccatagccaactaccaacccctcttttctctttcagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactgacctagacagggcagtttacttacaaagactctcacagttcctgttgcagtgtgggttcgagggagatggtagacagagataaaaccctgcctcctgacccccagacccatttgaggt

SEQ ID NO: 86465 - DNA, 1101 bp, Homo sapiens
acaattatcctgcctcagcctcccgaataactgggattacaggcacatggtaccacgcctggctaattttttgtatttttagtagggatggggtttcaccatgttggacaggctagtcccgaactcctgacctcgggtgatccattctgtcaagcttgattcctcccatcttgggccaagggcccctcctttctttcgtgctaccgaaatagaagcaaacctgtgtttagagttcccttttctgtctcatttacctgcatctctcattgatgcaggcctcccaaagtgctgcgattacaggcatgagtcaccgtgcctggccgagtagattttttttctaatctccagaagaaagcaccgtaaaagtccctggcatggttaacaaggcctctaactcccaggcagctgggctgagacctggtgaggaaaaaaccagagtcagatttgtccactgatgccagatgtcttcctgtagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccaggtagagtaggtgcggggagtgggctcagtgggaagaacccgcagggcaggccaactgccacactcagtccagaggggaccccttggagaggtccttcagctgagaataaggtgttgcagacttgtggaccctccaaattttgggaagtgccaaattccaaaattagacagaaagtagtttttctcttaaactttgttttcttgaaactttgatttccactgagttgttcttttactccccactttagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtggtgagttggctggggcagcctgggatgaatttgacagctgtagaatgttagaattttttccaaagatgctccagaggga

SEQ ID NO: 86466 - DNA, 5778 bp, Homo sapiens
tgtttggcatgtgtgtgtttggaaagcaattctgcctactgtcagttttctgaggtttacataggcaaaagctttgtcttgagaggtggtcttttgggtttcttttctctcttgcctactccagagccagaatcctgagtttgtgacagaatcctctgtttgtgacatcccagcccccccactgtagctcacggtgatgtcacaaatgaagaattatgatcctggcaggggaaacagatgaacttggaagaaacaaaagatcttctttgcctgcagctgtccctagtcatggggaggttggggggtgggaagtgaagcactgacgatccccatgattagcagaaccagctctgcataaaacggggtccttgtgaaggcaacagggtgtggctgctgacattttgactgactttttcctgccccctcattccttttccatctgggggggcaggacagttagcacaactctacctacataatgcttaagttttcatattgtccttagaactttcaggacatgccgagtgcggtggctcatggctgtaatcccagcactttgggaggccgaggtgggcggatcacctgaggtcgggagttagagaccagcctgaccaacatggagaaaccctgtctttactaaaaatacaaaaaattagccaggcctggtggcgcatgtctgtaatcccagctactcagagggcaaaggcaggagaattgcttgaacccgggaggcagaggttgcagtgagccaagatcatgccattgcactgcagcctgggcaacaagaacgaaactccatctcaaaaaaaacaaaaaacaaaaaaacagaaaactttcaggacagtaaacctgtgccactgaaggagaggcattcctgtcactgctgtgtgacactgcagaaagtcttctcagtgaaacagctggtaatgtggtagtgtttactgacttgctcatattttaaatttcagttttggaataggtgctattcatggttcaaaaactagaaagtgttgccagatgcagtggcttatgcttgtaatcccagcactttgggaggccaaggcaggaggatcacttgaggcgaggagttcgagaccaacctgggcaacttattgagaccctgtctctacagataatttaaaattttagctgagtgtggtgacgtgtgcctgcagtcccaactactcatgaggctgaggcaggagaatcactggagtctgggaagtcgaggctgcagtgagccatgattgtgccactgatactccagcctgaacagcagagcaagaccccatctcaaaaacaaaacaaacaaaagttagaaagtatgaaaaatattcagtgatgagtgtcccctcaaacttgtcctctctccgcccagttctcactcccctaagctaaccactgttcttatgtcttctattttcttccttagttttgttgtacttatataaaataaagatccttgattttctccctttatttagcgtgaaaggtagtatgctttatggcaggtctgcacctttaaaaaaaaatcactgagtagctcttggaagtctttccatattagtacatgaagagcttcttcattctattttagaactatatagtattccattatatgaatgtccatgttaactaaccagtctcctgtggatggaatttgaatttttctgcttgtaagttttcagagtttatctcttcctgacccccatggccaaattcttagagggaataggtgtcccttaactccagatttgtccttcggttcatttattctcggcgtgaatgtgattcagcaaggctctcccaggaataaatagcagctaaaccaaaactgaaagctcagaggacaaactagtaaaaagagaaaaacagaatatatggagatgctttatgaggctgaaagagtaaattaatccccacctttttgtgtgtgtgattgctccttggcttgtggtttgtatagtggcatgttgggaatagtaatctgatgtagcctatttagagccatttaaaataactattttaaggctgggtgtggtggctcacgcctgtaatcctagcacttcgggaggctgaggaggacggatcacgaggatcaagaccatcatggctaacatggtgaaaccctgtgtttactaaaaatacaaaaaaaaattagcttgggcgtggtggcgggcgcctgtagtcccagctactcgggaggctgaggcaggagaatggcgtgaacccaggaggcagaggtggcagtgagccaagatcctgccactgcactccagcctgggtgacagagtgagactccatctcaaaaaaaaaaaaaaaagtgataatattgcctatttcataaaattcttgtgaggattaaatgggttcatatatgaaagtacccagtaaatgtttactgtcctcattatcatctggagcctttgctgtcctcatttcagtgcttttatttaatgaattaggtatgtttttaaactttgatattacttagaagtggacccaaagacctcattgagttttgagtctgttacctgtgactaaactaaagtgaagatgtttctggagtccctgatgaagagccttatttgttttcttcttccctacaggttgttttctgcatggaccgtgccctagaatttgcccctgcctgccatcgcttcaaaatcctcaaggcagaatgtttagcaatgctgggtcgttatccagaagcacagtctgtggctaggtatgcagtcaggctagctggacattaaaatgccagataccattggactgatggtgtccggcagcttcaccacaggatatggtccccagagtaggccagctagggctgatcagaccctcttgggacttaaagtcaaagattagaccagctttgaaaacccgtagggtatacaggagtatagtagtatagcaggtacttgagctatatatgaaagaacagattgtgtttttgtggttttgtttgtttgtttaaggtagtccttttccttctactccactggttggcacactttctgcaaagggccagattttagcctttgcaggccacagggtctctgttgcaactaactcaactctgccattgcagtgcaaaggttgccctagataatagatgaaccaatgggtgtggctgtttgaatagtgttttatttacaaaaaccagtggcagaaaggatttggccctgtgggctgtagtttgccaaaccctgttctagtttaataaggattgtaagacacaagatgtgtattaaagataattataggtggtttatttggggaaagtttgggaacagttcttgggaatctgtctacctttggatattttgaatgctagacacatggtcaaggaggaaaactggccacaaatggtagtaatggtggggacattctaaagcacagctcaatgtgcccttttctgactattgcagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagagtaagttctagtcaccagacctaactgggaaagagcttccttttgggacctttaagatggctagagtggaaggttttagaatcacaaggaatgtgatagcttttcctcctgctttgcaaggatgcttggtctttattagaaatggtttcaggactacttgtatttacctaaaggtagatgtgatcatatagggtcggatgcctttaatatctaagagggtttttttgttttgtttttcccctcagtgaagatagatagtaatacttgtcctgagaagtgaaggcagacccagtaacataggtctcattggtatttttggtaactcttttcctgtccactctgtaggaagctcaaatgagcaacagatagcccagattgggggttggcggggctctgtgatgctgaactgctggaagcaaagaacttgaaaatagagtctggcctctctgtgcaatggtctgaggctttgtggatatgaaccgatcctccccttgcttttttctgtagaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaaggtaagctcttgatctagatcttggggcctatagaaatatttttaagggacatcaaagggtcttgggaaatctgcctagtgagggtaagcaagatgaaagagggaaagttgttatggttaatagtttgttaggaactcccttccaagaggcaagcttttgtcatctctatggaatttgagggcagttggacaatttgcaaggatattctcacctgttcattaaggtccctttcctccagtaagagaatggctagggtctgtgggataatcttaagcacctactgttgcttttttgttgttttgcttatgcaagtgatcatttattttttaggagtgatttggaggaagagtatgaggcaagcttgtttttctccagtgtaattgatggtcaccatgcatggttgaaaatggcctgagtgcttttgtggccctacccaacatcagaaacaaaaagtagactccttgcccttgcagaattctagcagttaaaaatcagagtgatttctgatccctgcaggtgacctctggaaaaaaggagggcaggaaccagccttactattttcatgttttcattgggcactaacatggaatggtaaaggtagtttatccttgaagacagatgtgcctggcttgtatcatatacaagagaaatcaattttgaagttgctgtccatagccctggtgacaaagaactagaacttaatatgacatttaaggggccagcatgactgatcctcttagagttttgaagccatgctcacagcttctgggctccctcagtcaccaaaggtgtgaagtatgattgctctctctctcctgaagcttaggaaactagatgatgcaatagaagactgcacaaatgcagtgaagcttgatgacacttacataaaagcctacttgagaagagctcagtggtaagtgcctctgatgggtagggggaagagggagttgccgctggcctcaggggaattgccttgtggatgacgaagcagacccagagatgttgtgaggtcatttggtccttccccctgcctctaggtgggattgttccagccctagactatctttatagacctccagcggaggagattgcacaagctccctcagtctcccatgcctgtgtctaacgcccctcacggtcagtaagtttcctctgatgcctgacccaaattccttttgttaaaaagtttaaatccatttcctttggagattttattttgtgttgtacacttatgctctaccctggcacagtgcttgacacataggtgctcactgaataaatgttttgttgaatgaatgtatggtgcttggaagagaaaacaactcttggagacagttgagagttgtacttcatcctgtttgttctgggcgagggaagacaatcttagagttggaagagatgtaatccggctcagcctcccaggataaaggaacttccttttgaaacaccctggatggctactctctgcttgagtgttttgagtggagggcactctgtgtctgacagggtgattatgag

SEQ ID NO: 86467 - DNA, 2067 bp, Homo sapiens
gaaaaaagagtttatgagcgttacagatagattcccttaacattgtttggagggagatgccctctaagtttttgtttatttgtttgtttgttttttgagacagggtcttcctctgtcgcccaggctggagtgcagtgatgtgctcttgggtcactgcaacctccacttcccagattcaagcaattcttatgcttcagcctcctgagtagctggaattacaggggcccaccaccacgcccagctattttttttttttttttgtattttagtagagatggggttgtgccatgttgactaggctggtcttgaactcctgacctcaagtggtctcccctcttggcctcccaaagtactgggattatgggcatgagccactgcgcccagccccctctaagttttcaaagcagggacctgttctaaactttgttttacgttcttctgcctttcctatagatatgtgtcctaaaaatgctagctattatggtaatcgagcagccaccttgatgatgcttggaaggttccgggaagctcttggagatgcacaacagtcagtgaggttggatgacagttttgtccgggtatgtatgtaatggggctgtttggggaaggctgggttgctacagttgagtttctctagccccgtatttctcaaccttgacactactgacatttgggaccagattattctttgttgtgggggactttactgtgcactgtgggttgtttagcagcatctctgacttttaatcactgagtatgagtagcaccccctctgcccagttgtaacaaccaaaaatgtctcttaacattgctaaatgtcccctggagggcacattgcccaggttgagaactactgctgtagtcattttcattttgtgttagttttgttcgtttgtttgtttttgtttttgagatggagtctagctctgtcgcccaggctggagtgcagtggcgcgatctcggcttcaggcaattctcctgcctcagcctccagagtagctgggaccacaggcatatgccaccacacccggctaatttttgtatttttagtaagagacggagttttgtcatgttggccaggctagtctcaaactcctgaccccaagtgagtgatctgcccgcctcagcttcccaaagtgctgggattacaggtgtgagtcaccgcgcctggcctctgtgttggttttgtgtgggtgtctgttgctgctgttgatttctttccacttggccaatcatgcttcttttcttccctcttggtgttcttttagggacatctacgagagggcaagtgccacctctctctggggaatgccatggcagcatgtcgcagcttccagagagccctagaactggatcataaaaatgctcaggcacaacaagaggtacgggtctgatcctgtttctgtcaaaagaggcagtatggtatatttgggaggagtggctacttgaaagtcggaactgaggtctagtctcacttctgccatcagcacacctgggtgactttaggcgagtttcatagcctctctaagcctcagcttcctaatctgtaaaatgagttttgaatatgattgacagcttttaaaaatctgtgaaaattgaagtgtttctgagatagctggggaataggcaaatgcttccagggactgatttgagtgaggttaaagaatttaagagtttgggacttagtgagaccctgtctccacaaaaaaattttttacattagccaggcctggtgccatgcacctacctgtgctcccagccactcaggaggctcaggtgggaggattgcttgtgctcaggaggttgaggctgagccgtgatcgcaccactgcactatagcccgggcaacagagcaagaacctgtctcaaaaaaataaaaaagaatttgagtaaattcaagccttgattaaattggtagcagctaaaacatgttttagttccatctccatatatagtatgtgtcgcttaatgacaggcatacattttgttaggtgattttgtcattgtgcagaatcataaagtatacttacacaaacctgggtggcatagcctgctacacacctaggc

SEQ ID NO: 86468 - DNA, 1438 bp, Homo sapiens
ttcttttttgcatgtgaacaacaggaaaagaaagatgtttctcataacaaaaatgatcaggtacttagttaatgttgcagtaatcatttcagtaaagaattatctttatcacttgagcagtggaatgattttgagtatcttgatagaggttactagttcttttaaaacactgttggtcatgtctgatttgattctaggtacttgctcgggaatctaattcccaattatataacattgttcctttaggacaaagtttaggaaagtatactttgtctaatggcacagtttcaaaaaatagatcttagaggtagggaaaaaatactgctatcacccagttgctgaatatataaggtactggagggagtacaaagagggcagcaagtacctacattgttgtgatgggaagagggaacaccagtggatgggtgctccttatagtatggcactggcatcctgtacctcatatgtccctgtcatccacggtcttagtctctgctgtcactcagctctgttcctgtcttaaacaccaacatgctatgcttttaactcttttgccacctgcctttgctctgcttgttcttccagtgacaaatgcatgagccacttttcaggaggtgaaattattaaaactcttgaggatgtgacctatttcacattgagaaataagttgccctgaatggagtaaccatttttcctgtaagtttgcaaaagaggcagcagttgtgacactgtggaaggagatagaaaaattccttgccatgagggaatgtctaaatttgtcctgcggggaggatgactacaggcagaaatagtgaggtgaggcaggaacataagaggggttttcttgatttagtttgaatgtatctaagtgacaaaaaggagcatctgaagaacttggattctttcattagcacctccttttggtccattggcctattcaacaaatctataaatccttcaagtatcacactaactttcagctcagtgtgctgcgggctctagaccaaagattcctcctgtaagattacagaggttattccctttgtaaagtaacatgattctctttctctttcattttcagggaagcagagactttcaaggaacaaggaaatgcatactatgccaagaaagattacaatgaagcttataattattatacaaaagccataggtgagaaagaactgatacttacgctagaaaacatttacttgccaaatattattaaaagtagctgccaagtcctggtggctcacgcctgtaatcccagcactttgggaggccaaagcaggaggatcactttagatcaggggtttcagaccactctggccaacatgacgaaaccccgtctctactgaaaatacaaaaattagctgggcctggtggcgggcacctgtaatcccagctacttgggaggctgaggcaggagaattgcctgaac

SEQ ID NO: 86469 - DNA, 1044 bp, Homo sapiens
ataaattttaaaatgatgaagaatctcatccctgttttaataatctgcaaatacgtgatatgtcaagcaattccagagagaacccagccatgttaatgacattttaaaaactaccacacaattaattctgcattagtgtaggctgactaaagtttctgattgatgctttaattgctaaaagttagactagttgacccaacgcagagatcttaagtgttcaacttggaagtatttagagagaaaatggaaatttttatagggcatctaatttggggcatgttgcaatgtcaactatgatgttttaatgtgtttttaatttagttgagctgtaaatgtgcaaagttggctagcaaccataagcccaagttgtctgatttaatcacatgatgctgagccctgctaagacctgtgtgataccaaatgattcccttagcagtgtttgttggagtaattagtgtcagcaatgaatgaatgctgaattgagagagataatgtaactacatgtctaaaggatatacagattttaacgaacatttattgtagaagagcaagttttcaaagctgcagttttcttactggtgggtggttttgtttttttgagacagtcttgctctgtcattcaggctagagtgcagtggtacaatcacagctcgttacagcctcaacctcccaggctcaagtgatcctcccatcttagcctcccaagtagttgggactacagacttgcaccaccatgcccagctaatttttaaatttttgtagagacagagtctccctgtgttttccaggctgttctcaaactaactcctgcactcaagcagtcttcttgtctctgtctcctaaagtgctgggattacaggcgtgagacattgcgcccagcaaggttatttctgaaaaacaaagaaatacattttaaaatagcaaaggagaccatgaatgggatgtcttctctgaaggccagggcttccagtgtgctgatcctgttgtgagagatcctccatgcatccagagaggacagatttttttggaaaacctttcagtagc

SEQ ID NO: 86470 - DNA, 1044 bp, Homo sapiens
aggtggattgcctgagctcaagagtttgagaccagcctgggcaacatagtgaaaccccatctctactaaaatacaaaaatttagctgggcatggtggtgcgtgcctgtagtcccagctaccagggaggctgaggcacaagaatcgcttgaacctgggaggtgaagattgcagtgagccgagatctcaccactgcactctggcctgggcaatagaatgagactgtctccaaaaaaaaagaaatttttttcttaaagaagaatctaaatgatatgcttttggtaagatggaatagaagttaggctcctgggctccttttactttattttgtcatgaaggtcagggagagtgcaacatgaaacaggccctgtgacatgccattggggacaagaggtctcggactgtgggaaggaggaaagaatttctactctgactggccaagatcccgtgaattctgaagggtggagggcatttctagatcaacaggcaactagtaagtttgactgaataaaataaatggagcacaacaatcatagagtaaggcgacatttggggagtagtaaatataagaggaatgcataagggatattgactcattggcagtataaagtattattattaatagcctaaaggaaaagaaaagtatctttttctttttcttttttttttttgagacaggatcttgctctgttgcccaggctggagtgcagtggcgcgatgtcagctcaccgcaagctccatctcccgggttcacaccattctcctgcctcagcctactgagtagctgggactacaggcgcctgccaccttgcctggctaatccttttttgtacttttagtagagatggggtttcaccgtgttagccaggatggtcttgatctcctgaccttgtgatctgcctgcccagcctcccaaagtgctgggattataggcgtgagccaccgtgcctggacttttttttttttttttttttttgagacggagtcttgctctgttgcccaggctggagtgcagtggtgtaaccttggctcatcacaaccaccgt

SEQ ID NO: 86471 - DNA, 4035 bp, Homo sapiens
gtgagacttagtctctataaaaacatttaaggctgggtgcggtggctcacgcctgtaattccagcaccttgggaggctgaggccagtggattgcttgaggccaggagttcgagaccaacctgggcaacgtggtgaaacccgccccccatctctgtaaaaaaaaaatacaaaaattagcagggtgtgatggtgcatacctgtaggccctgctacttgggacgctgaggtgtaagtatcacctgagctgggggaggtcgaggctgcagtgagctgcgatcacaccactgcactgcatcctgggtgacagagtgaaaccctgtctcaaaaaaaagggttggggctaaaataaaagatatattagttggcactccaaaacagatcaggattctatgcatgaagattatttctctttgctcaccaaaacaggcaaagctatttatgagccagagggttaaacttcagatgtttcacatttcaactaacttaaggctttatattttcctgggaagttgctgactgctttacctaatatgggaatacctgtcttgaattaaggatctcttgttatatctcctgggctgggaaacagcttgatctctatagggagtctttcttatggtaaacttgagggatttcaaattgttttcttttctttttgacggagtctcgctctgtcaccaggctggagtgcagtggtgtgatctcagctcactgcaaactccgcctcctgggttcaaatgattctcctgcctcagcctcccgagtagctgggactataggcgtgtgccaccacacccagctaatttttgtatttttaatagagacggagttttaccatgttggccaggatggtctcgatctcttaacctcatgatccgcccgccttgtcctcccaaagtgctgggattacaggcgtgggccactacacccaacctcaaattgtttttcaaagagaaaacacttacgtgtctcagcatatacctagtgtgactggacaacaagatctaaaagaatcaagggatccatagacttaagagtcaggacatccttacctgattccttgagctgataaacttaacttctctgtatgttttcctgatgggcacaaataagagcaattcttattaggcccttactacctaggtattgtacactctttgcgattaggattttgccttttatttctctattcagattgttaatgggaacaactgaactctcaattcatgtcccgggtttcctgtagttgctgttcgtttgctgcagctttgcatggtgtttttgagtttgtggcctcacttaactgaagagcttgtgggcatgcctccccagctttcttccttacctggttttaaattcttaggaatgtgtccttctaatcttcctcttgaagtttcagagcaagcacctagacatttcagtaagcctccaaactgagtgggaatttatctttgacctggaacccaaatcagtgagaaacactattttccttttgctgtgcactaagtgtagtcagatgtgaagaaatgggagatgggaggagaaataagttaaggaagggataaacctaggaatacagaattctcaataccggcaaattaattgaaccctgatactaacagatggcaaagtagataatcataactggagcaaaggtagagtacagagaaaggttctctcttagtgctttagttcagatccacatgttaactagtgccagagaaacaagaattttgagaaaatatagggccaagtgagtggcagttgcttagagtccagtccactcccaacaaacagaactctgattggccgaaagcccagccttattgtacattccagccaatcagggattagtttagtcattgaagtttgtattttaatggttttgaaaagctgagtactgggcacttgcttttttgttcttcgggactttagaagtttggagaacaatagtcagcagttgcctagttgctttgtggcctgatgcagagtccctctgagagcccatttctcccttactgcactagtctttggtcccctttctccagcactgagtgatgtggaagttactcagaggtctttccaggtattcttttaaacttttgaagtaagaacaaaattcaaagtgcagttatcctaacaggctattcattttattggagtgacactgtttttccttctcccattcggatcaaaatggcaattcctatgttttaccctcaccatgggtaagaatatgagtggttgaggcttttgagaatggtaataggaggaatatatgactctcaggtcttattctgagacgtgaaattctattggcatgtgacttacaatttgtgtggggaggccagattgtcagataagcagtgttaaccatctctcttgattctaatattacttttggagagagtgtgaggggcaagcaggaccctctcttgtttttggagtttctgtcctgagagttcttccttggacagtttgccctgagacagttaaccacctgttgaactaaggaaccaagacaactttgagaagtgaaataccgttgacaatccaggctcctccccactctagttcccatctccaccccaccccactccacccaaaaaaactcaggaagcagcctttatatatatatatttttgagacagagtttcattcttgttgcccaggctggagtgcaatggcgcaatcttggctcactgcagcctccgcctcccgggttcaagcaattctcctgagtcagcttcctgagtagctggaattacaggcatgcgccaccacgcccggctaattttgtatttttttttttttttgtagagacagggtttctccatgttggtcagtctggtctcgaactcccgacctcaggtgatccacccgccttggcctcccaaagtgctgggattataggcgtgagccactgcacccggcctaggaagtagcctctttctttctctctttctgtctgtctctttctttctttctttctttgtgatggagtcttgctgtgtctccaggctggagtgtgcaatggcacgatctcggctcactgcaatctccgcttcctgggttcaagctatcctcctgcctcagcctcctgagtagctgggactacagttgcatgccaccatgcccagctaattttttatatttttagtagagacgggtttcaccatgttggccaggatggtcttgatctcatcacctcaggatctgcccgcctcggcctcccaagtgctgggattacaggcgtgagccactgcgccagggcaaagcagccttttccttaattgtagttcctcagttttaaatttttgatgggtgctggtgtccctatagtgggagatgtcacagaatagggaaccgagggatggaaaatggtgggtttggggatatgttatgaaaacaagcctctggctaatgctgaaaagccagtgacttgtatcctcagaatggtttcagagaagcatgtttcccagaagtagcttcattgttgggtctcctctccccagggataagtgaaggttaggtagatgtaatagattgtgacacctctcatttaaggacctaaaataaatttccaactcaccgttgagacaagtatttccaagtgaatatgtttctgcctgcagtgatgggatttctgtagggattgaattggttgcttgctttttcttccttactgaataaggcatagccagctgcatagccaggcacagcttgctggctggtgtccgtccctgcctgaacagtagggagtgctgctgctttgtgtagacagtctgtgactcctctggtgcattttgggtcccttctgactctgcccgtgttgaggcttctccttgaatgtccacccagaggacaatttgaactggtatgttaaggaattttcttcatcttctgccttctctttattagcggagatgtgtggagggttgttccatttgtgctttaaagtgaaaactatctattctgtaggaaattgggtaaagaaagctgagtagcagatagctttgctaaaaggtagcagtt

SEQ ID NO: 86472 - DNA, 1055 bp, Homo sapiens
tcaaagtgtctcttgactttcccgggaagaagctgtggacacactccaaggtcggaaaggtagcagtggggactccttccctacagagtcttgggtcacctggtccccacgcaacccagactccacggagcctttcaggaagactctctaggattggaagttgctatggcaatgaggctcttggaatactgaaagcagccaagccctagagaggctaccaccggtacaccccgccttcccacccacgggtaaagtggcgccgcctacgcaccggcacagcccctgggctcccgccccggcgcggagaccaccgtggacatccgggggcgggaggccgctctggccccaagcggagcctctctctggtagacgagcccgagggagcccttctgggcgcggcgccgcggagctgctctatgctccaaccggaagtgctcttcaccgccggcctcccacccagctctctggtcccggcggtaagatggcggctgccgcggagtgcgatgtggtaatggcggcgaccgagccggagctgctcgacgaccaagaggcgaagaggtaaccgggtagcagggtagtagaggaggcgacctgcagctccgtggctcagggaaactcgttcctgccatgatgcagcccccagctgttgaggcgatgccccgccctccgcaaacacccccccatctgagatcaaggccggatggaccccctgaaggggcgctcttgggggtcggccttcctctcccgcttccgcctggcgtaggagctgaggcatggccttgttctccagctgagaggacgatcgtccttataggagaggccgagtctccgagggcaatttcagaggtctggtgcgaggtgggggaagcggcgcggcgtcgatgacgacttccttacatcgcccccgacccccgcgttctcttgttaacttctgtgcattgttgcctgtctgcactttccgtctccaaaacctttgctctcctcaccccgttttcccttgtaattataccccagcgatcactagtctgggttcgaagtgattgtgtgtctccata

SEQ ID NO: 86473 - DNA, 1029 bp, Homo sapiens
tagggtgtctggcctgcctggctgagctaagcctcctgggtggaagagagctcacctgggccggaggccctggatcccactgagggacctgccaccggcttcagcccccccagtccctgccttctctctctctctcctcagcttcagcacccccgtccctgactctctctctcctcagcttcagcccccgtccctgacttctctctctctctcctcagcttcagccccccatccctgacgtctctctctctcctcagcttcagtcagtgcagcggttgttcccagcacccccatcttcagccccagcatgggtgggggcagcaacagctccctgagtctggattctgcaggggccgagcctatgccaggtggatacttgacccctgacctctgaccctcattcactccttcccaaaccttttttactgatcctgagcaaccttgcctgcctccccaataggcgagaagaggacgctcccagagaacctgaccctggaggatgccaagcggctccgtgtgatgggtgacatccccatggagctggtcaatgaggtcatgctgaccatcactgaccctgctgccatgctggggcctgaggtgggcagcccgacctgctgaccagttgggggacccccaccaacctgagaccccggctcaccacccctcttctgtgcccagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgtgcgtcccccagagagcccctcccccagggcagcacacccagttcccttcctcctcggcctcttcactcctcaaaattggggatcccctgctccccacttctgaggttcatcctttgagcattcttacttctcactgccca

SEQ ID NO: 86474 - DNA, 2041 bp, Homo sapiens
cacgtatcccacttggagaatgtgtcagaggatgagataaaccgactgctggggatggtggtggatgtggagaatctcttcatgtctgttcacaaggaagaggacacagacaccaagcaggtctatttctacctcttcaaggtgagcttccactaaaggagggtgtgagtgaaggaggtggggccttgaggggttgtctgcagctctgcccccctcccctctatgcccccttcctcttctctctagctactgcggaaatgcatcctgcagatgacccggcctgtggtggaggggtccctgggcagccctccatttgagaaacctaatattgagcaggtgagataggggaattggagatagcggataggagaattggggacagcttggaggagtggggagcctgtgttctccattctcctcaagctgagaacactggggaggttcagagaaggaagggtgttttgtgctaacctcagggtgggcatggtggtagggagggggcagagcttttctatagagagcacccgagagagagaggagaaggagaaccttgtccctggccagggagcatcttcctttgtctaagaaggccctgcgggctgctcacacctcattcctggttttatcccccacccaccccttctcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccaggtaggcccagccaggggcagcttcgggggaggcttgcaggcccagcctgggttcagtggtttccgccctcacctgtctccccctcgaccccctactccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcaggtacatagcccaagctaacgctgcccccacccgaccctacgccccagtagatgttactaattgtttcccatgggggcctggacacagcctcagactccttccctgcacaactctccaagaaaccagaccttaagcttgaagtgaaaccaatttctactcctgttctggtcttttctgtaccattttcttctgttcggccacaccttttaaaatctaggccataactcccctgttcaaaaaaccctgactgactaatcctggctctctagtgccccctgccatcaggtgggaacaagagatggcaaggtggggtggagtctgagcccattttgatactgagggcagtgagggggctcagggtgacaaggtgccctgcctggccacacagcacaggatgacatcagctcagacctgtctccctgtgccacacagcgtggtgaaactgagcctgtttgatctctgtcctggatgtgtcctgtcctcttaccttcaattggaggctcccagaagacaggggctgtcccctctctcaggtccccagttccctaagagcagggtctgtctctgaccagcctccagtccctctgctgcctggcccaggctgcaccctggagaacagagttgtgggacagactgtgtcctccctacagattcctgtccatgctggaggaggagatctatggggcaaactctccaatctgggagtcaggcttcaccatgccaccctca

SEQ ID NO: 86475 - DNA, 1203 bp, Homo sapiens
ctgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaattgtcttccttgtctttctctggcagtttatcagacagtgccctctgtagttgaagttgatttaaaatgaaccactgaatcttgttaaacaaaatcttcccctctaatgtgaggggatgctggtggtcatggtaaccaagagaaagaggctcttactgttagcagctccgatgaggtagctgacctgggctgaccaagtttgaagtttcagggcccgtgttcacttctccacctcccttcccctcccccacctaccagatcatactggggtgacatgcagtgtgtatttgatgatcattagtctctgaaacaccagaaacaacctctttgggttttttttggttggtctttaccagtgagagggtctggatcctctctcttcctgaagaggaaggaatcccaacagcccctggaacgctggactggtcttaaggccaagactgtagccactggctttcctcaccacctctgtccacgtcacccccccacac

SEQ ID NO: 86476 - DNA, 1013 bp, Homo sapiens
aaaaaaaaaaaagaaaagaataaaaaaagcatgggcctaaaaggaattgcccgtcacctgtctctccctggttctctttctttggtggtaggggtatgtgtatatatggatcactagccttctacttctcttttcttgtaagttgactttttaattaaacttattgagaaagaaatacttaagtctctgctaaccctagaaactcaacttctcttcttctaatttccccagtttcttgtccttccagaaatatgcacgtgttttttaatccctttctttacattgatggcagtgtgctatacatactgtatatgataattttttaccaatccctaataatagcaaaagactgaaaacagtgctgcagtagacatccacatacttttgtgcttttgtgcaaacatgtaagtgtatttgtaggttaactttctagaagtatttcctagcctagtgattttgaagagcaagaaggcagggtggacctggggaaacccgggtaagacatctgctagtgattgtgagctgagaggtgatatacatgagcggggaaacccagatcagggcagccttaggcctgaaaactcctgtgtgtgtccagctgatctctattatgataaggtgctcgaataaggaaggtttgtatcctgggccctgggccctggcccctgccaacatttccctctcacctcctctcacctccatccaaaccaggaagcacaagcctatgcagacgacaacagtttgctgttcatggagacatcagcaaagactgcaatgaacgtgaacgaaatcttcatggcaataggtcagttgcttctcctcccctcctctctccaccacagcaagggcatatcacctgtctgctggtctagagtgggcctgcggggtcccttcaccactctttttttttttttttttttttttttttgagatggagtctcgctctatcacccaggctggagttcagtggcacgatctcgactcactgcaagctccgccccccaggttcacgc

SEQ ID NO: 86477 - DNA, 1146 bp, Homo sapiens
tgtgtacttccccagcatagctaagtgtgtgagaatgtccttaggaaacccaaggtcagtgacacccctgggctggagcaaactgaggggtggagcggtccctagctgctggtctgttctctgagtggcggaggaggaggtctgagggcgctcacccttctgtgcttggagtaggcttcccctaggctttccctctcttgcccctgctgtgttgctcttcagagagtggtcctgagatggctcagtgcatgcaggagtcccttctcctgccgttgcctgggctgggtctgcaaagcctgtgcagaccccgtcccccagacacatacataaaaatccaaactccaccccccactcaggcctgctttggctcctggcttgagggttctctgtgcccatctcagtggtgggcttctgagtgccagagcctagaagcaacagtgggattgtgtggggtggattccaactcgctcttgcccatggacgctccttctctcttacagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagtaaagatttccccttgcttcttcctttgcccttcatcttctcaaagtcccagggattgggttatcagagccctgatttcaggccgcttaaccctctgttcctgggtggggggtgggcagatttcctgtttggggacattgcatcagaatctttaggtggcaatgtcttagataatttggctgtgccagcttgagagtctctaatgggtggccctgggcagaatgccttctctgtcccttcgacattctgtccctgtctcctcaggatacatttgcacgggccaagaactgggtgaaggagctacagaggcaggccagccccaacatcgtcattgcactcgcgggtaacaaggcagacctggccagcaagagagccgtggaattccaggtggggagatgacagacttgggggaaggagtggagtaagcagctccccccggcctcgcctgggatgctcaggggctttgggaagggccatgctaggaggcaacagg

SEQ ID NO: 86478 - DNA, 1030 bp, Homo sapiens
tgggatccagaagtcaatgtgtttgctcagaaccatgagcctgaagttgggagaccattctcctctttacagctcagatggtggtagagccggtagacatctagtatagcccagtggggcctcctgacctctagtggggagggcagggaggtgaggtgaggggaagcagtcagctaggtcttcagtgaggccagagggaaagatctgtaatttaagaaggacacagcgggtgacggcctctgaactaactcagtacttctcatttctcccttacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggaggtgagtgggcatgagggagtcggggaggggcctgaaggttgccaaagaaatgctttgaccttgaggagatgggaagctgcctgcctgcattagggactaaatgcgtctgtggtggcagccccacttcctcacctgggccctggaattgagcccagcaactggtctccatgccagagtcccctcaagcatcgctagtaagcatttgctgggagtggaaagctagcttcccatcctgtttctgccccttcttgatctgtgtggccttggctgaggccctttcactgccctggcctcatggagggagagctgactctggatctttgaggccccttcttactataatgggtggtccatgtgccctggcctttcccacttccagaagaaggaacagcctggtgagtcggagctgggtgataggtgggtgtttctgaagctgactttaccctttctggagctcacagcctgttgttgattttccagtggtcagcatttaggatgtg

SEQ ID NO: 86479 - DNA, 1033 bp, Homo sapiens
gctccccaggcgtcgggccataggaggtggggagcttctttccttagcttacctgcctttggtgagccttaaggaaaccgctatgactgtcctctggcctgtccattctagttgtgggagagaggtaccctaagttccgctccccctgcttccagaatcggaggatctttgctaggtgtgaaggaacctgtccctcttctcttttagaagtgacagggagtgctgtctgtcgccgttttccttcctcctgtcccacaaaaccagttgtcccctctagccctagaggaatatctcgatttcctttgggggaggggggtcgtctgggtgagaccgttccacacgcacagaagtgtgtgtgcgctcccgcaactccttacttcctctctttcctcaagccagagaaccaaccaggacctcagctgagtttaaagtcacttactagaaatgagctgttttcctgttttgccccttctgtctcccagccctgtcctctagttatgttgttctttgagtgtctctctctttctgcctctgaagaatttagctgaggtttgctcaatcctagctacagatcacagatcagggtggatgtgcccattcattatcttctttcccctccccccttgctccaggctcagctctgtcctcccagagcacgtgagtggtttcccagccgcctcaaagggactgcttttcttgggactgctgtccgtgtgtctatagggaggagaataagacccaaaatgaggagtctggaattgaagggccatctctttcccactcccaaacacacacacatacacctccctgagcaacaggtccacaccacgccagggtctgtctgcaatcccttcagggcttggacttattactgaggactaagtcaagatcacaatggcagttctggatttttaattgtagcctgaggaattccgatacatgccagaaagtgcaggttccctcaaccatattgactgatccttgtctgttgcttggggcttaggtgtgtgaaatagctgctgtctcagaccaa

SEQ ID NO: 86480 - DNA, 1042 bp, Homo sapiens
gagggcagaggcctgggccaggacagggcccgaagaacgactcagatcccggactgtcctccgggcgcgacggaggcggcggccggggcggaacagcggcgcccgaggcaggggcgcggcgctggctctgcgcctgcgcggcggcccatggtcaggatgcccgcggcgtggttgccgctggcctgcaggaggcgctgcagccgaccctggaggcccgggggcccggacctccgcttgcccagcgtgaggatgccggccgcgtgattgcccgcgccgtgcagcagctcgtagaggcggcaagagcaagtcttttgacgacagcagtcgggcaggggctgtgcagccgccccggacgacaacagcgcgggcggcagcagcagcagcagcagcagtagcgtcacggcggcccaggagacctagggagacggagacagggcgctgggggggtcttcccacggcgcccgccaccagctcccacgcccaggacctgcccctctggctccgcgccccctccaagcctgcactcctttctggctgtcacttagttctccttgctttgcgcccttgctggtatcggcctactttccctgctcctccttcaagacccagcagagcatctcccccaggaagccttttgagaccccctgggcagagtgaatcccccttttctctggagacttaggccactgtgccaccactagggcacttgccactccacctgaaaacaggagtgtctgtctgcagcagaagttgtaaacttgggaaaaacccgggccctactgagtccccccaacttcctctccacagcagggaaacacatggaaatcaggaactagcaagactccagaatgctctctcatctgcctgcccccttgcaggagtgactgaactccgttgctttgaaccagtttcctgccctttcagagggcacagctcccttacctgtaaactgggtatactagaaataatttctactctgcaaggctgttgggaggatgacaagagatgacaggtgcaaacggagcacctgacacatagagct

SEQ ID NO: 86481 - DNA, 1054 bp, Homo sapiens
cccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgatcagctgcacagcccctgctacctggggccctatgggaccgtgctgggggcctggggcatgagctcagaagaccttgggcccgacctcactcccacttgcaccccatcaggtgccgcctgggtgatgtggtgcgagtggttggtgcctacaatcagtgtccagtcgtcaggttcatctgcaggtaggtgaccccggggagctgaagggccatccttgtgtcctgggctccactgcctctcccttcctcctcttcaggctggaccagaccctgagtgtgcgaggggaagatattggtgaagacctgttctctgaggccctgggccgggcagtggggcagtgggcgggggccaagctgctggaccatggctgtgtggagagcagcattctgggtgagcctccccaccggctcctgcctaccatccttgagctacccttcaactcctacctcccctgccaggggactgctaggaaagagataagcctcctttactactcctacaaaagtccttctctgcatctaactctcatccatcctgctgcagtctctacccattttctttcctgatctgtctcctatttaggatcaagctctaggttcctctccatttaccccactccccaccaagaaactcttttttccctatgaatctcagagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaaggtaaaggagacgaggacagggtctgactgtagaccccttcactctgcacactcccagggtg

SEQ ID NO: 86482 - DNA, 1114 bp, Homo sapiens
ccgcctgcctcggcctcccaaaatgctaggatcacaggcgtgagccaccacgcccggccggtctcactgttttgatacacttgttggtgcctcttttttgaaattagttgctatcttcagggatttagggatggcagagccttttagctaccactatcttgtttggctccagacccagtcagcagttattgaatgttatttcagtccgacagctgtttggtttcttcagtgagtaagtaatttggtacttcccagtgtcaattgttgcctaagtagtagaaaggaaggaaggaacggaaggaaagaaggaaagaaggaaagaaaggagggagggagaccatccaacccccgtcaccagttcagtagcttgaaatcaatgcaaagtctgtagcgtggttttccttgtttactggaaaagttggcattgccttcaggtcctgggtctgcaactagtgacatgaatgtctgactcgtataaattcttgtaggcaccctctgcctgaatgtctcatttccagggcttcttagaaatagcaataacttgtttcacctgtctctacctaagaaacccacagataccaaactccttgaggctggaaaggacatgtagaagagtcttggccttgtgcctcctttacacccatgaggggtaactataaataggaaattatccaagtccttatttccttcagagtacacagaaccctttccttttccttgcatttctcggagcaaatagcataagcaccaagcacatcattgagagaaaggaagaagggcagcacattgttaaaaatttttttttttaaaagaaggaaatctactgtataatccaactatttagtaaattacaaatagattaacataggcattgagtccatttctgttgggctgtttcttaaaatttgcagtgaggattaaaaacatcactttagttgaagaaaaagtaggatgtgttgaggctgtatttatacaggctcacgtgcatgtatgtatacagattatgtaatttttttcccctagggactcagtagatcttgataatccacaggagaacattaaggccacccagctcctggagggcctggtgcaggagctgcagaagaaggcagag

SEQ ID NO: 86483 - DNA, 1037 bp, Homo sapiens
aatggcttgtgcctctaatcccagcactctgggggaggctgacttgggaggatcacttgaggtgaggagtttgagaccagcctgggcaacatagtaagaccttgtctctacaaaaaaaaaaaaaaaagtttttttctttaattagccaggtgtgatggcatgtgcccacagtcctagctacttgggtggctgaggtaggagtatccctcaagcccaggagtttgaggctgcagtgaaccatgatcacaccactgcactccagcctgagtgatggagtaagaccctgtctcggatggatggatggatggatggatggatggatggatggatggatggatggatggatagaaaagtttatactggaggatattggttaaggagaaggatagcaagagctatttgtggaggattgatttttggaaagtttattaaattgagttaaaattagagatgggagaaagaagccggttttgtaagtttaaggtaacagtaagaacagtagtgagtacttacagagcacctgctcttagctagatactgttttaggtatgtacataaaactaattcattcttacagcagccccctaaggggcataagtattattattcccattgtacaaataagaaaactgaggcacagagaggcttaacaggctgtctttggcagaaccgtatttaggtgagttcagcatcatctctaaaagtttaaccccagtttagagactttggccctgggatggggggtaggatggagaatcggaattacaaaatgctttaaattatacatatgaatccagcagaccaaatctgctggattcatattattcatattatgcataatattattcatattaaccccctactcccaccccacactagaattcattcactgagttggcagatacacagtgggccttctaatgtcagacactactctccactgcagtttagctagggcaagaccttggtcacagtgttctacaagtcttcagagagagagtaatgtttttctttgttatagtttatattttactttt

SEQ ID NO: 86484 - DNA, 1067 bp, Homo sapiens
tatatatcataaaatttaccatttttaaccttttattttgagatggagtttctctgtgtcacccaggctggaggttagctcattgcaaccttcacctcctggattcaagcaattctcctgcctcagcctcctgagtagctgggattacaggtgcacgccaccatgcctggctaattttggtatttttagtagaggtggggtttcaccatgttaaccagggtggtctggaactcctgaccttaggtgaaccgccctcggcctcccaaagtgctgggattacaggcgcgagccgctgtgcccggccattttcactgttttaaagtacagttccgtggcattaagcacattcacattgttgtgtgaccgtcagcacctggtccatctccagaattttttcatcctaaactaaaatcctgtattcattaaacagtaatgagaataaaactctccatttgcccctccccgcaggctctgacaaccgccattcattctttctgtctctatgagtttgactactccaggcatcttatatcagtggaatcatacactatctgcccctttgtgtttattcctttttttgcaacataattcttttggttggagacttcacagtttttctttcctttgattgtttagtttttgctttgtacctagacctggccagtgatgcatgtgcaatgagtatgcaaagacaagttaattcagcagcttgttgcataccactagggagttattaaagctttcaaaatgtgattcctcatctgtatgcctgtggcttatctactccaagtcttgctgataaacctgcactgagagtaatagcaaagattagtctttctccatgtttcataaaacaaattgttctcattcttacagcctgattatgaactggaaaattacaggtacattgttgtaattgtttatacagacaatgagacatactctccacaggggacctcagctgcaggggaggttctgattgcgtgtcattaagaaacgacagttaagaaacttttttttttttagacggagtctcgctccattgccaggctggagtgcagtggcac

SEQ ID NO: 86485 - DNA, 1014 bp, Homo sapiens
cgtgatccgcccacctcggcctcctaaagtgctgggattacaggcttgagccactgtgcccagcgtaggctagtttttaaaaaagaattagtggaatattttatgtgccacctgggctagaagtagctttgttctaataaagctgttgccaccaaatacacctgtctgacacccgatgtcagcttgttagtgagtgctgctgttggttcccagcctaccacccgaggttgggaagagcagggggacttgttatatcaccctccatccctgctgggctacccagcaacacaagtgagtcaaatgatgggatagtgtttgtcctcatgtgcacacacacaacagtgcctaccttcaaagatgtgaaagctgattattttgtggcccattgtgggatgaatgtgtgtgtgttctgttttaagaaataacctcttgaccccaagctgaaaatgtactacttgactctttttctttccttcaggacctggtgtgaattattcagggtgtcagatcacatgggctaaattttgcaaagtaagcaatcttgttaaattctcgtgggaatgggaatgctcacctgcacggctgtcgttgagggctctggcttgaaggccctgaactcttggtccagcggccagtaggacctgcctgaaggtagacgggcctgaggatttgggtgatgcactgcacccctaggaagggaagggctgggatggcagtagacttggctttcccattactcttttctccaggaaaacatggctggcaagggcttctccttctgggtctggctggacaatatcattgaccttgtgaaaaagtacatcctggccctttggaacgaagggtaggttggacagagtgtgcacagatgtaaccaagtcccctgctctcagcaagccagtggcaggggatggatgccctgttagcaataacaacattgttcctcctccttggctccaggtacatcatgggctttatcagtaaggagcgggagcgggccatcttgagcactaa

SEQ ID NO: 86486 - DNA, 1024 bp, Homo sapiens
tcaccaaattattggccaggctggtctcgaactcctgaccatgtgatccacctgcctcggcctcccaaaatgctgggattgtaggtgtgagccatcacgctcagcctttttttttatttaatttaatttttttttaagacagggtctcactctgtcaccccagctagagtgcagtggcacaatcatagctcgctgcagcctccatctcctaggctcaagccatcctcccacctcagcctctcgagtagctggggctataggtgtgcaccaccacacccagctaatttttgtattttttgcagagatggagttttgctgtgctgcttagactggtctcgaactcctgggctcaggcaatcctcctgccttggcctcccaaagtgctgggattacaggcatgagccaccacacctggcctaagagtgtccttctcgttactgtaggcttccctgattgtgactgaggagctgcacctgatcacctttgagaccgaggtgtatcaccaaggcctcaagattgacctagaggtaagttctgcagcagaatcggtgagaggctacgtacaggggtgactcaggacaaaaacttccactgggatttttacaagagaaggtggaatgattactgtttgcttaacactgtgtttatttttgcttacttttctccaaaaaaatccttggcatcccatctggcaataaagtcttgcttgaatgcttagaagatgtgtgtatattcagctttcagcaaacttgatatgaaaatctctatttagaaattgattggccgggcgcggtggctcacgcctgtaatcccagcactttgggaggctgaggcgggtggatcacgaggtcaggagttcgagaccagcctggccaacatgacgaaaccccgtctctactaaaatacaaaaattagctgggtatggtggcggacgcctataatcccagctactcgggaggctgaggcaggagaatcacttgaacctgggaggcagaggttgcagtgagctgagattgtgccattg

SEQ ID NO: 86487 - DNA, 1082 bp, Homo sapiens
aaaaaaaaaaaaagagaaagagagataggatctcgctctgtcatctaggctagagtgcagtggcatgatcatagatcactgtagccttgaactcctgggcacaagtgatcctcttgcctcagcctcccgagtaactgcgactacaggtacatgctaccacaccccgctaatttttaaattttttatagatgtgggctctcactttgttgcccagactgttatggaactcctgggctcaagggatcctcccagcttggcctcccacagtgctgagattatagatgtgagcctgtaattatagacagcttggcctatttacctgttggaaatgaagaattatgaattttacatttcttcaagaaaaggttatgggagagttactgactttttttccttggattttttctttttaaataggttgctggtcaaattccctgagttgaattatcagcttaaaattaaagtgtgcattgacaagtaagtactcctatcttagctctgtttttcaaatgaggaatagaaaaatgagaactttgacagacatcatttgaactagagactctgtctttattcagagatcttcattttgtggacaaaagttttcaaaagccttggggtgcattgtcatttacgtgtctgaacaaagccacaaagctgggggtacagatttgatttgtggttgctattgtgacaaccagtccctcttttccttgtttagttttttacttgtacatgtcattcatgcatattatatataagactgagatcatgtgttaattaacgactgggatacgttctgcaaaatgtatcattaggcaattttgttgtgcaaatgttgtagagtatatagtccttacacaaacctgggtggcagaacctactgcacacctacgctatgtggcagagcctactggtcgtaggctgtaaacctgtacagtatgttactgtgctgaataccgtaggcaattgtaacacatctcaatgaagtaggaatttttcagctccatgataatcttatgggaccaccatcatatatgcattttgttgttgaccgaaacgtcgttatatattctttccataca

SEQ ID NO: 86488 - DNA, 1132 bp, Homo sapiens
tgtgagggccagtggcaggcaggagcctggtgtttttgaggacctgaagaaggagcagagtgagtgccaggaacttagccaccagctggtaccagccatacgagaggggcagagccagccaggatgtcggtcatgctagtaatgagtacaaacacttacatgctgcacgctattgggctcctgagtgctacgtgttcattagctcgatgaatttgtacagcaaccctgtgaggtaagcactgttctctcccctttctatagatgaggaaattaaggcacaaagaggataaataactggcaccagctacacgctaagtgatcgaagtggtggaaccaggattcaaatccatgctattctgccttaagataacaaatcttgttttttagcctaagaacagagcagtcatcaggagggttttaagtaggggtgtggcaagatcaagtttgtgtcttgaaaaggtctctctacccacagtgtggaaaatggcctggaggcaagcacacagatgttgggagacagttaacagctcttgccatggccccctatgcattttggctctgatgtttctgcctgatttttctcttgcctctgcctcttttcctgaggggatggcaggttttaccattcagctggagtacaaaccctgaaccctttttggttaaatatctacttgcttttcctacagtattattttgagttgctgtggctgtaatgtcttgagggaatcgagcttgacagtaatttatagaacaaacagtttttagagactgtgtggcccaattgccctctcaatgttggcactcctgccatgacatttaccatgctgagcatgtgaccgccatctgaataccaaatgccacaggaacctgggaggttgtcacttactcctccctttctctgagtcacctttgcccttcagtcagtcaccaagtcccatcacatgtagctctgtaatgtcacagaagatggatgtctgcctcaaaacacttacaatgctgctacctaaattgggcagccacgacctcccaccaggattattgcagcctgagggatctttttgaaatgtaaatcaaactatcacttgtctgtttaaagcttttcaaagacttaccccattgcccttggaagaaa

SEQ ID NO: 86489 - DNA, 1077 bp, Homo sapiens
aaaatggtaatatctgttagatattacaaagtcaggcaaattatgattcatggcagccactaatgacccaaaggagagaaagaataattagcagattctaacctaatgggaaaaaaactaaatgaatagggatgggggacttacattctgttagaggaaattgaggctgtcatataaaaggaataggtaaggcaaactgtaaattcctgtttacacaaatgcccttctgataaatctctgcattgcccacagtccatgattacctctcccttattttaagtaatatttaacacattaaaaatggattaccacccaaggaattgctcccgacccagaaagtgcaggtagtgttgaaggtttgaggggaagaggaatgattagagttggttgtgtctcaggaagaagccaacaggaggaaccttattttgagtcaggtaaagaaggtgggagtgaggaggcatcccggtggccaggtatgaagctgggagctgattgctgcacattactcagctgaattaaatgtgccctcacatctgtgtgtgtgcgtacatgcaaatgtacatgtgtatgagttagttggaggggtagacctttattttcctgtcctgtaactttcctttgcaaactaatctgtattcagaacagtgttgcagttaagaaccacccagcttgtccatgaaacaggttctctcaccccatctccccagttttagagaaggcaggaaagaaaaggcagtgcttttcttttttcctggccgtatgcggggcaggaagaagccagcagagcttgaaagagaaagtaaaccttctgggaaataaacggcttggcttccctattgtggaggaggagtgcaaattattagggggatgtttgggtagtttttgtagaagccatttctgaaaactgatttggattagtgaaggtaagcccaatttaggaaaaccctgcccagtctggtgtcagccacctgtttcccgctttgtttgattgatttgattagtttgtggtattctgacctctcatttttattacaagagttggaagatttgagtctgaacttgagcacctgcttcggt

SEQ ID NO: 86490 - DNA, 1049 bp, Homo sapiens
tctgtagtcccagctactcgggaggctgaggcaggagaagagcgtgaactcgggaggcggagcttgcagtgagccgatatcgcaccactgcactccagcctgggcgacagagcgagactccgtctcaaaaaaaaaaaaaataaataaataaataaataaataaaactttggagccgaagcactgatgtttaatcatagagtgcttactatgtgttaggcacaggcctgattgcctgatgctggttaatttgtacaaagtaaatcagtgcatatgccctctgccctaggggagttattaactggagtctgacattgtacaaaggtaggtatcctgactagtttgatttggtactttgggtgaaaaaagtatagtgtgcttaagtgcagaagtgttttttgaggatttttgattggatacaaaccaccactcatattttatgtctttggcacttaaaaatttcaccataacttttgagtcatttataaaaaccactgaaagagtacttgagggacatccccgaatcctgaagaacttctggtgttctggagcagcctcagtgagatccaggaggatggcattgctgggctggcccagcccttattgattatggtgtaaagaattaatatggtggttatatactctttgttagacaccttggcttacaagacgtaagcgtaaagtgtagtgcgctttagtcagtatggccacatggtcctttggtggtaaattgtttgagatgcctccagtttttaaaaggagtagcatatcgggccaggagcagtggctcatgcctataatcccagcactttggaaggccgaggcaagaggattgcttgagcccaggagttcaagaccagcctgggcaacatagtgagaccactttgtttctttaaaaaaaaaaaaaaggcaaaaacaggctgggcatggtggctgatgcctgtaatcccagcgctttgtgaggcagaggtgagcggatcacttgaggtcaggagtttgagaccagcctggccaacatggtaaaaccccgtctctactaaaaatacaaaaa

SEQ ID NO: 86491 - DNA, 1089 bp, Homo sapiens
tgcccaggctagagtgcagtggcgcaatcttggctcactgcaacctctgcctcctgggttcaagcgattctcctgcctcagcctcccaagtagctgggactacaggcgtgcgccaccacgcccagctaatttttgtatttttagtagagaccggggttttaccatattggccaggctggtcttgaactcctgaccttgtgatttgcccacctctatctcccaaagtgctgggattacaggtgtgagccaccgcgcccagtaagtatcagtgaaattctaacatatatctgaacagtaaaataccaccaataggctgaaagacttcatgggaggtaaatattcaataaacaggtgaaaaaagaaatacaaatggagcttgcttagattatttttctaattgctatgtctaacttgggaagtgaggaactgtttttggtcagcataatttaccatcagaatttagctatttactaatgaaaagaaatactaatctaggtttgttttagattaaggacagtcatgacctaaatgtcatttaaaccagagtgcattgtggcttgatcagtggtcatttctgtctctagaaagttgctttaacttctctgcctctacgtgtctcttgacattcagatatgaggtggggtagaggtggtgaccaactttccagacgcctgagtccaaaccttcttagcttatggttttcttaggtgatgtgcaaatcaacaaatatatacttttttttttttttttttgagttggagttgcactctatcacccaggctggagtgcagtggcatgatcgtggctcactgcaacctcctcctcccgggttcaagtgattctcgcacctcagcctcctgagtagctgggattacaggtgcccgccactacgcccggctaatttttgtatttttagtagagataaggtttcactatattgaccaggctggtctcaaactcctgacctcaagagatctgcccacctcagcctcccaaagtgctgggattacaggcgtgaaccaccttgcctggccaacatatatataccttttgcaactttgtcagagttgctatgaagaataagttgta

SEQ ID NO: 86492 - DNA, 1019 bp, Homo sapiens
aaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaggatctgtgtttgattgtattctctgaaggcagttacatagggttacagagggcaggtgggaaggagagagaaagagagggagggagaactgttggtataaacttgtctcacgtgcctggggtgggggaaggccagggagataacaataattgccaatttattgagcccttattctctaccaggaactgttctaagcactttggtatggaattgcttatttaatctcataacagcccctctaggcagagcctatcattatcattcccagtctagatatgaggaaacagtgacttgtctaaggtgccatagctgggaagcagtggagctgggattcaaaggcacctggatcctcaatctgtttcatggttataaccctgtgtctg

SEQ ID NO: 86493 - DNA, 1136 bp, Homo sapiens
taggatagtgccagaactttgggcttttagaaatgcgcattgtcagtagaagggagaaggatagttacaaggcagacatctttatgagagggtattgaaggcctcttctgtttgtttcctgcactagcaaaaacagattgagcagtgtgaaactcactgcctcaatattgtgtcctgggtatttaaagagttgtttgaggttcccagttcctgtctttaatctggatacattcttatcagttgagttgcccaaaataattgtcatttgatcctgatgttgactggaatggaagtgacttttcatctgacactctgtgggacagaattcaggaactgcctttgcaatttctcctttccatctttctagacagggtgtcaaaaacagttgttgacctgtcctcatggggtgttagaaatgtaaatgcaagagccgtagtggggtgtcatttgctcttagccctcgtggtaatttccaaagttatgtcattttctctttgcttcaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacgtaagtagttgtggggctgcgacttgattactgctgaactctattgctatcgtggtcagatgccttatgatgaatgttttgttttttatttgcaaaaataacattatagcactgacttcctattggcagaatgcacattttgagttgtctttctaaaggtgagaatgttttgtgccaatctttacatgcttttgctagctcccactttcagaacagtcctaagcattctccaggtaattgtttgggatgcagggagaggttaccaaactaacctgatcaaggctttcacttgctaaatagcaaggtatttaaaaaaatatattgcagtttttccatatagtaggacattttaaaaaaaataaaatttgaggtatccagctacagatatatagtatataaataagcatatactgaatattcattattttggaatattatactgggcacttggagaagctatctaaagaat

SEQ ID NO: 86494 - DNA, 1050 bp, Homo sapiens
ggattacaggagtgagtcaccatgcccggccaggaaagactatttatttatttatgagatggagttttgctcttgttgcccaggctgaagtacagtggtgtgatcttggcttactgcaacctccacctcccgggttcaagtgattctcctgcttcagcctcccaagtagctgggactacagtcatgcgccagcacgcccagctaattttgtatttttagtagagacgtggtttcaccattttggtcaggctggtctcgaactcctgacctcaagtgatccacccgcctcggcccaggagagattattttaagcaaaaaaatttccataaagaaaattgctctagtaaaatcacagtatttgctaggcaagtccaagttctctttgaactatcggcttggcaacagttctgtgggatgaattcatttaatgtctttcagagcaaacatattgagcttagcttaatatattttcttatttcatctaggccaattttgagaagattgaaaatgaactgaaggaaatcaacacaaaccaggaagctctgaagagaaacttcctggaactgaccgaattaaaatttatacttcgcaaaactcagcaattttttgatgaggtcagactattgtttcttttagtatttgagcagctgatattatactcacacaagtgggccatatttttattccagtaattattttaatttgctagtttggaagcaatgccatttttgcaccctgttttagttacagaaatgtgagattatgttccatttttcatgcagtacacaaccagccatggttttgcattttttcacattttcttcaatttttcatctcaatatgaggaaaagaaccctgaagtagttgtataaacatagttagtataaatttttacattatatttatacttataaggtaagtatatgcttaaggttaaagctgaggaagcaaacatttggttatagacaaaattataacaaaggtttaatcaccaaaccttttgtcatcaaatttttatttcattgtctatgtttgcttataaaccttcga

SEQ ID NO: 86495 - DNA, 1080 bp, Homo sapiens
cgagatcgcgccactgcactccagcctgggcgacagagcaagactctgtctcaaaaaaaaaaaaaaaaaatgtaggtgacttggttgggcatggtggctcacacctgtaatcccagtactttgggagggtgaagtgggcagatcacttgagcccaggagttcaggatcagcctgggcaacatggtgaaaccccgtctccacaaaaaatacaaaaattagacaggcatcgtggtgcacacctgtagttccagctactcgggaggctgaagtgaggggattgcttgagcccaggaggcagaggttgcagtgagcggagattaagccactttactccagcctgggggacagagcaagactgtctcaaaaaaaaaatgtaggtgacttagtccaggtgacaatgtgctgaggtgactccatggaaaggatctggagcaaggcttccagaatgctcccttctcctaactcagtctggggaggagtcttagctttcaacttggatgtggtttttctgatggcctaaagtacagtaactgtcttcttgacaggtgtctttgccaccagattgacaatattagacactttagggattgttacagtcactgttcaatgtgccttcccataaagttctttcattcctttgctcaacaagaaaacttggcaaagcttttaaatatagaggccctttttttttttttttttcccgagacaaagtctcactgtgttgcccaggctggagtgcagtggagtaatcttagctcactgcaacctccacctcccaagctcaagcaattctcctgcctcagcctcccgagtagctgggattacaggtgctcaccaccacccccagctaatttttgtattttcagtagagacagcgtttcaccatgttggccaggctggtctcgaacctctagcctcaagtgatccatccacctctgtctcccaaagtgctgggattacaggtgtgagccactgtgcctggtagagtcccattttagttagcatctgctgtgttctcagttgtactttaaatttatatatatagtttttatttttattttttattgtttttaggccggg

SEQ ID NO: 86496 - DNA, 1033 bp, Homo sapiens
ctagcagtctgtatttactaggtgatccggaggcatgctagtttgaaaactgctgggctagagaaggtctgctgaggatgtgatacattcctcactaatttaaggatttgactcagaagccatttaattaaaaggatctgctgggtcaagggaaaggggaaaaactcatatgaatttaattgcctggtcctttcaagagtcagaaggtacaaatatttatttagtttgctcacagagtcgagaattttgagactagtggtaacttctttcgccagtccctaatgacatcacgttagagggtgtgggacagtgtgattaactctaagtgtttaaggtcttttgcaataggcatcgccacttaagctgtatgtttttaatgaacctggaattccagcatgctcactgcccagacgttattgtatttttgttcactaattcactgagcatataatgagcacctacttattgtgagacacaagatgagtaagacatggtccctgtgtttaaggaatgtatcattcagtcttaagaaataccccagaacatgacgctttcatatgctcacagatgtgtgcttttctaaacatatccaagctgctacccacagatctgatgtaaacctggccttgtagtcagagctcagctaccttttagcattatttggagcttaattcttttaccttccctgtccccatttttttcccttttgatatactgtttagtttactgctgagatattgctatctcatatgaaaatgtctttcaagacctcgtaagtttaagaatgagagccagcttcctattatggttcatttttggagaaattccgaataaagactgatagatggattcccttaagggaaataattatttaaactattaattttctaatgaaaagaacttagtaaaaatgaaaataagaggaaccacttggaaaaatgatattttaaaatcataatttatggatttaggacttttattttgtgaataataagtctaaacactaaatgcctgttttgagaaggcagactct

SEQ ID NO: 86497 - DNA, 1048 bp, Homo sapiens
tcaaataatgcgaaagataggacacttgggaccctcaaatgttggaaacttaggatttttaatgagattttcttctgtgtctgaaattataatatttgcaaagggcctaaaacactaccagttttaaaccccttattttgtgtaatttggtgactataatcaataattcacagtaatgagttagcagaaatggctaaatcagaaaatgattctatatttaggcataggagttatgattggcagggtgtgtgtaaggtgaaaaataaacatattgaatagtcttatgattaaagatgattacaaatttgacttagtcatttcttatctagggcatttaaaatgacttgttaatgattatccttttctaagtcttcttgcttatgaagaactgtaagagctggagagatttctctgcatcttttaccataagcaccataacatatgagaacataaagaagactggaaaagtaatggttaatggcatgcagattccctgctttcctttccttctcagttttccatccatctgctttctttatttttttcccatctgccatttcctttggggcctaggtgaataccttaagtaatgaaatataatttttttctcgatgtagatggcagtaattgtttgttcttggtaattgacatagcttgaactggatgtgctatttatacttaattgctgtagaaacagaactgaagttcttctacttcctttttgtaaggcgtggttttcagtatctgaatggagaaaccagagggcatagcagtaatgtagaggcatattcacaatgttgttattagagaacccagatacccttaagacaagcttgtccagcccatggccttcaggcctcaggacagctttgaatgtggcccaacacaaattcgtaaactttctcaaaacattatgagatttttttggaatttttttttttagctcattagttatcattatagtgtattttatgtgtggcccaagacagttcttcttccaatgtggcccagggaagccaaaagatcagacacccctgctctaagattt

SEQ ID NO: 86498 - DNA, 1045 bp, Homo sapiens
agttcctgtcctttgtagggacatggatgaagctggaaaccatcattctcagcaaactatcacaaggacaaaaaaccaaacaccacatgttctcactcataggtggaaattgaacaatgagaacacttggacacaggaaggggaacatcacacaccggggcctgttgtggggtggggggaggggggagggagagcattaggagatatacctaatgtaaatgacgagttaatgggtgcagcacaccaacatggcacatgtatacatatgtaatgaacctgcacgttgtgcacatgtaccctagaacttaaagtataataaaaaaagatatatatataaatataaataaaaaagacttgtattaaaaccttccatcccatgacatggaatagagtttccaatctgcctcttctccccacagcttcgtggctggtgtcattaaccgggagcgcatccctacttttgagcgcatgctttggcgggtatgccggggaaatgtgttcctgcgacaggctgaaatcgagaaccccctggaggatcctgtgactgtaagacaaggagattgcatcctgtggagtaggtcttgtaaagggagcccagagcagtaacgtagcatggggccacctgaatccagtgcttccacagaggagccattatctttatctctgctctaattggagaatttgaagtacttcctcttagttaattcctgtcatatatacatatggatgtatgatgtatacatgacatatacatattttcaagtttacccgtgtagatgttattctgattggaaatttttattttcactcatttgccttttatgaaaattaactttaaagcaagacatctggttccaaatttggtaatttttttttttttgaggtggagtctcactctgttgtccaggctagagtgcagtggcgcgatctcggctcaccacaacctccgcttcctgggttcaagcgattctcctgcctcagcctcccgagtagctggggattacaggcatgtgccatgatgcctggctaattttttctgtatttt

SEQ ID NO: 86499 - DNA, 1039 bp, Homo sapiens
ccagtgaagataaatgtactgcaaaaattttgctttgcttttgtactagtattatttagaaacctaaagttagcttttctgttctaaattatcttgtgaatttcttaaattcgtgttctttacctaaaaagagagagattgaattgtgagatttctcagattgggtgggctgtgcagctgcaggtctttcatcctccatgccgtggaggagtgtggttacacttcaggtgaaccccctgcctaggggtgtagtttcacaatcttgccaaaggccatcaggttgtggaaacgttgtaatttgtagtcacattaatgaggaacttttctcaggaatattcagtcaagtttcctcttggcaacagaaaggttattttatcaacaaatccagaaatggggaccctggatatctgtaacagagcaggctgcacaaagaatgggttctagtttagcctacagaatttagggatttcagacccttgagcccaattttcttcactcctcatccccttttatccttctaaagttttgtttgttattataaaagctctacatgctgtgtatgactatgagaaaatacaggcaacctgagacaatcctggttaacacaccatacacctttttttctgatctttccttccagtccttgcatcatacttcaggtataaatttggtatttggaatggattaccttcctccctgccccataaagtccagattagcttgaattgtgagattctatatcagcattctttccagggactcagttccttgtagttattcagccccttttatctaagaatttctaagtcccagaacaggcagaaatggcttccttctcttttctctcctatactttcatcattcaggcaatataagatttaaagctgaattggtaaataagtctaaacagtgctaagaggagcatcatcttagcttcaagctcctggttgagtcaaaaaaacaaatagagaaagatttttgtgaattagagattatagggcagatgttcttgtagtgaagcttaggaaatggagtgagg

SEQ ID NO: 86500 - DNA, 1348 bp, Homo sapiens
ctggtattacaggtgtaagccactgtgcctggccttttttttgttttgtttttgttttgaggcagggtctcactctgttgcccaggctaaagtgcagtggcatgatcacagctcactgcagccttgacttcctgagctcagttgattctcccaccgcagccccatgagtaactgggactacaggcatgtgccaccatgcccgactaatttttgtattttttgtggagatgaggtttcaccatgttgctcaggctggtcttaaactcctagactcaagcaatccacctgcctcagcctcccaaagtgctgggattacaggcgtgagccactgcacctggtctaggggcagaattttttccatgccatcttactccgttaatttacaatataatttgctttactttttttttttaatcacaaaggaatttcatagctacagagaatgtcaagatagttcggatgctataattgctccgtctgcaggtcattttacgtaagtgttgacttaggctgggcatgatggctcatgcctgtaatctcagcactttgggaggccgaggtgggtggatcgcctaaggtcaggagttcgagatcagcctggccaacatggtgaaaccctgtctctagtaaaaatacaaaaattagccaggtgtggtggcaggcgcctataatcccaggtacttggaaggctgaggcagaagaatcacttgaacccaggggcagaggttgcagtgagctgagatcgtgccacttcactccagcctgggtgacagagtgaaactctgtctcaaaaaaaaaaaaaaaaaaaaagtgttgacttaatacatcggtctgacctaatcctgttttggtccttctggtacattaggattactttctgagattatttaaattagataagttaagaaacttcgatgttcttatattccaggttccgagcctcactctatccctgtcctgagacaccacaggagaggaaggaaatggcttctggagtgaataccaggattgatgatctccaaatggtatgcagaaggctggagggaatttgtttttgtgaaatactggaatacgagaccattatccttccttgaaatgctgatattctataaggtacctgtagcaaaccaggataccaaaaaaagaaatgtacatgggtaatatgtccttctgggagctgagaaagtatcagggaatgatggttaaaaatagcattagccatcctcaaacgagacaggaatgtaaagcatctagaatcgttgttgcctagcatattcaattcctctccacctcatgggtctgagattttttttttttttgagacagagtctcactctgtcacccaggc

SEQ ID NO: 86501 - DNA, 1755 bp, Homo sapiens
tgttgattctgccatgaaagattttctctgagagtcctatctgtctggcagctggggagtaagtcaccttatattgatcttaagattatggaagcctgggcacggtggctcacgcctgtaatgccagcactttgggaggccgaggcaggtggatcacttgaggtcagagtcggagaccagcctgggcaacatggtgaaaccctgtctctactaaaaatacaaaacttagctaggcatggtggtgggcacctgtaatcccagctactcaagaggctgaggcaggagaatcacttgaacctgggagatggaggttgcagtgagccaagattgagacattgctggctgacagagcaagactccatctcaaaaaaaaaaaggggggtgggtatggaaaagaatgtaatatttgtggaattgctatggtttaatgtactttgtatttttctttttttggtttcttcatagctccgtatactattatcacgttcccttttctatttgctgtgatgtttggagacttcggtcatggcattttaatgaccctttttgctgtgtggatggtactgagggagagccggatcctttcccagaagaatgagaatgaggtaatgtttaagttacatctgcattgaactgaaattttataatttcccaagcattcattatgaaaattatgatctggaagtcttttatccatgaatttatcaaaaggaagtagagaagttatgttcattttaacaccaaagacgacatgtgcaagctggaagtggtagtgtgtgcctgtagtcccagctacttggaggctgaggcaggagaatcacttgagcccaggaattcgagaccagcataggcaacatagtgagaccccatctctaaaaaaataaaaattatttaggtttggtgcaaaagttattgcggttttggctgccaaaagaaatggccaaaaccgcagtaacttttgtgccaacctaataaaaaaatagaggccacatcctgtgaaagtgactgtctcattagcattgtattttggtttttacttcaagctctctgaatcaggatggggtaaagtagtgctggagaaaggggcaggtatattctgaataacattgtcacaatgtgagctgcagtgagtacattctcattacttctttcttctggttcccagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggacgtaagttgcagaagaagctaaaattcaaagcttattcctttcatgtgcagccctgatttttaagacaagtggtaaactgacacttctttaggaagtggtgacagtgtctcctcattcatgctccacactgtgagttgctttgtgatttgttcagcaagtatccaggaactaagattagaaatgattttttttttttttggaaactaaaaccagattccccagttccctacttgattgtgtgtttgtgtgtttaatttttctttttgtcattttggatccctcagtctcagctgctagtctctcctctttatttttcccctcccattttattgaagagacaagatagctacagtaatttattttggggtcagtttctggacccttgttgtttccctctcttgttcaaaaataatgtgactttttccctgtcatggt

SEQ ID NO: 86502 - DNA, 1086 bp, Homo sapiens
tcttatggtcatccttctggaactagtctaagtcatccttctggaactagtctaaaagggctgacattttgagtcagaaaaaattttaatcttgctgcttaaaatacattttcaagtagggacttccctgtgagacatttaacaaacctttagaacacatactacctattgtcaatgtccttaacacatactcttttttctgctagtcttagcatatataagatgtgcttctgacaagatcttaatgcatttaagtcttgcgacttcttctgtgataaattctaagttaaaagttccccgtttggaaacctgcacattcatagggtcttcttaccccactggttctttagccaaacatctgttcctggagagcagcctgaaggcatcaggatgatcagtctacaagaaagtctctggatttttgaccccagagggctgaggatatgaacagtgatctggttttgttctgttctttgtccccttggttgtctgtgagtgatatatcacagtttaatttttcttttcttttttctgctgacatgtgtctctcatcccccttcctgtaactctcattcctgtgttctgaagagatcattattagtgtctggctgggagatttaacctgtctgctcctcagtttatctgctagttggagaaagcttcagaaatggccttctactttgggagccttgaaccttgaagccttcctcctatatcttataacccagccgaggttatgcaggagtcccctcctgtgcccttcgttgcattttcagtccaccttctgagggttgccaggtggaatatgtgcatgacctggaggtgtccaggctctggtggcccacaagtctgactgcacatcacagtcacctggtagactttgaatttgtttcttagggtattaaaacaaataagtggaagaagaaataaaagtggcccataatttcatggtcctgacaatcccctactgacattaaaaaaataaagcaataggtgcacttggctagagaatgcatatagtgctaactaagaagaaaaccacctgcccccactacagtcctcctcttcagggggcattgttaacag

SEQ ID NO: 86503 - DNA, 1443 bp, Homo sapiens
cactaattgggatctgtgagacttaactcatttctgcctggttttttttcccaaagagtcttttttgctttgggtttggaaaaactcaagttttttcaaatcaagttgactttaaaatctacttttggagaccctacaaaagactgtgtttgtgaactcagaagaagcaaatgccccatcagcgtctgcccacgtgcctgtggaagaattgttctaacattccagagctgtctgctgaagaaaaggagcccctactcatctttttaagctcagcattctctagccacaagtgaatgtacattaagcatttttttccttctctgaccttggaagctttttgttcctgggcagagacatggtacatttctggaagaagttgctggaattcttgggctcctgttaaaagcttatcagactagggtacaatcacaatgtcacttggccccccttcctcttagaaagtctaatcgttagggccagaaaagcttaggcccttgcagcctttacagatagagctgtacttgttgtgagaatctgttcatattaaggttttcattcaagcaggattctcaattagtgttgacccaggtgaggctggtgcctcttggcacagcagacagaactgcatatttcctctgaagcagggtaaggtggtaattgtaggttgggctggggctggggaggcggtggttggggtggaacagttgtttgattttacttagccgttcagtcagtgggttttgtttttgttgttagacatatgcttttctgaggtttgtgttactaaccatcgcccttcccacctcacagaatgtcatgttaaagcccaggcaaattctactctttctgttcatctgtgtagggaactctcaactttggtgggatcagggtgggcaacggaccgacagaggaggatgctgagattattcagcatgaccagctctccacccactcagaggacgcagacgaggtaagatcccgtggtgtgggctttctctccttccacctcgggtcagccctagtcttgtgtacctaagaggcctcactccagtcttctccttgaaaaataaaaatactaattaatattcagcctgccttctggacctcttagggcaccacagctttttccagtgggccctgccctaagctccagctgttgcccccagagcccgcagcagttttgctcctatcttgaattccagattttgcccgcagtgctctgcacgcaggtctccattactgactgctctctcacctgaggcagagcaggcctcagcatcccagctcttatgacctgaaacacaggtcactaagcacagcttcttcatccattgacccttccaaggatcgttccaattacattactgaccagctataatcactggtacttttgaagtcctacaccactgatgtgttcttgctgcagatattttgtttgagctt

SEQ ID NO: 86504 - DNA, 1038 bp, Homo sapiens
acaccagagccaggccagtggttgtctgggaaatcttcaaaggccgtgaccactcagcaagggtcagtggcacctctccccactgtctcctcaccaggtgcattcatcccatccatccatgcattcactcaccctccgtgttgtccagcactatgtatagtgctgcagaaacaagaagaatatagtgcttgccttcaaagacctcccaaagtggggagatagtctggatgacaggtgctgtaatagaagtgtgccccggatgctataggagcacagaaagagggcaactgatgaacactggggtgagagtggaagaggagaccctggaagactccctaaggaagttgtcttactctggtcaagcaggaggccctgtagagggagtggtgcagacccaccagcatatgcagcttcacaggggcaaaacacctgtaggtccatcacgtgttggggactagcaagtattcagcttggctggagcagaggcaggagtggggaactggggacaggtgagactagaggttggcagaaaccagccatagtagtttttgcctcatttggacaacaaggagccatccaagagagagcggtgaagctgatggtgacacagccatggcgcattgaaatacccccagtggctgtgttgtagggtatattgggttggggagggacaaggtcaggaggcatagactcgacatcatctgatgtgattcaggacagaatggcgagcctgaagtgaagtgtctgtaggataagttggaaaggaaggaaccaatatgagatattaaagaagtgaaagctataggtcccagtgccttaataaaggtaaggagtaagagaagattcgagattgactcccagactctccagtctgctggacatgggagatggaatagaagttgatctcggtgtggtcagaggagagcagttactgtgttgagcatggagagcctgtcgttccccaggagaaggagtacagctggctggaaataggcaaggcagagatggagagatccaccttggagtcactcctagggg

SEQ ID NO: 86505 - DNA, 1021 bp, Homo sapiens
ctcgcccttttgctcccccaaggaaaaataacaagcaaacagaggtgcttgcccagtgtctctggaggggcttcccttagaggtgggctgtgtgatcccctgccaggagggggcgatgggggccacttgttcattaacgatgttaggctcaaggtaactgaactttttttgcacatgcctctctgcagagagttgtgcataaacacactgctcggcaggacagagcaagattgggaactgagggcaaatcccttcctccgtgcgtcgaactcttgatcccaggccttaaaagtgggatctctgcactctgggctttctctagcttccccagggaagggaggctcggggtgaggtgggcacggggcatctttcctgcccaactgtgaagtcctaaaaagcttcacaaagtttctattgaatgacagctttcttcttctctttctccagggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggat

SEQ ID NO: 86506 - DNA, 1004 bp, Homo sapiens
gactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggagaagctgcctgtcactgtgcccacagcccctgcgtcgctccaggctcagccatcttgagcccctgtggacccctgaccttcgcctccctcctccagcattgctgcttttccttctatcaaaggccacagcttcagtaggcctggctgggcagttggtttgggaaattctcaccttgtcccaagtttcccaggcgccttcccactcacaggatccaagtcagctctgcagacactacctgtgggaagaggggactgggcagcccatcttcgtctcccgtttactcattgcacatccagacagcatgggggcagaggggcactgggtatctccccacgcgcctctccctcttctc

SEQ ID NO: 86507 - DNA, 1050 bp, Homo sapiens
tcgctacttcgctacttactgcactacttcgcagcatcacaactatgatggaaatccttacttacgttaaatatctggtttctaggtcacctccctgacggggacggtagggaccgtcttctcgttcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgccccgaagcttccccgcgtccgcccgaggcgcttaccccctcccggagccgctgccacccaaatcgggaggctgagcggggagcgctggccggaaggcccagctgcgccgcctccagcagctgtgtggccttgagccagccactctgcctttcagagcctcggctggcccacctgaaaaacggaaagaaga

SEQ ID NO: 86508 - DNA, 1044 bp, Homo sapiens
tgtgaaatgggtacgtggacagacctgtccagtagcctcccatgtgagaatcctcggactgagagggtactaggagggctaatacagcgcagccctgtgattccccacctctgtccctggaatgaaggaaatctgggtgttagttctggctttgccgatgcctcttgggtggcctggctgaaactaatctctcctcatcaggccagaagggaatctgtgaaatgggctttgaaacctgccttgcctttctccgcccggtcccagcgggggtccgatcggcatcaaggcttcacccactcccagagccttcgggatcagccccaccccatcagcaggacacagcccatgccactggaaatctcgcgagaatcccgcgctgaagcgaagtcgagacgtttgaccttcctccgtttccgtagttccgagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgg

SEQ ID NO: 86509 - DNA, 1039 bp, Homo sapiens
gggtgggcaggtagtatagtcccaggcacaaacacctcccttgcagccttcccaccccattgagtttgtgagcatagaacttggtgtcatggaggaactttgtgccattttgctttaatctctcagggttaaagaacccatttcccctgctgtttccacagagaggctatgatgaccttcagaccatcgtccccacttgccagcagcaggacttctccattggctcccaaaagctcagcaaagccatcgttctacaaaagagtatggctagggaaagcactggaggggatggagccaagcggggctgtgaagaggccagtgcctcctacccacccatggctcggccttggtgtggtgattgccatgggatagttggggtctggggtaaggggaacaaagtcagccttatcttcttggttgagaatacttctgtacctgtcctttttttcttgcccccaccctagccattgactacattcagtttttgcacaaggagaagaaaaagcaggaggaggaggtgtccacgttacgcaaggatgtcaccgccctaaagatcatgaaagtgtaagaggggtgctgaatggggggaaccagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggagctgctgcagcacctcagccctggcctgcatgcttttaggaactatgagcagattgtgaaggcacaccaggacaacccccatgaaggggaggaccaggtctctgaccaggtcaagttcaacgtgtttcaaggcatcatg

SEQ ID NO: 86510 - DNA, 1351 bp, Homo sapiens
tactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtac

SEQ ID NO: 86511 - DNA, 2475 bp, Homo sapiens
cagcacttttggaggctgaggtgggcggatcaccttaggtcaggagttcgagaccagcttgaccaatatgatgaaaccccgtctctactaaaaatacaaatattagccaggtgtgatggtgagcacctgtaatctcagctactcaggaggctgagacaggagtattgcttgaatccaagaggcagaggttgcagtgagccgagatcgcgccattgcactccagcctgggcaacaagaacaaaactccatctcaaaagaaaaaagaaatatgtagggtctggtggagaggatgttggaagctgagatattttctccagtgttttcaactcaccttgcatttaggctcagcagctcagccttctgttattattatgtaggcttagagccagattcagagaggctctttgttttgtgttctgattttatgtctttaaagtccaaaggggattttacgctgggagaaggtatcaagcaagactttgtgctcttcccacagtacgccgcagagctctccacccagaacgagccatggacaaccacagtgacagcgaagaggagcttgctgccttctgtcctcaggtatcttgagtgtgggagctgcttcactgtccagttttctttagctaccttttaaccatccgacagctcacatttaggccataaccaggtttgaggccttagactccccttgttcccaagacaaggagagaagtgagactttgttcctagatctcaatttttttctttatcatatcattcctgtaatcaacctaggtctcaattagagcctgatgcccagcaccgctcttccgtatctctttttaccctaccattatggaagaacttctggagctagtatgatcatcttttaaacagcccagttcacccttgggtctgtgcagtatgtgtatcctcctaccactttgaaaaattatctctggatcaattatttgccttaaagtaagtgggtaattgactcccccaagactgcttttcttcctgtgcttaagaggttatgaatgagtgttttctttgggagagcagcctaaaaggggtcaagattttttttgttgttgttactttcacatgtattgattaaaaaaaaaataaaggggagagggagttttcaacgggaagttaccatctatccctggttacattgatttgatggccttcggataactaatgctagctgattagtaaagctgtacctggtgactacacctggttcctgatggcattatctcacatttgttggtcttttcctaagctggacgattctactgttgccagggaattggccatcacagactctgagcactcagacgctgaagtctcctgtacagacaatggcacattcaatctttcaaggggccaaacacctctaacggaaggctctgaaggtgaggggagcctttgacctcagttgataatggctctgactgttgcctcttagcttccctgaacagaggggatactggtgcttgcccctctcctgttttctgagctatggatcaggcggcagagcagcctgagtgctgtggctacagccaggatggcactgctgcccttcttgaagactttagtcccttagtagcctcaggcactagcctcacaggggacatagaagagagggggaattgtgtagagatcacagccacctataagtggaggggaaaggtataccagtcccatgggtttatttcgccctgagaaagccagggtgggaaaaatctggtcatgtggggctggggcacaggagggccaggtaggtgccatgactcagacacttctgtattccaccagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagt

SEQ ID NO: 86512 - DNA, 1904 bp, Homo sapiens
gccattaggactaacacaggagcttggtgactgctcatttggtgtggttgccacttagatgaggccgttttcttgcttcaagataggaaagaaagctttcttgtgtacattctgtgtcatattaaatatgtgataggttgttgtgtttttttgggttttgtgtgtgtttctgttgacttaaaaaaccaccaccaacattgctttcagagagaatttttggctaagtcctattcaaaccaatttcttggcaggaaaggtgcagccctatggggttagccatgtaaaaggagtttgaatagaaggggacatgctccttttcttcccaaacagaatcacctttggatgcaacagtggctgcacgtccatgcttgacttacagagtctttctgtcatatctctaccctaacccttcacacccaccccagtcccctgccatgtgacagaaacttaatactctttcttgattccccagttctgcttgctgagctgtgggatactgacctttttggctgtcttgggccgctacgtccctgggcttctgctgtcctacttgatgcgtaagtatgacatatacctcccctacaaagtataccctgctcatagctttccaactatggctaactctaggtgtggggagaggactgttatatttcaattctctaggatatgacctttgcatattttcatgacctgtttagtgtcatgaaaatatccttctttagcaggctctccacatacaaagttcatttcttaccaagtcagaaattgatgagggtccactaacatatattgttggtattaccaactataaaggactgcctgtccctgtttaaggagagaatttttagagccagggtattgtcagcagaacataactcttaggggtttctctgctaggttctatttatgccagagtacttttttcccacttggagcatagttttgtaaatttagttacttcctgttggcatgtactcagcttgcttggggctggaagaactaagtacttatgcctgtggcttttgtatatcaaaacctcgcatgatttgttgtgtaatttccatttatggctcagtgacacccattgccaggttctgcccttggcctgtcagcagcatactgtgctgtgcacaaccctgcagtaggctttgtgggtggctgtagaagtccctgccctcaaagactccttcatgtgtaggggagactggtgaagatgactggcagacttgggcagatctgttccacactttgtgtccaagccctaaggaccaatagcagcgctacagttgggaatgttttttgcagccccttctccattttgtcactgtttcccatgcctcctcacagttgtcactgtcatgatgtggccccttgctgtgtaccaccgactgtgggatcgagcatatgtgcggctgaagccagctctgcagcggctagacttcagtgtccgtggctacatgatgtccaagcagagagagagacaatgtaagtgtcatggtgtcattctttccacttacgcaatttggggcgaaaaggagaagcccataggtctgacatactgggtgggtcctcaaaagtggaagtcgggggtagttggtgggggtgaggattgataggtaaaaatgatattctgttctagggaaacctgtgcaggcttgccagtttttatcatttgtaatcctaggctcccgttttaaacctatctgataaaagctctttcaagttgaataaaagctagacagtgaagataaattcctagtatttgtggtttgttttttttttttttttttttttgagacagggtctcattctgtttcccaggctggagtgcagtggcatgatcatggctcactgcacccttgacctcccaggctcaagtgatccttctactcagccccgccaaa

SEQ ID NO: 86513 - DNA, 1032 bp, Homo sapiens
tcccaggtagctgggattacaggtgcacaccaccacacccggctaatttttgtatttttggtagatacggagtttcaccatgttggccaggctggcctcaaactcccgacctcaggtgatccacctgtctcagcctcccaaagtgctgggattacaggcttgagccactgtgcctggccagaacttgcttttcaatatagcttttatgccaactttctgtgtgaccttaatcaaatatttttcaggcctcagttcctagatctgtaaaaagatatgtaattgaattaaatgctcttgagtgcatctctgtcagtttgttgccctacactagggtctaatttggtagaaagatgtttgctttcattataacaacttgttatcaaggatgaatttctccgtgaaattaatagagatatagactggaaagcagaaggagctttaagaggttatttgatttagtcctctgcctttacagcagcaaattattttctctgccccataggtagagtagttaaggtccagaaggtttaaatgatttaccctaggtgtataactagttaagtgtcagaacaaaaaaagctagacctcaagtctgtttaccacagagcccatcgtacacacgtggccttttctgaaattaggataactaggtaaatgatctttcttctgtttttcttcctctgtaggttttttgccctgacatctcttcgtcttgtgtttttacttgcatttggcttgatgatcattgtgtgtattgatcaatggaagaacaaaatctggcctgaaataaaaggtgagtttggtagcatttagaacaatctgaactgaagatggcctttcctataatttgtacctttagtattaggggtttatgaggaggtgtatggagctggggactgtcttttgaagtctgaatcatttgctttaggaggcacttgaagggcttgtgccccaattatggttccttagagctgggttctgcccttcccattgttactaagcacaggaaatctgtactcaccacctgagtta

SEQ ID NO: 86514 - DNA, 1031 bp, Homo sapiens
caaagtgctgggattacaggcgtgagccaccgcgcccggctacacatcagatttctaatgaaatctgttgagtgaatgttcctgatgatagtctttgcagggttcttgtctttgtgagccgagaagactcccaaggatgccttggtttatttacttcccctctctttacctttagtttttatctgccctaattgtatggttgagtgctttctctccactgttagcagctagctgatttcatttctggtttttttgcaagcaacaactgtcactgcatgatataggttgggttaatttttcctttgaatttaccggtgacttgggctcattaaccaggcggtcacaagtgctgtacagtaacaggctttctgtccctgtagaatgggatgctttgttttgaagtgcccttgagacaatcttaatctgtaataacaaaggaacctagaaatcatgtctttgaaaatagacatgtggtcattatttatgattatagcaaactttaatttactggtactaatagtgaggctccatggtatagttaatcacaaaagtttatgtttggttctggaatttctcacgatgtttctggacaccaattgctattccagggatattttatttagactgatcatttaattggattttagtccctgacagagtggagggacagttcacaaaaggggaaaaaaaaatcaatggatatataaaatttcactctcacaaataagaaaagaattcaaatatatgtaaatggaaattatttactaatttctatcttaagttttttttttggcgggggacaggatctcactgtcgcccaggctcgagagcagtggtgtgatcatggcttattgcaacctcaacctctgggctcaagccatcctcccacctcagcctctcaggtagtggggactacaggtgtgtgtcaccacacctggttaattgttttgtatttttcgtagaaacaaggtttcaccatgttgcccaggctggtcttgaactcctgggctccagcagtccacccaccttgg

SEQ ID NO: 86515 - DNA, 1038 bp, Homo sapiens
tttagtttctcttttattgtattgaataatgggacaaaaatgacatatcattaactgagatttttatgcattttgaggtattaggagataggagtacaaaaaaaaacccatcagaattcaggtaggtagctcttaattttcagtgttttgtatcctcagtcatattttgccgtaactgtgaatatgccctcttacatcttaaaaaaaaaaaaaaaagatggagatagatgtagataccttgtcaccatagtattccaaggttttcatacttttttttttttcaggtaccagagaatttatggtggccatatcagaggtcttccagcctagattacttctggtcactgatctgttattgtctctagcataataatagaaatgtcaggccgttccttccaatagcttgtgttttcattagtctcaacctcatctgtgaatgagtgatttgggggaagaatgtgagagtcaacaagcatgtatcctgacaggatcagaaaagaacaggtttgggtaactttttggtttgacttgtactctgagatcagaggagggtaaatgaacactggaaatgtgtgaactccaagctccctctcccacctaacatgaagagatagttcaaggaggcctacataactgctgagctctttcagttttttttttttttttttttttttgctggggaatcgggggttgttgggctggacagggtctccctctgttgcccaggctggagtgcagtggcacaatcatagctcactgcagcctctacctcctgggctccagcagtcctcttgcctcagtcttccaagtagctgggactagaggcacatgccactgggcccagcctatttgcaaaacttttgtagagacagaatctcaatatgttgcccaggctggtctcaaactcctcatctctaacagccctcccggcttggtctcctaaagtgctaggattacaggcatgacccactgcaccttgactgctttgtggtttttaacaatctgtgaatctacatagtctatgaattaggaatattg

SEQ ID NO: 86516 - DNA, 1058 bp, Homo sapiens
tttaatttttatttatttattttttttgagacggagtctcactctgtcgcccaggctggagtgcagtggcacgctctcagctcactgcaacctctgctgcccgggttcaagcgattctcctgcctcagcctcccgagtagctgggattacaggtgcttgccatcacgcctggctaatttttgtatttttagtagagacggggttttactgtgttagccagggtggtcttgatctcctgacctcgtgatccacctgcctcggcctcccaaagtgctgggattgcaggcgtgaaccgccatgcccggccctatagtttctatccaacttactgtcattagtgatgccttttattacagaaatactaatatatttgattaacgtgcttctgattaaataaaaattcccactggaattttatttaatatatagtatatataccataatacctttctaaaatctgaaatattttgaattccaaaacataactggccccaacactgttagataagggtatatggacctgtattattaccttcattgtacagatgaggaaactgaggcatagagcaattaaataagctgcccagagctacatagaagtagagttaatgggccaggcgtggtggctcacgcctgtaatcctagcactttgggaggccaaggcaggcagatcacctgaggtcaggagttcaagaccagcctagccaacatggtgaaactctgattctactaaaaatacaaaaaatagctgggcatggtggcatgcgcctataatcccagctactggggaggctgaggcaggagaatcgcttgaacccaggagacggaggttgccatgagccaagatcgcgccactgcactccagcctgggagaaagagagagactccatcgcaaaaaaaaatagagctaatgtatgaacccaggtagtctgggtgtagagtgctttcttgtaaccactgcaccgtactgcctctcaatgtagataaaagcaggtagctatgctccataaaaggacttctgggtgttataaggagaattgagggtggcttttctgagg

SEQ ID NO: 86517 - DNA, 1079 bp, Homo sapiens
cacaccctggacctgcaggggtagaggagaggccacctccactgctcctatgcccaccccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcggtgagtctcaaagtttgcaccttttttccctgaatcagtttcctgactatacctcacctctctgcatctgctggccctgcttctagcttttttgctgtgggcatagcccagccttggttccccagctttctgggccacgttattctttgaagttctttgtaacccctgttttctgcacaccccaagctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaagtcactgctccctttaaagcctttgggttctggagatgcggtggggatgcctgttctttctccatcattctgacagggtcctcacccacttccagcatcttcaattctgaaccaacagcttcccctaggtttttcctctgcctagttttggagaacgctggtggggtttgacccacctgaaattcctttccagggtaaaaaggcccagagatattactttgttctctgtctgaccctttctgggtccccgttccctcccaccctcactgtatca

SEQ ID NO: 86518 - DNA, 1128 bp, Homo sapiens
gatcgcctccaaggcacccctggagacccccacccagctactgctcagggacatacaggtacacaccagggagagccaggagagtggtggaccccaaagctttctggggttgtgaggaactcccttccccatcaaggtgaccctctccctggccccctaggaaagttgcggggacccagaggccgttgccctcatttacctgaggaacccgattctgagacacactagtggagccttgtatgccccactcctgcccctgccctatggagtcagcgccccaggtgagtggtcccatggcccaagtcccctggatgggatggggtggttcagaggtaagaatctgaatcccttaactggcagggatctaagcatccttcatggacctgccagctcctcacttttcgaaggatgaaggtgaaactggaagctggccagggtggaggagaggaagccagcacacacaaaagggccccctttggccaccttctctatgggtctcattctgactactgatgttccttcaggagtttgtacactcccctattttttcattatcctcttgagactatgccatattacctttacaagtggtagaaaagctaccacttttgtagaatgtgctggcctcatccaactgtacttctccctaaacggtgtagtgactggcccaggtcctaaagttagaggattaaagggtgctgggagaggaaccccggttttctgactcctagtccagcctgttttctgacctatggtggtgagcctcagtatggagttacagaatctggggtgtgaatctacagcccttcccggccgtccgtctccctaagtccaaatgcaggcttagtgggattgggaaggggattcctgggaggcagaggttgagagtctggctccgtgggaccactgctttcccttcactcttcctgtcgttcgtaccctcccctccctgccaccccatccccttatattccctctgaccttcccctggttcatgccttcctcccagggcgcagctctgtgtcccctctccaaaccgtccctccgcccccaccctcccacaggtccgggctatgcacccctgcgcgaggaggcggtgcggctgttcttggcgctgcaggcgctgga

SEQ ID NO: 86519 - DNA, 1021 bp, Homo sapiens
ggcctggactgaggcctttacattctggagaggggagaggagtgaagggggcagggcaggaggccccagggtactgggaaaaggtgggagtggctagaggcagtgaggaggcgaatctgagggactaagtattcttggagaagggggaagcctgggagtcctggtattctccagttccagaaggcccctggagatttggttactcgtttataactgtgcagactctgtggcagttgctgggtcatggataatgaagagacattcagagaggtctccactgggtgtgagaagtgtaatcacgggggcacacaggctgctactgggacacagtggggctgctgcttccccactcagaacattcttctaccctagttgctgcttccctccacccacaccatcatccattcttgtccagggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggtaagtgggggccaacctgaccagacctctgtttctgggtgggaaggctccatctaagtccacccagatggggccacatggagaattttggagggatcaagccctcttcccctctggggcctcagggagtggaaggtcattgccatctacactttggttgtagtcccctttcttcctttatgtctggctccccctcagcatgtccctgggggagggtctttggggtctcccctggggaggatctcacaggggtggttgctccaggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtacccagaagcccctaaca

SEQ ID NO: 86520 - DNA, 1034 bp, Homo sapiens
tagcctgtctcatcatcctttgtgccattgtgcatctagtgcctttgccatcctgcagccttggggatcaggggcagggaaaggatgctgacagtcagagggtagtcttgggaggtcagcttagtgatcagtgctactcacagcctaaaagtatggcaacccatccttcatcatggtagtaggggaagtctggagaggagaaagcaccagttaggagatgcctcctccatgttaagaatcattcccttccgtgtcatccctcccttctgtcctctgtgtcctgggaatgtacctgggggcagataccagggatcaagctcaggtggcacctctgaaacaagacgtggcatagctccgcaattagattcggacagttctccctgaactcgaagggcctcagctagctcagcagtcatgggtcgaggggttcggaagtgggtcttgaggggagccacgttgttgaatcgaacaccagacaggcagcctgagaaacctggggtgttgtagcgctggatctccgggtcaatgactcctgtctctgagagagaggcaggcccagaaagagggacttggacccaaaggccctgccactctcactgtccacaggtttcccactcatccttcccactgccctcagccattcccagggccttcactttccttgaggatccaggaacatatgccacagctccttgcctaaaacgcgtccgcacccgcagcttacccatcacacgccctaaatacaaggccttgggtgagtccaactggctgtccaccaacagcgagaacttctgctctgtcagtgggaagtagtccacctgaggtggggagggggagggggagggcgatgagggagcggggaccagaagcagatgcctgtgggctggactggaactgtgtggaccctgggaatatacttgggggcagatactggagatctctcattctgtccaaactggcggtgccagctgggtgagtcctagctcaatctgaagtgggcaacccctgggcctagatgtaggatttggtatata

SEQ ID NO: 86521 - DNA, 1388 bp, Homo sapiens
tgtgtcccttgttctgatatctggtgccttgcctcagaagtgggaccattgtaaacagcccttaaggagtgggaggggaagtgaaacgggaggggactccgccttttcaatcacaaaagtcatgagagtaacctggttcctcttccctgctctgggacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggta

SEQ ID NO: 86522 - DNA, 2090 bp, Homo sapiens
actcagaaggctgaggtaggagaatcgcttgaacctgggaggtggaggttgcagcaagccgagatcgcaccactgcactccagcctgggacagagtgagattccatctccaaaaagagaaagaaaagtggttccttgaactggccagacaaaaaggagctgcgaggtgtatgcacctttggtgatgtctatgtttacctcacacattgcagtgaattcctatagactaaggcccaggagggctccatggataaaggaagagatatcctatttccgttcgtcaccacctcccattttcttttctctcccaagcagaaaagaatgggttagacctttttctgctttcagatcctcttaacagttgctggttctttccaccccacccccaccacacatgtgcacatccagcacacaccccctactcatgcacaccctgtagtctgagacttggccccctcttccccagcacctgctgctggccccctctgatgtggccggatggggcaccttcataaaggagtctgtgcagaagaacgaattcatttctgaatactgtggtgaggtgagtgctatagttttggcccacattcttactcgggggagactgatgagaaactctgattttctgtgggccaggcttctttgaattaatctctaaataactcagctgtgttctcacgtggcctcttggggagatcccacagaaccgtttgcagtactgaaaccactgttcaactctttggcaactccagacacaagagatgaggggggctcttttcagccttaaaactggttggcctgggtgggaattggaacagcataacttgaacttgctctcttgtgattctcatcatgatgctcagtaagcacccatgtgagataccacccagccctttctgggggcagggtaccatgccctgagcaggcagcctgatactcctatttgttatttgtctatctctctagctcatctctcaggatgaggctgatcgacgcggaaaggtctatgacaaatacatgtccagcttcctcttcaacctcaataatggtatgaagtcactttgtctcatcccaaggtggtcttttttttttttctttttttgagacggagtcttgctctgttgcccaggctagggtgcaatggtgcgatcttggctcactgtagcctctaccctctgcctcccgggttcaagtgattctcctgcctcagcctcccgagtagctgggactacaagcacctgccaccatgcccggctaatatttttgtatttttagtagagactgggtttcaccatgttggccaggctggtatcgaactcctggcctcaagtgatccacccgcctcggcctcccaaagtgctaggattacaggagtaagccaccgcacttggccccaaggtgatctttctaccagattgcccttgctgtagtccaagtttagatcagctccgaatcttccagcagatgcatagagcaagggggcaggatcacacttggggatcccacaggccacagtgcccttgctttggaagaacctccatttctgggttctgtttgtaataggagtgctgagcgtctttacctgagaaatctccctgcccagtagatgagaagatccataattcaaagagggacccaaagggagtgctcccacacaaggctgaattctgaggctgcatgctttcctctgctcctgttagcacactgggcttcaacattcccatcagactaaagtgtttctgttaccatttaactgattttaaattcaagctgagaagctgtggaattgcctgctgtgcttatggttttccttgatttactttatacagattttgtagtggatgctactcggaaaggaaacaaaattcgatttgcaaatcattcagtgaatcccaactgttatgccaaaggtgagtcccagtaacctgggaggtggggtgggggatggatgcctctttactgtgatttccattcgttgttgaacattttccttagctgagctattttttgtccaaagataatcatgattaatatctggtatcattttaggcccctctcaatcttagttttctaatctgcttttttcagcga

SEQ ID NO: 86523 - DNA, 2217 bp, Homo sapiens
caggttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgtatcctccctcaggctcttccacagcccatacacatgcacttctgcgctttcacacatgcccagacgcccccccgcgccagcccccttttacccatggtaggcagattcccacccaaactggacttaaagagtgaaaatgtgtagctgacattttcccctggcaaatgcagtaccataccctcttgttcttggcagtgatgactgctcggatgtcattaaggtcttagaatttctgccctgaagccaagttccaagttttttaacctaaacccttttgactatttgtatcttccatccttttctgtgtgaggcccagacttgggtaactacctttaattattttctctgcccccctcctgccaggaagtaagggtcatttgtttttgctgcctgattcatccctaaaatatctgtggagaaaggctgaaggaaggcaacagacagagggtgaggaatgacagtacctttcattttctaaagcttctttctttcttttttttttttttttttggagacagggtcttcctctcttgctcaggctggaatgcagtggcacaatcacataaagctccttttaattggaagagtttctctttaccttcctcctttgaatatccaggaaatgccaattcatatcatgttgggaaattgcacacatatgtgtgtgggagaggaaggggcaggtgtttctcaacatgggactggctctgaaaatttttatcctacccaactcatgtgtatgccgttcccttaaccttaaaccaggaaagcttcctgtggagtcgatccagattgtattagaggaactgaggaagaaaggtgggttcagttccccagattccttatttttcttcctagttgggttttcctgagggcaaattaggataagtctttttccctttaataactttttctctctcctggcttgaaggccagagtcttctgtaaagtaggcagcccaattcccaagtcctttcttctttgtacacaaaattgaaatctctgtctgtgccctaaacctgaagagaagtggaagaaggatgagtgccttgtagataataatagtaaaataaatattgaatctttctttctgaaagctgagtctcttccactctgtcccaccttggtatttttttgcctctttgtttctttttagttcatgatactttttttttgggtggggagataaggtctcactctgtcatccaggctggagtgcagtggctcagtcctatctcactgcagcctcgactcccaggctcaagtgatcctcccatctcagcctcctgagtagttgagacctcaggcatgtgtcaccacacacctggctaattttttgtattttctatagagagaatttttttgtattttctgtagggtctcatcatgttgcccaggctagtttcgaactcctgggctcaagcagtcctcccgccttggcctcccaaagtgtaagccactgcgcgcctggttatgctttcataagtatctgttttacagggaacctcgagtggttggataagagcaagtccagcttcctgatcatgtggcggaggccagaagaatgggggaaactcatctatcagtgggtgagatcattattctgccaagtattcaacagtgacccatggaaaaggttaactatattagggcctagcagatagccggtgttcccagatccagactgagcaaaatggggagggggcagaaagaggaagtgtaggccttctagggaaacctctttaagtgactcaatgtctttggctgcatagaacctccctttctttgcctgtaggaggccgggggctatgtgaggccatatttggagaatgcagaactgggaaccctgagtgctattgttggctggagcctctggccacaggagataaatggggaaaggaagggaaaaaacctggggcccctcccccactgcactgttatgggactgtccacaacatgaatgagatattctgaatcagtgtgggtgtggggacagaatactcttccccctaaaccaccagtcccaaacattcccaaggaagagaagagggtaagaagcatcaaca

SEQ ID NO: 86524 - DNA, 1626 bp, Homo sapiens
tactggctatattctttgtgttaggatagatcctctagggtcagtgtctagtgacaatggctccgatctccctaggcctgattttcacggcccctttgtggccctgaagcagatggtgtcattctcgtgcatcagacacaaatgctaggtgtgggggaggctgagtctgagaggagaaccaagaagggggaaataagcacaaactcatttcatgctgattcaggctttcttccaccccttactcctaaggagtgcctgggaagtgtggatggcagctgtagcagtatagatggcttatgcataccctgcctctgggaggtctcggcttccagccagagcactctcctcagaggccttgggcctcaggagctgattgtctctgcctatctctccctgttcagagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactcccactgcctgcctcttaaattactacagtactggaatggggatggggagggctgtgaagtgttgccacctgagtaaatcccagcctgggagaggggagagaaaagaaagcttatggcttttgtagaagaaaaggtcctccagggccctgtgggctccagtgagcctgtggttttacatctgctgggtgggctgtgtggaggagtgctgatggaacacagcttggggacagactgctttctctctgaattggagtcacttaagggctcccccttccctcaccatctccctcatggaagtcctgaactactctgaagcccctccctccacccatctggtctgggtggggtaactgtggccaaggggagctgaggggggtaagccggatgtggactttggtttattggagactggcaaacagaaggggaggaaggagagcccatatagcaaaaacagccactctggccagggttaggctgcggccaaggtggcctggaggggatggatgaccgggctctcggtttgggggagggacttatcctggggagtacacacccattccctatgcagaccagagggacaacaac

SEQ ID NO: 86525 - DNA, 1096 bp, Homo sapiens
tgaagggctttcctggccaccaggagcaacgggagggggaaggggcaggctagggaggggactaggaggggctggaggagactgggaaaggagcccaggtgagggggacagcagggactgggccacagtcatcacagccagtgagaaggcactagccagagaaaggagaggggctgctgtggtggaggggaaggaagaagtggaggggcacggaggaaagaaaggggaactaagagtgacctgagaacaagtgggagagaacgtaggtggagaagtcgtggggagagaactccagggacactgagagagtgggaccggaaactcgggtgtgctggaggagaatggaagtggagagctggtggggtgtggagagggatttgaggagacctgggaagaaatgggggagaatggggaggggctgggatgacatgggggagaagtgatggggaagatgggacctggggaaatgggggttccaggggaaaatgggtttccaggagacaaaggagttccaggagaagatgaggaggtggagaaggctgtccagctcctgtgctccagggaggtgctgctctggagctcttctgggaaggagggtatgttgagaccacagtcccacatgccctatgcccttcccaggagcaaccccaggggttgggatgagcaaggacacaactcagtacataccattggatgggtctgggagggggacgggcagggcaggtaatggtgctggctcctcctgaggcagaaaaaggagtccgcagtcacagtggggaagagcagtctgagatggaaggtgtcagaccggggttcctaagctaggacccatgaacctataggagtctgtacatgagtttcaagggattcagaagcatatgtgctgaaatgtatagaggtaaaagggcatgatgtctgcaacttactcttaagtggttccgaaaaatatattatgtatgcacacatacagaggggagaggaagagacaatgatgacgctaaggtggcaaaacactaacaagtggcaaatctgggcaaagggtatccagtggttctttatataattcttgcaacttctctccacaagtctgaaatta

SEQ ID NO: 86526 - DNA, 1025 bp, Homo sapiens
ttcctcattaactgatggcaggaagccagagggctgggcagcttccacccctgcctcccattgtgaaaagaaagtcccttttaaatcctcccctgcctcaccccacaagtctttgctcccccaattcctaaggcatggcatatggattcacggcgttcttgtttccagcatttttattggttgctgctaatgtggtgtgagcatatcccctacactctcccagctgggagtgggcccctctagaagcatccaggcttgggtgggattgcttagtggttgactcttggcaggggaggtgctagagatgaagatggtaggcagcagaactaacacctccacacagcaaacagttcacatatgtttggctcttcactataatggagctgcactctccatgcccccctggccttctaccccttcagtgttgggatcttccttgctcagttttgttgatcagaaagcatcagattctgagaacacaagctccatggtgggccctggtgtgggggagatacatggcttctgttctgaattcactggagggaaaagaaaaagtgatgaagaaacctccaaggtgggaggaaggcgaagctgcagccaggtaccattccctgggctctccctcccttgggcccgccctcaccatcctgccaacatccccggcgaatgtcacccccttgcttgcccgctgctcctgggagccggtgctgctgccactcagagagttccttcgcatgatgcctgggagcaggatgggggaaggagagcactaagtgaggaaaggggaggtggggagagggggtctattcccccggggcagacccccagggcctggagaaaaacagtcgacagaaaggggtctcagggaaaagatggaagctgggtgactgcagtctcaccagggcctgggggctcagagcgctgtaggctgttgcggcgggaggtggggaagctgcccttggagaggcggcgctggcggctggacagcatagcagctggggccacaatacccggtgggggctgct

SEQ ID NO: 86527 - DNA, 1149 bp, Homo sapiens
ggaacatcgtgaccggcctaggcatcggggccctggtgttggctatttgtatccgtccgtgttgtagactcaaggggaccgcatataggggcaggggaacagagtgtgcaagagggctgaaccacccgtttaattttggggtaaaatgggtagtactttcctttgttattcctaaggtactcttttaatttgatttattaataataacggaattggggttcagggtttagaaacagcagcggcgggaagccggaatcactgatttgggagagtaacaagagtggtagagcaaatctaggaaaggggaatgtgcatattctgtgtggtttcctgaacctacctccccagatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggagtcaagtgagtatggaggctgagaggcagcatatggcacttcatgctggaaagcttcacaagcagtagctgcagtggtggcattgccccagggagctgtaaatgtttaactagaattactttttccatgagatctttccacctgatttaagggagagatcactgggcagtttgagactgaacccacgtcttaggggaaggaaggtcactcttctgtcctctacccacaagaacatactgtaactctactgcttttcccatccccaga

SEQ ID NO: 86528 - DNA, 1061 bp, Homo sapiens
caaggtcttgctgtgttgaccaggctggtcttgaactcctgggctcaaacagttctcctgccttggcctcccaaaatcctgggattacaggcatgagccaccgtgcccagcctggagtttaacataatagcaggttatcgttataaagggaaatgaacaagccgaacttgggcctccatttccagttttataaaaggaaaacaaggaaacatttcagccctatcctagatttttccctctcaaatcttgcacacccatcctaatcctgggtcttggcacttctgtaggttgtcctctgttttcctttaactgatgggtgaaatgctttctgttaaatgaattctcaccatgctggtcctgctcagtggtgcatacctggctccaacactcatggttttggatgaaagcacttgctgcaatgattcctactgccaacagcatgaagtcttccttcactgaagtaaacttttccctgagtgattaaaaccacattaattttaaagctagaatggaacttgatcttccaaatcatagggtcatggaacttcaactatgaattatttgtgtcgatcatcttggattttttagacatggaaggaaatggtcaagtaatagctcattgacctgctctcccattctcccccaacttaactgggattaacatgagccttatgtcttgaatggtttataggccttttttagttctatctgtttccctaacaattgtaactgtgaggcttttaaccagtctgactttacagtaatcaaacactcttgtccaagttgcaaccttgtgactgttttttttttcttttttctttttctgagacggagtctctctctgttgcccaggctggagtgcagtggcgccatctcagctcactgcaagctccgcctcctgggttcacgccattctcctgcctcagcctcccaagtagctgggactacaggtgcccgccaccacgcccggctaattttttgtatttttagtggaaacgtggtttcacgctgttagccaggatggtctcgatctcctgacctcgtgatctgcccgcctcagc

SEQ ID NO: 86529 - DNA, 1078 bp, Homo sapiens
ggggttttcttggcatagagctcaagcctcctctccagtttcaagaaggtttttccctgaagcccttggaaatacacaggaatgcttcttttgatttttctaggatcccattgatggatggaaactctagtttttacttagagtaaggctgcttctatcaccccaaaacaaagcatttcttttcttctgcctcctttctcccccgccaagttcagggatgcctaggaaaacagcaagaagtactgtaaccctcactcacccctactccaggcttctcttctctttgggtgtgtgtcctgtccctgtactctgcaatgacaatgaggctcttgtgacagtcttcttgatttttggctttcaagcaaatccaaaatacactatcattcctcaccaagtgttctttaatagataaaatgacgtgaatggtcccatgatcaagtccctgccccgaacttacttaactcagatctcagttactaatgagttttgctctgtccatctgcaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgttt

SEQ ID NO: 86530 - DNA, 1997 bp, Homo sapiens
ccattttttaagtctctgtggtttatcaagtcttgtggttatcaagactaaagccatatagttctgaggctgtttgggagatgaactctacctctaagctgccagagttgtaatgccctcttatttctttcccaggagccatttattgaaactcctcgccaggatggtgtctctcgcagattcatccccccagccaggtgcctactacttctcagcccccattccttgccaaaggctagtagaattttaattaaatccaggaatcgagacctggagccaggtgatagagatgcatcatcacctagccttttggccctttcagaaaagatgtattcccttatacctggcccgtcaccttccagtatggattttttcctgtagctgttcacagagtgggaaaggatagtagctttaatgatgaagtattgaaaaaaattgagggagtgattgaccaatcaccaagagatgggctcttgagaagtttcaaactagcaaatgttgttagatgttcaggtccttagttctcattgctgcaggtaaagagcttgctggcaaggggtataatattttctaaaatggcctttcctggttctcccttcttttccactgtagacatatgaattttttatgctccctctccctccttagtccaccaaggccaaccttcatgctgagtgtccctgtggaagaccagcatggccttcctttgggagagaggtacccttgggaggtcagtcgggctaggagtgggtatgttccttgaggcccctcagctggtgcttgagagtctctgccactggcattgtagtaggtggaggaagcctctctgttccctcatgtggcccgtgggcggggggctgtctgcaggatgatgtccacagaaagtgccaacagcttcactctgattggggaggcatctgatggcggcaccatggagaacctcagccgaagactgaaggcaagtcggccccattccggtggcaagcagtaggcctggctgggagagtgggtaattgagcaggaagcatgggggaggccctaccctgactctcccacacttccaggtcactggggacctttttgacatcatgtcgggccagacagatgtggatcacccactctgtgaggaatgcacagatactcttttagaccagctggacactcagctcaacgtcactgaaaatgagtgtcagaactacaagtgagtgtctccagagccagggctcagagctgttactgctctgagactgcttggcccttacccaagagccgtactccactcaggcaaatggagctctagtaagtatagtctgcctgtgtctttggcagacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtgagtgctcaccctgttctatcttctcacactcgaggctccaggagaggaaatggcttccagctgaatgtgtctgaatagtttgtaaactagtcagctgtcagtcagcagcatgcctgccccagatcctgcatattgcttccatgccctttttctagaggtttgttgggagagttacctatgaagagtcagcatgattaagtgaaaaaagtatgttggttaaatagtgcagaaaccagagctccagtcttggctctgtcctgtagggaatgggctcatttggatgaatcagccactttctagccatccttagctgaaaagatgagctaattagcctacatttgttccctccaagcttaaacatttcatgggggccaggtatggtcgttcatatctgtaattccagcactttgggaggccaaggcagaaggatcacttaaagccaggatttaaggccatctggggcaatatca

SEQ ID NO: 86531 - DNA, 1566 bp, Homo sapiens
ctcccggggtcggcttcgcgggagaggaaaatataggatggctttctgtaccgcgtctgatgatggagagtcccggggacacctccgcggacacgtgttggactcagggctttaggcccgtgacagctggtaatcccccagcccaacaacgtccctggacactgcccctgcccttggcggctggcctgcctagtatcatagactaggtctgggtgggggttggcacgtttgtgagctcacatcttccctaactacctgtcttttgtctgcttatcaaattcagacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggtgagggaaagacagttggattgggattctccatcctgctcttacctctgtccccaggtactgaattgctctctttgttaattttaggttgattctttcagggagcggatcacaagtgaggtgagtgaaataaatagaaaaatggttgttggttgagaatttcccaaagaggagatacctggagagagagagagagagagagagagagagagaccttcccacagatattaattcagctgtattttccctcttccttaggcagaagacttggtggcaaattttttcccaaagaagttattagaacttgatagttttctgaaggtgagagaccctattctttcctcaaattccccaatttttttggccctggtattactgtcaactgggataaactgttgattcttcttctttttatttttttaaactgtaaaagcactttcatttcttgctcttcaaatcaaatacttctttgttcagcttgaaaagattaatgttttggggtgggtgtctttcaggaaccaatcttaaacatccatgacctaactcagatccactctgacatgaatctcccagtccctgaccccattcttctcaccaatagccatgatggactggatggtgtaagtgtcctatatttatctttgtgttcttgagcagtaggtcctctgtcctctgtttccttgtcagtttaagatgtacagagggaacagtgggatttggatctgggaactaggactctgttacagacatgatgactctagtatagttcttttatttcttatttatttatttatttttgagaaagggtgtcactttttttgcccaagctggagtgtagtggcgggaatgctgctcactgcagccttgacctcccgaactcaagcgatccttcctcctcagcctcgcaggtagctgggactacaggagtccaccaccatgcccactgatttttgtattttttgtagagatggggtttcaccatgttgcccaggccggtctcaaactcctgagctcaagtaatccacccgcctcagcgtcccaaagtgctgggattacaggcgtgagtcactgcacggggactccagtatattccttttagaccctcagtttcatttacgac

SEQ ID NO: 86532 - DNA, 1034 bp, Homo sapiens
tcaagcagttctctgcatcagcctcccaagtagctgggattataggtgcttgccaccacgcccagctaatttttgtatttttagtggagatgaggtttcactgtcttggccaggctggtcttgaactcctgaccttgtgatccacctaccttggcctcttaaagtgctgggattacaggcatgaaccaccgcgcctggctaactttttgtatttttagtagagatggggtttcactatgttggctaggctggtctcaaacttctgatctcaggtgatctgtccacctcggccccccaaattgctgggattacaggcatgagccaccgcgccttgcctccaataacctttcttaaagctttgtatgtacttaggaaattgtgcagaaattaataacataagctatgaggctgaggaagggattaaacttgcttgaagggtatcttgtgatggagatgtgggtgtcaaaactaggctcatccctgcctctttgtatccttagcccacttataagaagcgaaggttggatgagtgtgaagaagccttccaaggtaagaggcacccttacctcacctcccctcaccccatccctgacttgcaaccctgagaagcaggatggatctagtgttctcctgaccaggaggcaagatctaatcttacttcccagaggtagcattcccagctcctccaaacgtgcttgttattgagtgctctaaacctggttttccaataaacagaggatttaagacttttgttatgttttagacgctcatctgtagttctttttttccatacattctcgttgattctaatagtggtgtcatggtaggattgtgacaaaggcagaggtcatagcatctgataggtatagggaaaatgagagagaggcaggggatgctgtgtccttccctcttccctgatcatttgaccttcacatctctgccaggaaccaaggtgtttgtgatgcccaatgggatgctgaaaagcaaccagcagctggtggacattattgagaaagtgaaacctgagatccggc

SEQ ID NO: 86533 - DNA, 1036 bp, Homo sapiens
tcctgggttcaagtgattctcctgcctcagcctcccgagtagctgggattacaggtacctgccaacacacccagctactttttgtatttttagtagagacggggtttcaccattttggccatggttagccaggctggtctcgaactcctgacctcaggtgatccacccgcttcggggtcccaaattgctgggattaccggcatgagccaccatgcctggccagactaggtattttgacttctgtgttcctggcatctggctccagccgtctgaattgtgtacttcatggcttcagccttcaggcaaaggtcctcatatatgttttgacctccaggtcaaaatgtgggtacagctcctgattcccaggatagaagatggaaacaactttggggtgtccattcaggtaatgtacttgaattacatactgggaagagtggcttgggagatactctcatctcccctgcgttacctttttttcctttttctttggggctgctgtggatgacatggaagtggcttttgatgcacctgttgtttgtttgttttaggaggaaacagttgcagagctaagaactgttgagagtgaagctgcatcttatctggaccagatttctaggtagggctgcttgggcttggccgaggcgttgggggctgatgaggtggtgggcaccatcaagggtctcctgcatcttcctcctcttctctctctttccagatattatattacaagagccaaattggtttctaaaatagctaaatatccccatgtggtaagtaaggggtttgtggcctgagggtggaggtggcaggatagtgaagagtgactgttactgggaaggagctgtctggaaacaattgggctttggggactagctttttcctgtaccctccttgcaggaggactatcgccgcaccgtgacagagattgatgagaaagaatatatcagccttcggctcatcatatcagagctgaggaatcaatatgtgagtaatctcagtccttgtccatagttgctgtggcttctcttagttctgt

SEQ ID NO: 86534 - DNA, 2537 bp, Homo sapiens
aaaaaaaaaaaaaatacagtaagtcttcacttaatgttgtccataggttcttagaaactgcgactttaaaaatgatgtatatcaaaaccaagtttttttttcattaacattgtaacaaaatgacatcgaacaaaatgatgttatttgaaaccaggttatttgaggaccttctgtacttgatttgcttacctgctgtactttaatttccttcaagtcgcagttgctaagaacctattgatgacattaaggacttaccgtatgcagatgattgcttggggatttgtgaaggggtctctcattttcttgatgaggtaagggttgtacagatatgtgattcccctgatccctcttctctcaggtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcct

SEQ ID NO: 86535 - DNA, 1027 bp, Homo sapiens
ctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagaggtggagctacccaaggcacccatcttcctgtcgtccaccttcaactacaatggctctaccctggcagctgtgcatgccacccctcggggcttgcgctcaggggaccgagctacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttcatccctgaggtctcggaactctccaggtcctcttccccctcttcagttctcgccccagggttcccagtacagtgtgcaaggaaacctggtggtatcctccctctggtcatttacctttggccatggggtgttcagcggcctgaggatttttgatgttcggttccagggtgagc

SEQ ID NO: 86536 - DNA, 2354 bp, Homo sapiens
attccgtatttgagctgtggctctaaacaatagtcactagccatgtgtggcaactgggcacttcaagtgtggctagtgtgacagaggaactgaatatatatatatatatatatacatatatatatatatatatattttagacagagtcttgctctgttgcccaggctagagtgcagtggtgtgacctcagctcattgcagccacaacctactgggctcaagcaatcctcctaccccagcttcccaagtaactgggaccacaggcatgtaccaccatgcctggctgatttttttattgtttgtagagtcagggtttcaccacgttgcacaggctggtctcaaactcctgggctcacatgatccacccgcctcagcctcccaaagtgctgggattgcaggtgtgagccacctcagctggccctaagttttaattttcatagccacgtgtggctagtggttaccctatcggatagggcaagttggaagaagataggagcttgctcttgcccagacctcctggctcccagcacagtgtgctctgatgctctctctgccttttgtcacaccagtgcagtggacatcatggggaagacagggacctggcccagagaccttacctggtgtggaactcatctcctttccctccccctggcagggctgaaaaactgggtggtagctgaagacgtggtgtttaaacctgtggctgccccctggaacccggagcactggctacagcgcccacagctgactcggcaggtcctgggaaaggaggacctgacagctttttccttgggaagccccctaccccgctacctctacctggctagcaaccagactaatgcgtggggtcaccagcgcgggtaccgaatccagatccacagcccccttggcatacacatacccctggagagtgacatggagagggccctcagctgggggaggtgaggagggccctggcctgggtggaaggaaaggacagcccctcccctgccccagtccttggagacaaactcccttcccacggctaccattcatccctgtacctcccctcaaacccaagttagatacacggtgggaaatggtctcacacagaatcggatctaagggactcctgggccagtaaaggcacttgacatttcccaaaaccaccttcttatgattcctggccagataccagcttgtggtgacccagagaaaggaggaggagtcacagagcagtagcatctatcaccagaatgacatctggacacccacagttacctttgctgacttcatcaacaatgaaaccctcttaggagaggttggttgccctagggacataggaaagggacacctgtgggcatggcatcttggctgcccagcctctggccaaaggttagagggaatggctgatttccagttcgcagattcagaggccatggagttttctgatgaccaacacaggtcatccctcctggggtgagattagctctgggacactggctcccccctctccccgcacagctgcttacatggattgctccacgtgttgtatgggcatgaggctggggagagtggaagccaggctgagactggaggctgggattgtgactgaagggtggttctttgggtcacgcttccatagtcctccagctcctccttcttcttgcaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtctactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattagaggaattttacttgaatttattgtttgacctgttaagtatctagagtcctctggagaatactaaggagtctggccagggaaat

SEQ ID NO: 86537 - DNA, 1135 bp, Homo sapiens
tgcaagtgtttttttgagacaaagtttcactcttgttgcccaggctggagtgcaatggcaccatctcggctcactgcaacctctgcctcccgggttcaagcaattctcctgtctcagcttcctgagtagctgggattatggcgcataccaccatgcccggctgatttttttatttttagtagagacggggtttcatcctattggtcaggctggtcttgaagtcctgacctcaggtgatccacccactttggcctcccaaagtgctgggattacaggtgtgagccaccatgcccagcctatgtgcaagtgttttcaagaaagattcctagaagtcatctactcttcttatccctctcccagtccctggaaaaagactcagagctgcccttgtttttttttgtgacttttccctcaaagtctccctgactatacctctgttccccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaatggttgcgctaccacttgtatttatatgactaattcgtactgtatactccattgtgcttgtgtggttactttccgtttataaatagataattttctaatttagttcatgcactgtaatgtttagaaggtggtggattaatttataccaaaccttgtgcttttgcactcagttggataagaaatgaacatctgatcagctgagtccactgctcccataattttgttataatccacaaaggcacatggctttttcccgcccctaccgccccaccccctgagatggactcttgctttgttgcccaggctggatatagtggtgtgatctcagctcactgcaacctctgcctcccgggttgaagggattttcctgcctcagcctccagagtagccaggattacaggtgtgtgccaccatgcctggctgatttttttgtttttgttttttgtttttgtttgagatggagtctcgctctgtcaccaggctggag

SEQ ID NO: 86538 - DNA, 1080 bp, Homo sapiens
aatcacttgaacccgggaggcagaggttgtggtgagtggagatcacgccacagcactccggcctggaccaacagagtgagaccccatctcaaaaatataaaaaaaaaaagaaatatgttacataccaggcctcctgggtttgatattaacatatttactgtaactctgtatcttttgttttttgtgttttttttgagatggagtcttagtgtgtctggagtgcagtggcatgatctcggctcagtgtaacctgtgcctcctgggtccaagcggttctcgtgcttcagcctcccgagtagctgggggatcacaggcatgtgccaccacaccaggctaacttttgtatttttggtagagctggggtttccccatgttggccaggctggttttgaactcctgacctcaagcaatctgcccaccttggcctcccaaagtgctgagattacaggtgtgagccactgtgtccagcctgtatctttctttaggactgtcccctacctcctttactctctaacagatttctgcttatcctggtgaatcctatttaagggagatggaaacaaacctggaggttgattacaaactgcagaggctgagaagggcagcttgctggctttcagccagtactctctcttggctaagggatatgggactttatgtgtacataggcagcaaggccagcctcagaaggaggggccaggcttcctgcagtttcacagccaccactccaacctgggtctcatgtctgtgtcctttgttgtaggaaggagggtgattcagagttcatgaatatcattgccaatgagattgggtcagaggtaagaggagcatgagattctctaccccggcctggatagagacctagggagacataagtgaggggcgctagtttagccaaagtccctccacatgaacacatgaggaggaggaaatagccattcattcaatactgttttcttagtactagctatatgccaagctctgttttaggtgttgagctagatctatgttattgctctctctggggctgtgatgtttattagcttctgagctcctttcatcagagctctagctcctcaa

SEQ ID NO: 86539 - DNA, 1322 bp, Homo sapiens
aaaaaaaaaaaaaaaaaaaagtggtgagagggtatgcttgttccagtttttagaggaaaagctttcagctttttcttgttcagtaagatatgttatctgtggccactgtacttctgacagggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtaagggtagagccagagggatggtttctgcggaatgattcctcatcagattcagacagtccctcccctctccttgagtccaggtgagtggccggggtttgcctgatgatcatgctgggcccattcgggttgttaacatcgagggcgttgattccaacatgtgctgtgggacccatgtgagcaatctcagtgaccttcaggtaagtgaggaacggctgtggagtggctgagaagagggattgggggagaggggatcacatggggctgggagtgggagagggggataatcgaggagtcctaagtgaaatctccccttcactgtttcagagctgaggaacagataggtttctcctgccttcaggttctaggatccgctgtggtttatgcatgtgcacacgtgtgtgtgtgtgttacccccttgcctcatgtaggtcattaagattctgggcactgagaaggggaaaaagaacagaaccaacctgatatttctgtctgggaaccgggtgctgaagtggatggagagaagtcatggaactgaaaaagcactgactgctctgcttaagtatgcctgtttcagtaccttcgattacctcccatttctgagattttcgacataatctcttacctctgggagataagatgcaatcgtaaatgataaagtgcggccaggcgtggtggcccacatctgtaatcccagcactttgggaggccgaggtgggcggatcacgaggtcaggagatcaagaccttcctggctaacaccgtgaaaccccgtctctactaaaaatacaaaaagaacttagccaggcatggtggtgggcgcctgtagtcccagctactcgagaggctgaggcaggagaatggcgtgaacccgggaggtggagcttgcagtgagccaagatcgttccactgcactccagcctgggcgatagagcaagactctgtctcaaaaaaaaaaaaaaaaaaaagatcaagtgctttggatagtaaatcagaaccacgaaaagtggttaattcctttgtatgttttctcccagttgcctaag

SEQ ID NO: 86540 - DNA, 1038 bp, Homo sapiens
ccccgacaggcaccaataaatgccctatttttttccctgtgtctcccaagagaaaaagtaaatttcagattgtgttccccctcctagcgccagagaaaggaactacaacaaagcctagctgctgagtccagagcgcacagcacagtcgccctcccagctcttccgtcggccgggaggagtctcctttgctcttgtctactgctggagctgctaataaagtttcattcgaatacttgagctgccgcgccctgcgtttccctcatgagcttcttccgcccgcaacacgagactcagcaccacacaatcagcgtggcaaagcctgaagggcgggacaggaagtgaggtcactcctcaccggggtgaaaggttagcggaagtgtccttctttcctttttgctggtagggccgggtggttgctgccggtaagtagaagcttgggttgaatctttcaatccgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaaggtatcagcctcgcgggactctgcgtccttgcatgccgggaccaggctggctgcggcggggcgggcaggcttggaattcaaggcctgtttctggggcagtagccagtgagcacggtcagggtgaacgtgggagagtttttgagagaggaagaagcacagtaaaagcaaatgtgagctgaattgggctcccaacgcataaagccttctccaccagaggctttaaatatatagtaatagtggctgacattgcacgcttg

SEQ ID NO: 86541 - DNA, 1006 bp, Homo sapiens
tttcaggtattgtcatgtgcagtccttgaagtaatcataggggattccttttcttttcttttcttttttttttttttgagacgggatctctgtccaggctaagtgcagtggcgtgatcactgcagcctcgacctcccgggctcaagcgagtctcccatctcagcctctcgagtggctgggactacaggtgcgtgccaccatccccagctatagggggttccttcctgttgctaaggtttggaggtgttctgttatttacctgaagtgctgcagctgggaatctgtaagaagaggaggaaattgcttttagaaaggtcacatagcccctcactgttttcctcttatccatgattttgtagcttcttgagagagttccctaggctctggccacatacaccactgcgttttgttgttgtggggacactggagtacccctggattcccctctcccatctcctgagactgatctctggagttaggctgtggtgtcttaaccttggctgtacacttcactagcagtggagcaagtgaatagataccaagtcctgtgagcagtgcttggcatatagcaagtacttcttaaatgttaactgttgctacttttaaatctcttacctctagtaagccgttccagatgcttcctgatggagataaacactgttctgtttctctttggtcatttctcatagctttctgtgatttttctctttataatggtggatcttggagacctgagggtggaaatattttttggacactgcactacctctaacacagggcctaaataggccctcagtgaataacaaatgtaattcttactcatttagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtgagcatt

SEQ ID NO: 86542 - DNA, 1034 bp, Homo sapiens
aggcgtgagccaccgtgcccggccagtacaagtgttttttaagaagtacaagaggccgggcacaatggctcacgcctgtaatcccatcactttgggaggccaaggcggatggatcacctgaggtcaggagtttgagactagcctgaccaacatggtgaaaccctgtctctactaaaaatacaaaattagctgggcatggtaatcctgtaatcccagctatttgggaggctgaggcagaagaatcgcttgaacccgggaggtggaggttgcagtgagccaagatcacaccattgtactccagcctgggcaaggagagcaaagctccgtctcaaagaggtgcaaggccgggcacagtggctcacgcctacaatcccagcactttgggaggccgaggcgagcggatcacagggtcaggagatcgagaccgcactggctaacacggtgaacctgggaggtggagattgcagggagccgagatcacaccactgcacctccagcaaaagaggtgcgagaattgagaaagtcctgaacaataattgccagaacccagcagcatgcaccttaaagtttgctgctggtattgcacatttactctgggttggctgacctaaaggggcagagagaggccggacaccatggctcacgcctgtaatcccagcactttgggaggccgaggcaggtggatcgcttgaggtcaggagttcgagaccaacctggccaacgtgatgaaatctcatctctactaaaaaaaattagctgggcatggtggctggcacatgtaatcccagctattccggaggctgaggtgggagaatcgcttgagtttgggaggtggaggctacagtgagctgagatggcaccactgcactccagcctgggtgacagagcgagactccatctcaaaaaataaaaataataataaaagggcagagagagctgtttcttgggtgctgggatgtggtggggttgaggcagctagtgtttgggctgtcatgagagtgactgcattggcagaacttgaacaataaggaaat

SEQ ID NO: 86543 - DNA, 1050 bp, Homo sapiens
ccaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaaggtaagctcatggggagcctcaggagggaggtggggagggttcccagtactgaccctgtttcccaccacccagtggctgagcaggtgctgcaacaaaaggagcacacgatcaacatggaggagtgccggctgcgggtgcaggtccagcccttggagctgcccatggtcaccaccatccaggtgatggtatgacagaatcctggggcatgcaaagcatgccatgcacctgggcatggggaagtggagctgtgtctgggaccaccccttgctgtctccccctagatgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggaggtgagggctatgcaggcctcctgcaggggagagggtatagggtgtgcaagattacggtgcagggagaggagagggcttgatgctaaaggcccacccctccttgctccccacagtggctcagcgtctgtgccaaatcggccagttcacagtgccactgggtgggcagcaagtccctctgagagtctctccgtatgtgaacggggagatccagaaggctgaggtaagcaggaggggtgaagaacaggggctgggctgggtaacctgtctgcctgccaggaacttgcccaatgaaggatcagaggccccaaaccccactgacctacctacccaccatcagcctctccaggcctcccgacctcatacccccatggggcactgcctgccctacccccagcccccagcccttctcccatgagcctttgccatctcc

SEQ ID NO: 86544 - DNA, 1035 bp, Homo sapiens
cttggtacacatggctgcaggtgacaggtcccctcactttatcaccccttaccccacccagatttccttccaggccccttccctgcagcctgtctgggttgttgtcatggcaacaccaggctgccttggcctgtggctcccagaggcctctgctgtgtagttgccgtggtaacattcaggcaccaggtctagtctggtgtgctatccttagcaacgtgccctcaccccacacccccacctctctagctaccttccccaccacttctcagtcatggaaattagacacggccctaaaatgagcgtaggcaaaatgaaggtgacaggctgagtccctgggaggctagaatggagtggttggtggccagggcaactccatatcccctgcttatgggtgtcttgctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggtggggggcataatatgggagggggtagggaggcacaggacagggaggggagctccagatctgtggatcctaatgttgttcttgggttcccctactctatgacaggagtggacattgtcatggaccctctgggtgggtcagatactgccaagggctacaacctcctgaaacccatgggcaaagtcgtcacctatggtgagttagtgggccagggatggagagagcatgtgagggcaggagggagggtctaaggggtgggatatagaggccagggcttttgaatgaagaaggggtagggactcaggtgctctgtagacgatcagggttaggaatggtcctgtatgctgcattcagattgctgactcttgggtaccagctcttttcattctctgtcacaacttttcatatgagtgatagtaaattctacattcttttttttttttttttttttttgagatg

SEQ ID NO: 86545 - DNA, 1040 bp, Homo sapiens
tcctggtgtctgggttggggaggggtcatggccctgatttggatggcctgagggttagcatgagccagggtaagtgagacttgttctgggtcaaatctgggactggccatgaccctaaatgaccaatgcactcctcgcagctctcctgggttgttctgtatctgctagtcctgagtccctgggtggagggcttccgttcttgttctccagacctcatctcaggccagaacttggaaggaaagaccccagcatgccctcagttctcgtattcagtggagtgtgggggcttgaggacatgaaaaagggcgtaagtggcagtcccatcccccttccccatggaccctaactcttgttaatatacagaattcccatcattcctggcagggatcaagacagacccagattgtcccagaacagcacccacacctccctcttcatgctcttcagagagcgcagagaagtcttttctcctgacgctccctccttttccctgcccttcccttgaccccacttgctaagctggagagaaaggttctgttatctttgtcccctttccctcctgcacagaggctctcgtgggggtgggggggaagccttttactgctgcgtaggcctctgtagcccttcttgtctgttgcccctcctgcaccatctctgagtgaagatgttttctgggctcccagtgctggctcaaacacacttctcccgaggtgaccacaccctgctgtaagcgctcagagaactttgcctgcactttggtatggccctgaccacacagtgccgtcttcttttggttgtgtgacttccttgctgctattatattattattattattattgttagctaacattattaagtgcttattatgtgccagacattgtgctaaaattttttttttccatttggaaaaactgccctaattgacagataagaaaactggagctggaaaagtggagctcaaaaagattaagtaatttttatgcatccgaagtcacacagtcagtaaacagttgagaccgcttttgtaaccacagcagttt

SEQ ID NO: 86546 - DNA, 1024 bp, Homo sapiens
cgttcctggtgccccttttcgtgctctcccagcttgcgccactatggccctggccctttaaggctgagcgcgaggccccgcctcgcccggcgccccgcccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggtgagcgggttgcgtagggcagggcagggctgcgcaggccactgggcagtggggcacgagtgggcgagcgccgggggtgtggcagggcgggagaaactggcgcggacctgggtgcacgagcgtggaaagcgtagccaaggaacttgtgtttgggggctcctggagagcggcatttatgtggggaggggagacgaaattatcgccccttccccaaccatttttagttgtggccgccgcccagaagctgtgctggtgggggggaaaacaataaggtgcccatgcgcatgcgcacaaccacactaccgtccccaccccccccccccccccccattaaaaccacacctgtacccctacccaccaaacactctctgggtaattgtggtctgtgactatgagtgacggttagtgccccctttccccgagggagcttgagggg

SEQ ID NO: 86547 - DNA, 1041 bp, Homo sapiens
caagggaggcacaaagtcactgaaggagaccactgttttgttgctgtcctctaggcagcgactgcgtccccccagagccccctccttctctgagccccttctgcagcgtggcgaaatctcacaaatgcaagcttttgcccccagggaggtggggaggcagtgatcaagaaagaaacctgacaaacccagaccaaccatgggggtctccctcctgttaacacccctccctaacagccctcctggtggttccctgtctgcccctcccctttatgggtcaagcctgctggcgtctgtttcattgtgctgtgggggaaggggagagtcaggggtgagtgggtgtctgtgtgcatgaacataaggcctccgggttcattctgacactgaatgaaaaactcaccaattattcgtccagtctcattaatatgcagacagacatctgttatttaggagtcaacagcagaggcattttcttgtcgggaggggcactagtgtacagggctctcttgtctctccgctgctagcgggtagctactcaggaatcatcccacacctcccgacctggagcctcccctctctctgaccctcactcacagctttgaggacagcaagtaagggattgaccagacagagatggagggagatctgggaacctggctggaaggaaggaagcaggagaggagctgccttgtgtagaacaaactgagaacaaaacgctaaaccctttcctggggaagagaatgtggagttgggggagagagctgtgccaagagtgcctgccccactgggaatctcagggacatgacccctccccccacaccttcctcagcctgcaggacaagtctgagtgcatctgaagcagggagagggtcactatggcaacatgaagtcctcacccagagactgcagaaaacgtaataagaggagttcagaaaaatggagaccaagggacctcaatctttttttttttttttcaatttatttatttttttttattgatcattcttgggtgtttctcgcagagggggatttggcagggaggga

SEQ ID NO: 86548 - DNA, 1016 bp, Homo sapiens
aagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagag

SEQ ID NO: 86549 - DNA, 1045 bp, Homo sapiens
tctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaaacaaaaagtagccaggcctggtggagcatgcctgtaatgccagctatttgggaagttgaggtgtgagcatcgcttgaacgtgggaggcagaggttgcagtgagccaagattgcaccactgcactccagactgggtgacagagtgagactttgtctaaaaaaaaaaaaaaagagagagagagaaaagctaggtgcggtggctcacgcctgtaatcccagcactttgggaggctgaggtgggcagatcacgaggtcaagagatcgagaccat

SEQ ID NO: 86550 - DNA, 1051 bp, Homo sapiens
cccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccag

SEQ ID NO: 86551 - DNA, 1053 bp, Homo sapiens
taatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtac

SEQ ID NO: 86552 - DNA, 1016 bp, Homo sapiens
tttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcttgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctacta

SEQ ID NO: 86553 - DNA, 1252 bp, Homo sapiens
atttttcccttcttgtgccatttcatcattagttccatgtattatttaagatttcttatcaaccagcaccttgggatttttttgtgtatgtgttggtttagggggtttatttgtttttttcttttttttcggtaattgaaaatgtgaagcaaaatgtcacctgttttttctttcatgtctgacactcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtc

SEQ ID NO: 86554 - DNA, 1018 bp, Homo sapiens
taaattactgggactaggattttggtgtttgatacatgttactaaattgttttttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttggagttgtcaagaaacctttgagatgactccccactctgtatctgagctgtcaccagtattctccacttcttcaggattgccatggcaactaaattgatgaaaagatttaggaggccttttctctctttgcaattcctatgatcctttttgaatgtgggtttgggactctgtcaatatacccatcatctaattctgtccattgtgttttaaagtttaaggttgcaatttctgattacatctgccttagccatactgtattatatttgacattcaatatacaatgtccttgtttttctgtatttctaatcttattcccagagatgtgtctatttgttcaggattcattttgcaacgtgtttttactaagcatctacccaaaaccgttgaagtcagatttcaggctgtcttacgtctaaagtagcacaggcaggaaaaactattgaagtgggatttttttttccctttttgtactgaaccgagaaaaagtatatagatgatagagaattcctaatttggtatcattgatatctgggtttttgtttgtttttacagaagactgattaactatacttatttattaatttatcttctcattaataaacacttgctgagtgcttactgtctgctaggcattagggagacaaatatgattaagggaagcttcctcctatcaaggtcatgtgttccatttgggtatactaatgcattagcaatgtaaatcaagtagtgagagatcatctgttcccgataggagatggatta

SEQ ID NO: 86555 - DNA, 3327 bp, Homo sapiens
tggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaat

SEQ ID NO: 86556 - DNA, 1008 bp, Homo sapiens
attaaagcagccagtgtaaatattgaaactttttggcctggcttgtttgcaaaggtcctggccaacgtcaacattgggagccacatctgcagtgtagagggggggaaaaaaacgtgactgcgcgtcgtgagctcgctgagacgttctggacgggggacaggccgtggggtttctcagataactgggcccctgggctcaggaggcctgcaccctctgctctgggttaaggtagaagagccccgggaaagggacaggggcccaagggatgctccgggggacgggcgggggaaagtgaatttccgaagctaggcagatgggtattcttatgcgaggggcgggggcggaacctgagaggcataaggcgttgtgaaccccccggggaagggggcagtttgtaggtctcgagggaagcactaaggatcaggttgggggcacagtgtgtccgaggaggaatcctcctgataggaactggaatgtgccttgaaggggacaccatgtgtataagaacatcagctggtcgccggggatggtggcttacgcctgtattcctagcactttgggaggccaaggcggatggatcacgaggtcaggagttcgagaccagcctgaccatcgtggtgaaaccccgtctctactaaaaatacaaaaattagccgggcgtggtggcgcgcgccagctactcaggagctgaggcaggagaatcgcttgaacccaggaggcggaggttgcagtgagccgagatcgcgccattgcactccagcctgggtggcagaacgacactccgtctcaaaaacaaacaaagaaataaacaccggctggtatatatgagaagatgggcccttgcggaagaagaagtgccaggaatatgtctgggaaggggaggagacaggattttgtgggagggagaacttaagaactggatccatttgtgctattgagaaagcgcaagagggaagtagaggagcgtcagtagtaacagatgctgccggcagggatgtgcttgagggg

SEQ ID NO: 86557 - DNA, 3391 bp, Homo sapiens
atgtcctaaatggtattgcctaggttttcttctagggtttttatggttttagatcttatgtttaagtctttaatccaccttgagttaatttttgtataaggtgtaaggaaggggtccagtttcagttttctacatatggctagccagttttcccagcaccgtttattaaatagggaatcctttccccattgcctgtttcagtctatccaatttctagatttatttctcattgtctttgttgtaagatttgcacatttatcagagatttgggaattagtgtgctcctctctctgacttttgaaactggtaatagtttacttctgtagaaggggagcaggctagagactttgttttcctttagtacgccttcatactgtgactttttaaaaaattatatacttgtatgatttcacaaaagaaacctcaaaataatacactccaggaaaagtattttaaatagaaaaagtaacctctaacatctcggcttgtgttttctcccagtcgtttccacttgttccatgtgacacagaccagcctcaagacaagcccccagactggttcacaagctacctggagacggtgagtgttctgtctcgcttgggttttaactgcggtgttggcacaggtggaatgtggaagaaatagaaaactgaacccaggtggctgctgcctctagtaccggtgaagagtggtagcttataatttccaaacttagaacagttccagtcgagaaagctctaacctttgcagtgaagtgtcagaaaaagagggagtctaattctaagcatgtaagggagagggacaactctctgcttgagaaaaagttagaaatttacttatcaaaaggatgttttgatattttcttcgaaccagtttagctgtggaaggaatagaccttttgctatgtttctgtctattcagtagcagttgtttattgtgtttttgtattataccagagacagttaggtttcagatctattgatatcttcacatttttttctgatattggaactgagttttttccctaccttctgctccatattctagttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtaggtaagcagttgcttgggagtagctagctagtgatagaccttacagcttttacctccctggctttctgtgtaggtaaagggaaattaattgtaccctgtttctgagcattagatgttgtagctgtgagttggaagcacaagctactcttcacccacatgctttgtatgttgtaactattcagattgttgtgttcaaatgtgcatttggattagcaaagccaggcaaaattatgttcccctgaacggacaaaattagatcactaagggtagttcctcggttgttccaaatgcctttttttttttttttttggtgacagggtctctgtcacccaggctggagtgcagggtgcaatcatggttcactgcagcctcaccctcccaggctcagacaatcctcccacttcagcctgccaagtagctgggatcacagactgccttttaattatttttttggagatggggtctccctatattgcccaggctagtctcaaactactggactcaaatgatcctcttctccatggcctcccaaagtgctgggattacagacatgagccactgtgcctggccccatgtactttcacatcttaccttcctcccatagattttcatttaaaatggatatgggttaagtgttattatcctcattttattaatgaggaaaattgaggcatggcatagtcagatggcatgctcaggttacctgctagttggtactggagcaaacatagaagtatggtcttatatctccctaccccaggtacttcctattctgccattgtgtattgtgccattctttccccacagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggtaaaaccctctacatggagatgcttattctctgattgacttcttggttctggtgacagggtatgaatcacaaaactacagatagtctccttagttctgctcattttcaattgatgtgcaataatgaagacagttatccaaagttagtgaaatagaaataatagctataaaaagaaattaagaaactaaagtaggctgggcacaatggcccataactgttatctcagcaacttgaggggctaaggtgggaggagtgcttgaagccaaatatttgagaccagcctgggcaacatagcaagatcccgcctctacaaaaaaaatttaaaaattagccaggcgtggtggtgcgtacctatagtttcagctacttgggagtctgaggtgagcagattgcttgagcccaggaatatgaggtggaagggagccatgattagaccactgtactccagcctacatgacagagtgagaccctaattctaaaacaaaaaaagaaattaaactggaagctgacactgatggaaattgcaattggctccacatagcttcagaatttatttgtgactttcttttaagacttgcttttattatctcacaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgtaagcccaggactggggtgggagccaaaactttaggcccagctctctgaaactggaacttcaaccaatttccgtcttatttattggtagcccttaacacctaaatctttaaaactttccattatctggtcttagtattttttgtttgtttgttttttgagacagagtcttgctctgtcacccaggcggtagtgcagtggtgcgatctcggctcactgccagctctgctttcgggttcacgccattctcctgcctcagcctcctgagtagctgggactacaagcacccgccaccacgcctggctaattttttgtatttttagtagagatggggtttcaccgtgttagcca

SEQ ID NO: 86558 - DNA, 1027 bp, Homo sapiens
tgcagtgagccaggattgtgccattgctctccagcctggatgacagagtgaaacccaatctcaaaaaacaaacaaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaaaaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgatgatatgatgctttctcttgattgatggttctcctgtcttcattctccagatgtgactccctgcatgtctcctctgccacatgacagtcctttaatagagaagccaggcttggggcagatagaggaagagaatgaaggggcaggatttaaagcacttcctggtaagggattaaacatttgtaaagtatttgcatcctccctttccatatcataccctattttacagctatcccctactgaccctaccttagcatgtaaatgggcttgctttctgtagcatctcatgttttgaagtctcctcaccttcacatggcacagatagcagctattccttggtttagttttagcatgggta

SEQ ID NO: 86559 - DNA, 1052 bp, Homo sapiens
gggtggcacctgaattgtgactgccagacttgactagttagatgtgctcttcttcactgagactgaagggagagtgatcttagttagaagttctgatcttggcggggcgtggtggctcaagcctgtaatcccagcactttgggaggccaaggcaggcggatcacaaggtcaggagatcaagtccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggattctgcagtaaggaatcttcctgtaatttgacagagctccttagcagagacccctatgggtagctgagttgtctgctttctccaagggcagcagtcccagaaacagtggatagaagcaggagtaccaacaaagtttctcaaggttaaattctgctgtaataaatacctttataggccgggcacagtggctcacccttgtaatcctagcactttatgaggctgaggcgggtggatcacctgaggttgggagttcgagaccagcctgaccgacatggagaaaccccatctctactaaaaatactaaaaattagccaggtgtggtggctacatgccaaggattacatgcctgtaatcccaggtacttgggaggctgaggcaggagaatcactttaacccgggaggcgaaggctgtggttagccgagatggcgccattgcactccagcctggcaacaagagtgaaactccgtctcaaaaaaaaaaaaaggaataaat

SEQ ID NO: 86560 - DNA, 1026 bp, Homo sapiens
tgatccagctactcaagacgctgaggcaggagaactgcttgaacccgggaagccaaggttgcagtgagctgagatcgcaccactgcactccagcctgggtgacagagcgagactccgtctaaaaaaaaaaaataataaagtgtacatgtggccaggtgcggtggctcatacctgtaatcccagcacgttgggaggccgaggtgggcggatcatgaggtcaggagatgaagactatcctggctaacacggtgaaaccccatctctactaaaaatacaaaaaataagctgggtgtggtggcgggcgcacctgtaatcccagctactcgggaggctgaggcaggagaatggcgtgaacctgggaggtgcagcttgcagtgagctgagatcatgctactgcacttcagcctgggcaacagagtgagactccatctcaaatcaatcagtcatgtatatctttatatttttttccacatgtgtgtacaaatacataacaaaaaggtctggaaagacagtaccaaaatgttcacagctgttattctgataggatttatgggtaattttttttttttttttgagataaggtctcactcgcccaggctaaagtgcgagtagcaagtttatggctcattgcagccacaacatcctggggtccccctacctctgtttcccaagcaactgggaccacagccacatgctaccacaatgagctaaatttttttttttttgtagagatgggatttcgccacgttgcccaggctggtcccaaacttctgagctcaagcagtctgcctgccttggcctcccaacgtgctgggattttaggcgtaagccaccacacctggcctgggtagctttttttttttttgggacacagtctctgtcacccaggctggagtgcagcagcgcggtctcggctgactgcaacctccgccttcccaggttcacaccattctcctgcctcagcctcccgagtagctggcactacaggcgcccgccaccatgcccgggtaatttttttgtattttt

SEQ ID NO: 86561 - DNA, 1033 bp, Homo sapiens
atagagcttcttggaaacctgagtgtttctgcctaccttgtttctgtgagctttgattctattttgttttgcatagtcttcaaacttagaatatggtcatagttccagaaccagcccttccctttagttcttccctctcctctggctttcataattctagcttatgatccacaaggctttaccaagtaaggatagtacttaggcctgcttttagcttccaccttaaaattggttgctttcatcctttagtgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccctcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttgattattgagagctggttgtgtttttttttttttttttttgagacagggtctcagtctgttgcccaggctggagtgcagtggcacaatcttggctcactgccac

SEQ ID NO: 86562 - DNA, 2524 bp, Homo sapiens
tacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccaggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatactttaaaaaaaaaaaaaaagacttcaaacactgtgatcagattgccacctgcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggctttgagcaacactgaacaaacggctaaagctgatgtttaagagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccagcctggctgacaagtgaaacaacatcaaaaaaaaaaaagagtgttttatgtttcagacaaggaaatagtgtccacaaattacctcactcttagcactggggaaaaggtagaaaggttaagcccagtatacatttaaataattttttcttggacatacctggttctctgcttccactcatattaggccagtgtccagaaaatcacatttcctttgcaaggtgttttctctgagagaataattgagcagacaaactgttgatatccttgtgtgtcctcgatcacattaattttcagctaggagtgagagccatcatggttaccagagtggtgtgtttcctgcagtgcccctatcttgcttgcaccagtagagctgggccctccatcaaaccatgatctgtagctataaagctgataatgaaagcaattgtgttctctttttccatctaattttttctcttaaggaaatcttattccaaggattagagcccagattatcttgtaaaaaggtaatgatttgtgtttgtttggggagataatttggttttcctctgcaggcaccatcatgggagcagcattgctggaggactggtgaagggggctttgtctgttgctgcctctgcatacaaggccctgtttgctgggccaccagtcactgcacaggtcagtgtgtgtgttttattttcctgaatctcaactccatgtcaccagtgaaagtgatggcatctgtctgggttgaagagtaacatggcattgtggaaagggcataggctttagatttagtctttagttaacacacaacacaactctgccactttttttttttttttttgagacgaagtctcgctctgttgcccaggctggggtgcagtggcgcgatctcggctcactgcaagctccacctcctgggttcacaccattctcctgactcagcctcccgagtagctgggactacaggcgcctgccactacacccggctaattttttgtattttttagtagagacgatgtttcaccgtgttagccaggatggtctcaatctcgtgacttcatgatcttcccgcttcagcctcccaaagtgctgggattacaggtgtgagc

SEQ ID NO: 86563 - DNA, 2271 bp, Homo sapiens
ccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattatacagaatttttttttttttttttgctttgcttgtctctacacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctacccggactggctagtccttgcggaagcagcgtccgggccctcgggtaacgtttgaagagctggcagcgtctcaggctgctgcgtggcgaaggggcggaccgggggacgggggggtgggcccttaggggctggggcgggacttccctgggcactgagtcaaagcttgaggggagtgttcgctcccgcattttcgattccactctcttccgtttctgtcgctgcagtcgtccgcgggtaaggccctccctagac

SEQ ID NO: 86564 - DNA, 1048 bp, Homo sapiens
ctcactcagctacacctcatgggcagagagtcttccaagctgaccccatgaatctttgttggctcttgggaatagcaagtctagccccttttctgagtctcaccttgcctataagttattaggggcaacaggcatagggctgtctggaagctgctggaaaacaggtggggcagctgtcccaggtaccttggcagagtggggagccagagggaagggcaaatgagggagctccccgctccccacccccagacagtataatggggccagagctttccttttcctcccagccatggcaacaaggcctgcttcctctccaggggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggcagtcccgtctgaatgtggagagagctgtagttttatctggcttttaaaacatggacctgccggctgggcgcagtggcttacacctgtaatccca

SEQ ID NO: 86565 - DNA, 1049 bp, Homo sapiens
aaggtgctggcttttgacatgctgtgaaactgccccaagggacagtcagataaaacaaattacttgcttcagaagcaaaccctgtctgtcaagttattggatacaagctgagaccccagagccctgctcacagataagtattcagtggagaaagtaggaagattactataagtctgaagttaaatatcctctttttccgacctccagtaaagggaaatgtattttggaacttatgtaaaaatgtctttgtgatttttgccttagaaaacaaacctgactcctttgttttaagtccaagggctgatggtccacccccagggatggggggtgtgtcctgtcacacaggaggtggtgctttgtgtggcttccagtctctgctggctctttaggagttcaatttgggaaagggaaaaataaggcaacttaagttgctgccatcagttcctgggatgaatggctaagtgatgatgctgatgaacaatttgcagctaagaggctgtttgggagttgaagaatagcccatgattgcagataaacaccacctgccatgctgtccaccgcagccccccttctacttgggaggcagaggttctccttttccttctctctccattgcttttatgctaatgctttagagctggatgagaaaaccggatttatagaaagtctagttggttcctctggcaaaagccatttccaattgaagcttgtctacattttaactaaatcagaaaaatggtggctgcagaggctctttaaaaaaaaaaagaaaaaattattggccgggcgcggtggctcacgcctgtaatcccagcactttgggaggccgaggggggcagatcacgaggtcaggagatcgagaccatcctggctaacacggtgaaaccccatctctactaaaaatacaaaaaattagctgggcgtggtggtgggcgcctgtagtcgcagctactcgggaggatgaggcaggagaatggcttgaaaacccaggaggcggagcttgcagtgagccgagactgagccactgcactccagcttaggcgacagag

SEQ ID NO: 86566 - DNA, 1046 bp, Homo sapiens
atagaatttgcttccccaccccatgtctccccatgaggagagtgttaatactattttattgtttgaccaccttcatggtacttttctcttgagtttaagaccattttcttttgttagttccagtaagggtagaaattggttgggggaaaaatattttttggcatgttccagatgtgtctggctctccctcaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggtaggtgagatggtcagcctgttcttacatgtgatggccaagggaatggaagaggacagcaagtgagacagctcccttgtttttgtgccttaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacaggttggggcctttagttttcatgaccagatagtcattcagcatgtagcatggtgcttaggggtgtgccctggagcacgatggcctgggataacttttggccactgtattagtctgttttcacactcctgataaagacgtacctgagactgggcaatttactaaagaaagaggtttattggacttagaattccacttggttggggaggcctcacaattatggaggaaggtgaaaggcatatctcacatggcagtagacaagagagcttgtgcagggaaatgccctttttaaaaccatcagatctcatgagacttactcactatcgtgacaacagcgtgggaaagagctgcctccatgattcagttaccgtccactgggtccctcccacacacgtggaaattcaagatgagattt
